United States Patent 10,724,096 (METHODS AND COMPOSITIONS FOR INHIBITING AND TREATING NEUROLOGICAL CONDITIONS) - sequence listing, part 118

SEQ ID NO: 2132 - DNA, 205259 bp, Homo sapiens
ctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttattccttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcatgtgttgtttcctgactttttaatgattgccattctaactggtgtgagatggtatctcattgtggttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttaggttctttgtagattctggatattagccctttgtcagatgggtagattgcaaaaattttctcccattctgtaggttgcctgttcactctgattgtagtttcttttgaagatttattttttactaccatttttttgttggacttttaaaatgagtttggaagtgttccctctccttcaattttttttttttggaagagtttgaaaacaattatcattgattcttctttaaaagtttggtagaattctccaggaaagatatctggttttgggcttttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaaaagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgacgtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctcctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatagcatctttactacaatcacaaaacaaaactcattatgtttacttctcccctacccaaattttatgttattgatgtcataaatacatctttttatattgtgtatacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccctactttttgttactgatatgcctttcaattatttatatgttctagacacacagtacattattatcattgttttgttaacacctatatatgtttctttctgggatcattttccttctgaagaaattaacatttcctttagtgtggcctgctggtaaagaaacctttacgtttttatatatctggaaatgtcttaattttactatcacttttgagaaacagttttgggtattgaatgaaagttatttttgccagcacttttaagatgacattccatggtcttcttttgagatgatggctgtcaagtttattgttcaattagtgtgtctttttttctgtctagctactttgtatacttactctgtttttcacttttaacagctttactatcatgtgcccagtgttaatttgctttgtttttaatctcgcttgcagttttcaaagcttcttatatctgtgggttgataatattttatcagtttaagagaagatttagcagtatgccttcaaatacggcttctacttcatattttctcttatattcttctgtgactataagtacatgtatgttaaatcttttcaccatattccttgtcttttatgtgccatttctgtttttaaatcactttttctctttgtttcataatccatgttttattctgacccatcttttactttaggaattttatcttgttattctaggccactgtcaaagtcattgattgaattcttaacttgaatcgtggcatttttccattttagaattttattttcctttttaaaaatatatttctaacttgggtactggctaatgtcaaaagaaactttcctcccacaaagttttcactcacttgatcttggattttaaaatcagatataacctgagagattatcatttttctccatttaataatgaatcaggccaggcatggtggctcatgcctataatcccaacacctgtgtgggccatgacaggaggattgcttgagcccaggagttcaagatgagcctgagcaatatagggagactccatctttacaaaaaatgaaaaaaattagctagatgtggtggtgcacacctgtggtcccagctacttgggaggctgaagttggaggatggcttgagcctgaggctgcaatgaactttgactgtaccactgcactccagcctcggtcagagtgagactctttgtcacccagttgtatagaatcaactataggtagaggcataaaaaagatgcctgagattgcatctcttgaatttagcttcattgtccctttctattaagtgagattatttgacatgaacattgatattcactatctcagggatatgttagaactattctcatattttctatccacagaggatatataatatggatattttagcacattcccttatagggcagttataccttcctctgtgactcattatacaggcagcgctaagatgtgtattatatgctcatggtatcctttcttactatccttataatagaataaattaatttttatacagaattaatttttgaagaatcaaatgacatatgtgcataaattatttatacatttttatacaattgcttcaacatttcctcttctctgcaatctggtatatctatataatttctatagataagagaagaaaaatatagcttattaaaattttattctgggttttgtaaggaataaaggacatttgtacccttatgaagattaaattttcttgtgttagtatatttctaaaggcttttagtgaattaaatggagacactttaatatactacacagttttaaatctaaatttttttctcaaggaagaacttctgtttacacaatgatgcttaaacatgactgaaatatctaaaggagaggttaactggatcagtcaagaaaataatctgtaacatttgattgaagaaaatagcttagaagaagattttttaaaatgttcttttcctgtggagtctcccatgaaattcagattggataatctatagttactgagaaaggaatattcaaaataagagttgatcactgtagcacaaatgcaagtgataatttaaaaagtaaatataatttaacagatatgaaagtgaatcaaaagtcaagagtcttgtttcctcctgaaatatctatataagtacatgagatattttttccagactgagaggagcatgtgaactgatattgttgatgactttttctccattgagtatatcttttaaaatactcagtatttatcataatactctgcagattacaatgtacacattgttaatactacattgttaatttgccttttaaatacttaatatttacttttttcaaaggttatctttgtgtattttgtataaaattctactataatttattccatagctttgtagttttacattatttactgttatataatagaaagtggctaacatcagctaatgctgttttctaaatatttattatcattttcttatgtttttaaccattgtgtattaaaatatttcaaaattatcagtatgaaaactattaggcaaatagtctgggaaattgatttgtgtttcaacgatccaaatattagtgaaaagtcatgataatagagatagtaaaaatcttataagggaactggtaaatatatctttaaagattgtatcagaaacaattctatgacaatatcttgtttctttacaagtttgaattccagaaatcaagtgaatttcctctgactttgcattttctggtaatttcttttttcttatcaagctatattttaaatgtaaaagtatccaacaatagaattgctaatctcttggtccctcttgtcttcacaggtaagggatattttgtaatatttaaggaattttatggagtatatatacaagcagaatgttagctatttcttcaatagaaaacttggtgatattttcttttgcccatatttattaagtgaagtttactaaattttctaggtcgtgttcaaatcataccatccagtaaacagttgggagattaaaaagtaattaaactaatataaagatagcctggttaataaaatgatattcttttcaacatgattatatttactggaacctaaacattttgtgaaatagtatgtcatatagacaatattaggattttgacttgttatgtaagtacaaaggtatgtattttacaatttttaataattgctttatcagtaatagcaacttgaagaaatgctatctagatgcttctaatttgaaaatagtgcaaagacgatttaccaaagtcgttctattatgcttttgatttctagaaagctgaaatatccccattacagtttttgagtcaatacaaaaagtagataggtgttatagataaagaaataggttttcatcgatttgaaaattagaactccgagaagaaactcaggtaagaatgccattaaaatagttttagttgtttttgaaaataacatcaacaaaatgtcactattaaacagtgaaattggaataaaaatttgttttatgagtaacacggagatagcatacaaacattccattgactaatacagaaaaaactcaaaagttttaattagatatgtttaaatagagatgagaaaagtcaaaactttaactcttaaaagttatttttatcagtttggaaatatataaactcctccctatataaaatacaccagcacaaatttctctagtaaggattggggtttcatgactttagatgtatttttctgtaatattttaatgacgcacttatattgacgcattttaagatagagtttaatgatatattttgactagagataagtgatttaaagaataagaatcatgtcattgaaagtgagaatacttgagaaatattgacgaatataagctaaataaagcaaaacaaaataaaacacttaccctttcatccacatgatgtcgctggacaccggaaggtttttctcccttcccagcctcaaaggaatacagtgagtagattttccttagacagaaaggaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2133 - DNA, 156297 bp, Homo sapiens; identical to SEQ ID NO: 2129

SEQ ID NO: 2134 - DNA, 6389 bp, Homo sapiens
tctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctc

SEQ ID NO: 2135 - DNA, 2536 bp, Homo sapiens
gatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataa

SEQ ID NO: 2136 - DNA, 2446 bp, Homo sapiens
catggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtag

SEQ ID NO: 2137 - DNA, 144957 bp, Homo sapiens
tctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgagggtgagtgcgcgcccgcgcccgccgacccccggggacctgcccggcggtgcccgccctcggccctagagccccacgaggccgcccccgccctcccccacgcaccccgcccggcccacgcggctgcgcgaccttcgggacaggccaggcctttgacccaggacccgtaaacaacggccgggacctggcgcgtggggccgcggtggcctccggagtctgccaaacgcgcgtgcgggcgcctgcgcggcggggacctcgggccaccgtgcggggcccgcgcctgctctgcctgccgggtgttcagctcttccctgggccagcggcatagccagccgcgcggggtgaccgttcattccatgagcagtgacgctcacgtgtgcagggcactctgggcagacacggcctgggggacccactactgggtgttgcgcgggcgccctgcagggtgcggggctcagggcgtgcagggctgaggcctgggaggcctgcgagcaagaattgcagagatcccattaaaaatttttttttttaaattttttactgcgtgtgctcacgaaacactaccaacctcgtacgttttaaagattgttagagttgcaagggatagtctggtgtctttaagtgtaccgcttgcccagggcctcctgggagatacattctggaattttctgcttgggtggggaggttctgccccgggaccatgccctatagtgagatttcggattggtgagaggtgaggggagctgctgtggaaaggcagatggagaaaggccggcctcaggtgggtccccgggaaggagccctcccatagcgggtatgcagtacggtttccttaaaccacctgggcctgacatatcccctgggaactcttcctgtgcctccagggattagtgtaccccgggatgcaggtcccccattcatttcttccctgggactcttgtattcctagggatgtgtgtgccccgggaagacatatgacagatttgcctctaggcatgtgtgtgcccccatgcacctgctccccaggatttttgtacagtgcagggaacgcttggttccccagacattttctcccagggatgcctgtgcccccagggatgcgtgtcttcccacccgtgatcctgttccaagagggcagggtcttgtccccttcagtaggtctcctggcggataggtcactcttctctcaagccttacactggaggacccactgtagcttgtattggtcggtgttggtcacgtctcctaaatgacatgattagtggctgtcacccttctatcatccccactgttcttccatgcagtcatcagcaccctcaccagaaatcatttcggttcctctttatggcttgcaacgattatagacgcaagtgacgctcccctcccaattcagcccacagcctgtggagcgcccgccatgggccaggtgctgcttagaccccaggaagaaaagagcgggggcggggtgcttgctttcgtggaacggggaatgaatacatagacaactggcgctgtgatgacgtgccccggagcacatagaacagggcgatcagagccaggggaggcctctgaggaggggacacttgagtggaggccagaaggaaccagaggaaaaagtctttcatagaatggcaaggaaccggaatgttctgggctattgcagctttttctaggtgccgtttacgctctcggaataggaagaacacacacccaaagtaatggactgggcccaaattccaaagtacgcagtgcttctcctccttgcctgtatgaattgatgtgtgtctagaaaattcaggcccagcctggtttaattcaaatgcaccaagaattccggtagcaggaagcatcctgtgctgaatagaacgggcgtggaggcaggaggaggagcaggacgccgggcactgctgatgctgctttcgctgggggtgagctgggcgccctgcctcggttctcagggttggggtgcctggcaaacagagggccacaaaccctccttggatctaggcacaggaattgagggacaggctggattgggaagggtttagcggcttctgtgtggtctcctgggaagtggaagagtcaggaagactggataatgagggcttgaataattgagagtcgctggtatttccgcaagcccatttgccttggcaacatgcgcttctgccactccagggtggagcagcccctggccctgactttgggccgtcagagctatgctcggttgcctaccagggagtgacagggcgcttgggaggtttccacgaccctgcctgctgcaccgtcggcttcatttcctcctttgttagaaagttgagggtggatttgggagaacggatgtggctccgacatgttcctgagttgaggactctaagggaggagggggaagctgggggaaggggcgggctcatcggtgaggttccagattcaggcaggggtgtgacaaggcacggagggacttttgggagggatggttgggatgagtgacgtggcctgttccagaggagaggggttaggaaatgtggggccctggggtttggaggaagcagtgcaggaagtgtctgagaatgagcttcacggtgggcgtgattaaggctgatgtgctacgggaggcgtgtcacgtggtggcctgggtcagaaaagggaactgtgaccaactgtgggcattcagaaaatggaaaggaacgccggaaacccccagggctccccacagaagctctggggacgtgaaaggacagcgtgtttcaaacttgggttcagctttactggggcttggaggagcccgtgtgcagagaagaccaacaacacacagggttccccactgtgaccatgtgatgagaggccctgtaggtccagtgggccaggatggaggtcggggacagcccagctgctgctggaagtcctcagaggcggatggccggccctggccagtgtggaagaggtcgggtggagtgctccacacatttgccacaagaggcctgttctgtgctgcaccaggcactggacctcaggcgccactgcccagtggccagggtcaggtttctcagagacagctgaaggcagcggggcgagagcagccagtctggaggttctgtccctcttttctgagcaacacattcaggaagtttctatcccctgattaccttaaaaaatatgtatgtgtgggccaggtgaggtggctcacgcctgtaatcccagcactctgggaggccgaggtgggtggatcacctgaggtcgggaattcgagaccagcctggtcaacatggtgaaaccccatctccagtaaaaacgcaaaaattagccgggcatggtggcgtgtgcctgtaatcccagctacttgggaagctgaggcaggagaatcgcttgaacctgggaggtggaggttgcagtgagctgagattgcctcactgcgctgcaggctggtcaacagagtgagactccatatcaaatagaaaaaaaaaccatatatatatatatatatatatatattcatgtgtgtgtatatatattcacatatatatattgacgtatatttttaaagcagttttaggtttacagcgaaatctagcaaagaatacaaagtgtccccacctatcccttctcacctccatcagtgccccccggctgtgtggtagagtcgtgagccaacgctgagacatcattatctccgcaagctcatagtttacattaggggttgctcttgccgttggacattctgtggctctggatggatgtagagtgacatggacccaccattacagtcacctctggagcagcgtcactgaccccagaatcctctttctgctgcctatgcatccctccgtttccccaaatccctggcaaccacggatcatttttttgttttgtttttttggtttttgtttttgttttttttactgtatctgtgtttttgccttttccagactatcatctagttgtgatcataaagtgtacagtagcgttttcagattggcttcttccactcaatgatatacattgaaggcccttccatgtcttctcagggcttggtagctcattccttttttgactgaataatattccgttgtctggatgtgccagtttgttgatccattcacctgctgaaggacatcttggttgcttccaagttttggcagttatgaataaagctgctgtgtacatctacgtgtaggtttttgtgtggagataaggttttaattcatttgagctcaattgctggatcgtatggtaagagtgtgtctcgttttggaagaaactgccaaactctcttccaaagtggctgtgccacatttattcaccggtggcgaacgagagtcctggctgctctgcatcctcaccagtatttggtggtgtcagtgttctggattttggaattctgttaggtgtattgtggtgtcttgttgctgtttcaattcgcatttccctgatgaggtatgaagtggagcatctcttcagatgcttatttgccatctgtgtatcttcttcagtgaagtgtctattaaggtcattggctcatttgtattttatttatttttatttttattttatttttgagatagggtctcactgtagcccaggctggagtgcagtggcacgatcctggctcactgcagcctcaatctcctggggctcaagtgatcctcatgcctcagcttctggagtagttgggactacaggcacataccaccatgcccagctaatttttctattttttgtagagatggggtctcgctatgttacccaggctgctctcaaactcctggactcaggagatccacctgccttggcctcccaaagtgctaggattacatgcgtgagccacagtgcccggccttggcctatttttaaatctgcttgtttgtttccttactgttgagttggaagtgttcttcatatattttggatacaagtcatgtgttttgcaaatattttctcccagccagcggcttgtcttccctgtctcttgatcctgatatctcctaagcatttgatgtagagttaatgattaatgagcaagatattgagacctcatcaactagatctaaagaaatcactaggccagacacataatcccagcactttgggaggctgaggcaggtggatcacctaaggccaggagtttgagaccagcctggccaacgtggggaaacccggtctctactaaaaatagaaaaattagccaggcgtggtggctcacgcctgtaatcccagcactttgggaggctgaagcggcagatcacctgaggtcaggagtttgagaccagcctggccaacgtggtgaaaccccatctctactaaaaatacaaaaattagccgggcgtggtggcacacacctgtaatcccagctactcaggaggctgaggcaggagaatcactcgaacccgggaagcagaggttgcagtgagctgagatcgcgccactgcactccagcctgggagacaaagcgagactctgcctcaaaaaaaaaaaagaaaagaaaagaaatcactaggtagctgcgacattgaactgaaggttgaaagtattaagtttctttgtggactttaaataaccttcaggagagaaatctcaaagctctaaaccagcaaccgagaatttccttcagggcatccatcttttacacggagccatcagttgtgtagatgatgggttgccccaaaacactaagacgcaccagtgaagggaggggagctgtggcaggggggcctgcactgcccccgcctttccccccagcaacgcctgggctgggagctgggggtgggtgagaccctggctcaggccccactcaggacagtttgagggacaggcagatggggggactgagccatgggggtctcaccacccagacttggggttttgggcctccctggaggaagtggtcctggctgaatgtctaggatggatgtaaattagcccagggagggggagggggctcctgaggagacccccaggcaggctcccagtggctgagcaacggtgcagcctgtgggctgtggccagccctggtcgggggctggagaggtgagcagccctggcgtcccacaaacacaggagcttggaacccttgctggggcttggcaggggtggccgatttcagtggtgctttggggagtggggaatggacggaatgggggaacggcggggaggcaggctggcaggaatgtggcacggggcacaggcagtgccccgaggaggtggcgtgggtgggcgcaggcgtggctgtgatttccacgctgttttctagcgggctgcagcccctctgatgctgaaatgaaaaaggacccagatccttgtttgtgggaggggtgggaaaggatttgcaaggagtgtggtctcttttggacgatttttcagacttcttctcgtttccaggccctctgtgctcacgtgacccctctgatagcgtcagggcccgtagaaaagtggctgtggcatgttgggaaggccagcgggcctcctagccaacgaaaagggggagtggctggtccgaagttgggggatatagacaggtgagggaccagggccatagtcactgtggtttctatggggaagaggggatggtggaggtcctatttggagctgttgtgttgtgaggctctttacagaccctgccaacaaagagaaagacaattccacactgttatctctaaacccaaacctccttcgagcagaggccgtctccgtttggggatggacagctgttggtccaagaaggaaaggcacagtgaggtcactgcgacgctgcccagcaccttcatgggaaacgctcctcagggtggtgagtggaactccctggagaccattttccagtgagggcctatctctttcctcttgggctgagaggaagtgggtggctcagctacatttcctttgattattattctgactataatcttcaaaccctacatttctcattgtgtgttccgcccatgcgttctgttgtccggggcagcaaagtcgacctgcaccacgtgggtgtttttgttttcttttgttttgttttgttttcttgaaggcctactaagagctgtcggaaactctgcttctgtagaaaaggtaaaggcactgcttggccacaagtgatgactcttccctgcctttcggggcttggggaggaagggcaggttctcggtggttctcctagcaccttggttacaaacctcccagcagagtcagatcaccttggcaaccccacactcatcaaagggactctgccttgattccctccccaccgctgtggaattaatatcgattgcacatcctgaaattgcttaccctcgcgctccctgtccagtcgtcagaataattaaggggtgtttattggatgtaagtgggttcatccctgctgcgagtatggattttaagtgctccgttggattgattcctccctgctgtggttggcacagggcaggtacctttaccgagctgttttcttcttttcgaacatgcggttccatcacataaaagacataccctatgaaaatgtctctgccttagctgtacatgttacactttaggtttcaggtgaaaaattggtttatctcctaatatgtctgctatttgttacatcacatagaggctgcaaaacagattaataagctttggaggatattataagcatacgttggcccaatggtattaatttgcttatccatactaattgctgtcttggtaaaagaaggcggacacaatgcaatcaatcctagaagtgttctgtggctttgcaactttgagatacctcaggctgacatattcaaatgagagccttctctctggttacaagaaaaaaatggaatgagcagcagttttggcctcgtccagtctctagggctcccagcatctgggtagtaacatgatcagccctgggaaaccagcggagtcttttacctcctctgatgttctgactaagagtgtctgggccgtggggactgaacgcaccctttgaggctatgtgtgttaaagtttgggggcccatttcttcatttctaatatggggcagtgtgggcagatcccagctctgcgtttctgagctgctgagtttgccctggttctgagaatgcccgtcgcggtggtgcagtccgcctccttgcactggatctgttgcttcttctctctaagcctctgttcctgatggtcccttgtggagcaaagcagcacttgtggtgtaaggaaggaaagcctcatcagcaattgagtgagcgctcaatcagaattcgttatggatgaatgtggatgactggaggcattgacgcagacaccagagtccagagctggtacgtggtacagcagaagtggcaagtcagctcagtttaggacaagtacctaaccctgtgttgagaaggattctgtggctgagtctgggcttagggaaaaagaatgctgggaccagtcagccacactaccagtgtgtatggagggttagttgctgagtggctgtcacccccagaacaggagccttttccagctctagtgctgtgtcatttcagcagcactggctgctttattcccattgagtgccgtgcaacagctagttggctgttggtaacaaaagttgtgtgaatcgtttaagatattgcagtgagaatgttggtatcttaactcttcccctagctgtctgtggctaggaagcatctccagtgctattgtttttttcttgagacagagtcctgctctgttgcctaggctggactgcagtggcatgatctcggctcactgcagcctctgcctcctgggttcaagcgagcacatccagctaattttttatatttttagtaaagacaggatttcatcatgttggccaggctgatctcaaactcctgacctcaactgatccgcccacctcggcctcccaaagtgctgggattacaggagtgagccaccactcccggcccccaatacttttttgaggtatacttggctgagtaactgtttagcgtgtgcagagaagcaggtgtttctgagctggaattccttgtacccagaaatgtgagggcaactcacatgggcaccaggaggcatttttgccttcctcaccagcctacggcatcagagaacatttggcagtctctgagtgggagttctttacgcttgcctgatagtagttggaggcctgctcctttaagctttgccacttgaagtgatgagcttggttttggcctttgaacctttacctgccagccacccacaatcagtcggtaatgttggtttccccaagcaacgccatcttaggaatttctttgcttgttctcttacaaagtcatgcattattatacgtgttttcatttgaaaaattacagttccacaggatctagacttgaatgttaagctattaaaaagttaaagagggagtgaaaatgttagcactcctagggcctgcgtacgttgcttgctcaaatccagacgctcctggaagcagctgtctcagcggagccctgtctgcccttgttgttttctgcttctcaagttactccagactccagggaactagaactgaccaggccccactttaaacatgtggatggagtgcccctgacaaggctggagaaagggggaggtccggggcggggcctcatgcgcatatggtattcagagtttatttttgctataaatggaatttgaagaatatatatatatatatgaacatacaaataaaaatatataaagaatatatgtataaagaatataaagaataattttggaattcattgcattgtgtctgcattcttttactgcaacagcaattataattataattatattataaagaatatatattctttatacatatatatttgagatgggtgtctttatacatatatatgtttgagatgggtgtctttatacatatatatgtttgagatgggtgtctttatacatatatatgtttgagatgggggtctttatacatatatatttgagatgggggtctttatacatatatatatgtttgagatgggggtcttgctgtgttgcccaggctggagtgcagtggctgttcacaggccagatcatcagacactgtagccttgaactcctggcctcaagggatcctcctgccttagcctcctgagtagctgaaacaataggtgcacaccaccatgcccagctcttgagaagcatctggcccatagcttaatttgaagtgtcttcatccctgtcttttttctttttgttttaaaattaatagaattgacccttgaacagcacagggggaaagaggcactgacccccatgcagtcagaaatccacgtgtaacttttttttttttttttttttttgagacggagtttcgctcttgtcactaggctggagtgcagtggtgcaatcttggctcactgcaacccctgcctcccaggttcaagtgattctcctgcctcagcttcccgagtagctgggattacaggcgtgcaccaccacacccagctaatttttgtattattagtagagacagagtttcaccatgttggccaggctggtctcaaactcctggcctcagttgatccgctcacctcagccttccaaagtactggtattacaggcatgaacaactgcacccggccaccatgtgtaacttttgactcccacaaaacttaactagtgatagcctgctgttgactggaagcctcactgataacataaacaattaacaatattttgtatgttctatgcattatgtgctgtattcttactacaaagtgagcctgaggaaagaaaatgttattaggaaaatcataaggaagagaatatgcatttatagtactgtgctgtgtttattgatgctgcacgtttacaacatgcgtttacaagatgaatgctctgaagtggccggcaactgcagctgcagacctcaccctaccatacaacatctcaagctattcagcttcttggaatgtcacgcttttcttcttttctttttccttttttttttttttttttttgagacggagtctcgctctgttgcccaggctggagtgcaatggtgcgatctcggctcactgcagcctccgcctcctgggttcaagcgattctcctgcctcagcctcccaagtagctgggattacaggcatgtgccaccgtgcccggctgatttttttgtatttttagtagaaatggggtttcaccgtggtggccaggatggtctcgatctcctgaccttgtgatccgcctgcctcagcctcccaaagtgctgggattacgggtgtgagccaccgcgcccgtccgtcaaggcttcttgggagcacttacagcaacacaagtggtgctttgtatgagtcccatagtgttattcagggtttacggtattgcactaaacatgatgaaaaatacgtgggaacccaaacagatcacttttttttttttttactatgatatggaatttactggagcggtgaactgctcaagtggagataattaacatcaaataatgttctaagcaatgcaatagcaacaggaggcggctactattacagtggtgcagtatggactgcagttaattttatgcagttattattgaatactgcatcttggctgggtgcagtggctcacgcctgtaatcccagcactttgggaggccgaggcgggcggatcacttaaggtcaggagttcgacaccagcctggccaaatggtgaaaccttgtctctactaaaaagataaaaattaaccaggcgtggtggtgggcacctgtaatcccagctactcaggaagctgaggcaggagaatcacttgaacccaggaggcagacattgcagtgagccaaaatcatgccactgcactccagcctgggtgacagaatgagactgtctcaaaaaaataaaataaatacaataaaataaataaatacataagtactgcatctttacatttgtttacatttctctcaactgtgaacacagtctgtgtgtgtgtgtaagttttgatacattttaactttttatagtagatttgtatgtattttatggtggtaaatgataaaacagatgagtatctacatatattttatgcatttgtcgcatatctaactttttcttaatttttaaaaatatttctgggctacgtggtttgcagttttttcaaattgtcacaaatctccaaaaaattttccaatatgtttattggaaaaaatctgcatgtaagtggactcatataattcaaacctgtgtttttcaagagtcaactgtaatgtctttcaaagtaaaatctaaatgagtttatacttgatatatataagtttaatagaaggagtgcgttggctcatgcctgtaatcccatttctctgcgaggctgagatgggcggatcacttgagctcaggagttcaagaccagcctgggcaacatagagagaacccctttttattaaaaattaaaaaaaaaatcaatcaggcgtggtggtgcacgtctgtggtcccagctacttgggaggctcaggtgggaggctcaggtgggaggctggcttgagcccaggagatcagggctgcagtgaaccatgattgcgccactgcactgcagctgtgtgacagagtgaggccctgcatcaaaataataatcataataaagataatctgagaagtgagggtaaaagttaaaggaagattaaaaacaaaaaaaaaatgcttataatcccagtactttgggaggccaaggcaggaggatcgcttgagcccaggagtttgagactagcctgggcaatatagtgagacctcgtctctgcaaaagaaaacaaaacaacaacaaaaaaagaaaaaacagctgagcatggtggcacatgcctgtagtcccagcctggccaacatggtgaaaccttgtctctaccaaaaatacaaaaattagccaggcatggtggcttttgcttgtagtcccagctactcgggaggctgaggtgggaggatcgcttgagcctgggaggtggaggttgcggtgagctgagatcgtgccactttgctccagcctggatgacagactgagaccctgtctcaaaaaaacaaaaacaaaaacaaatcagaatggagcttataataatcacaccgtagctaagacttgggcactgctgatgtcccaggtgctgtgctagatgcttcctgcattattaccttgtttactcctcacaccaagctgggaagtcggtgttatgtggttattcccattttgcagatgggcaaacacaggcttagagaggatcgaggtcatcctgccagcaggtgagatttaactccaggcagtgtggctcttcattgccgctgaccctgcttaaactggaagaatgattcagatgggagtcatcttcccagctggctcctagtaagctgatgtcattcctggcatttaagctgcacccagccccagtgttaggaagacgcgctagaggagacacattagatcctttttgtgctgaatgaacttgttggtgtttataagaagaagacagaaccctagtggcttcatgctactccaggaccaagtccagattctcgccagccacccagcgcctgtccagcccagcccagcccagctccagctccagctcccaggtcttctcccttggcctggccatggggtcttcgtttgctttctgtgggtcccatgatcttccttggctgaaagccctcacgtcccctgttctctctgatctgacaactctctgccctgttgacttaaatgttgcacctccagcagggtgggggcccctctttgcccattggcaccatcatgtccctgcattcctgtttcaggttgttggcacagttcctgtcttcctggggtgtggtgcattcccatttcactgggagataatgatgaccatttacagtgatctttgtgtatttgcccagcaagcaagaggcagtctagtgtagtggttagggtgactgctcttgaggccagactgcatgggcttgaactgatctttctgggccctggagctgtgaccctggggaaggtacttccccacgctgtgcctcagtttcttcttctgtaaagcctacttaactcatagggtcattagagaattgagtgagttattaaatgaaatgatgtacttaaaactggacctggggccgggcgtggtggctcacacctgtaatcccagcactttggaaggctgaggtgggcggatcacttgaagtcaggagttcaagaccagcttggccaacatggcaaaaccccatctctactaaaaaatacaaaaattagctgggcgtgatggtgtacgcctgtaatcccagctactcgggaggctgaggcaggagaatagcttgaacccaggaggtggacgttgcagtgagctgagatcacgccactgcactccagcctgggcgacagagtgagactccatctcaaaaaccaaaaaccaaaaaacaaaaaagctggacctggtcaagccatcgagtgggagaaaatgtttgcaaaacacatgtttgataaaagactggggtccaggagatggagagaacttccgcaactcaagaataaaaacacagtcaacgcagtaaaagaatagatagataaagggtttgaacagacacgtcaccaaagaagattgacagatagccaatatgcatctggaaaagtgctccccgtcaccagccacctgggaaatgcacatgagaagaacagggaatgccccgcagacccatgggaaaggctggaagatgtggtgagaataggacagctgctactcactcaggctggagggatgtgcagtggtgtggcccctcaggaaatcagcttggtagtttcttttaaaatcaagtaaccatccttcctatgacccagcaattccagtaaatcttagatagatttgctcaacagaagtaggaatctgtggctgagcacggtggctcattcctgtaatcccagcactctgggaggctgaggcggacagatcacctgagctcaggagttcaagaccagtctggccaacatgacgaaacctaaaaatataaaaattagctgggcgtggtggtgcatgcctgtaatcccagctacttgggaggctgaggcaggagaatcacttgaacccgggaggtggaggttgcagtggcagtcaatatcgtgccactgcactccagcctaagcaacagagtgatactctgtcaaaaagaaagaaaaaaaaaaagtaggaatctgtaagaagactcttgtacaggaatgttcatagcagcttcattcataagagctggtacttggaaacagcttggggaccatcagtaggtgaatggatacacggacagcagtaattgacaggacggaatgatcctgggcagtgtcaaggaacaaggtgccggtacaggaaatcacccgagactctcaaaaccactatgctgagcaaaccaagacagaccaaaagagtacacactgtgtgatttcatttcatttcatttttttcaaagatgagatctcactctgatgcccaggctgaagtgcagtggtgcagtcatagctcactgcagcctcgaactcctggcctccagtgatccttctgcctcagcctcccaaggagcgaggaccacaggtgtgtaccactacaccccgctaatttcacttttacaatgttctacagcagacagagctaatctgtggtggttgcctctggggctgtgggcaggagttgcttggggaggagcaggagggattttctgttgttatgaaaatattctttacagtgagagtggtttgagatacgcaggtgcagcatttgtcaaaactctgcatgtgtactttaaatttgtgcatttcatggcatgtaccttttaactccaaggaaataaaagaactataaataaatactgaactctaattagtgatgtgtgtgattagagggaaaagtactgatgtctgcaacttactttgaaatgtgttaaaaaaagatgatatggtagactgaatagtagtaccaaaaatgtctatattccaatacctggaaactgagaatatgttctcttatgtggtcaaagggaatttgcaggtgtgattaagttaagaaccttgagatggaattagcctgggttatttgggtgggcccagcgtgattaccagggtccttatgagaaggaggcaggagggtcagagtcagagagaagtgaccatggaggtggaagttgcaatgatgtggggccaggagccaaggaatgtgagcagcctctgaaagctgcaaaagccaggaaattgatttcctcctggagcttctagagggaatgcagccctgctgacaccttgattttagccagtgagacccattttggagtcctggcatccggaaccacaagatagaaatttgtgtcgtatggaggccgggcgcggtggctcacgcctgtaatcccagcactttgggaggccgaggtggacggatcatgaggtcaggagatcgagaccacggtgaaaccccgtctctactaaaaatacaaaaaattagccgggcgtggtggcaggcgcctgtagtcccagctactcgagaggctgaggcaggagaatggtgtgaacccggaaggcagagcttgcagtgagccgagatcacgccactgcactccagcctgggcgacagagcaagactctgtctcaaaaaataaaaaaaaaaagaaagaaatttgtgtcgtatgaagtcccacagtttgtgggaattatttccagctgcaattggaaatgaatgctgatggattgctggatagatagagggatggacggatgtggaataaaacaagtatagacaaaggtgggtggtggactgtaggctgtgggtatacaagtgttcacttcaaactttacttggctgggagtgggggcccatgcctgtaatctcagcactttgggaggccgaggcgggtggatcacttgaggtcaggagttcgagaccagtcttgccaacatggtgaaactccatctctacaaaaatacaaaaaattagctgagcacagtgacatatgcctgtggtctcagccacttgggaggctgaggcaggagaatcgcttgaacccgggaggtggaggttgcagtgaactgaaattgtgccactgcactccggccagggtgacagagcaagactccctctcaaaaaataaaataaaataaagttctttagatgtttctatgtgtttgaaacttttaataatgaaatactggggggaaatgactgggcctgatacataataaaagccctacaggccaggcacagtggttcacgcctgtaatctcagcactttaggaggctaaggcaggaggattgcttgagcccaggagtttgagaccagcctaggctacatagtgagaccccctctctaccaaaaaatagaaaaaaatagccaggcgtggtggcccatgcctgtggtcccagctaccccggaggctgagggggagaatggcttgagcatggaaggctgaggctgcagtgagtcgagattgcaccactacattccagcctgggtgacagagcgagaccctgcctcaaaaataaataaataaataaatacatacatacattcatacataccctacataggtgtcagcctttgttctcattggcatctcatctccattcttattgccaccacggccactcccccactttatccatcaggtggagaagaggcctgggaagagaagagaccaggggctgggttggtggtgagcagacgaaataataaacatacaatgaggccatatgacatattgggagaattgctttcacttaagaaaatctaggctgggcgcggtggctcatgcctgtaatcccagcacttttggaggccgaggcaggtggattgcctgaggtcaggagtttgagaccagcctggccaacaagtgaaaccctgtctctactaaaaatacaaaaattagccaggcctggtggtgggtgcctgtaatcccagctgctcaggaggctgaggtgggagaatcgcttgaacccgggtggcggaggttgcggtgagccgagattgtgccacttcactccagcctgggtgacagagcgagactccgaagtgaaggggctggggctttggaactgtagaggctcatctccccagtaagctgtcacttgtgatgtggttacagctgtaggcatttgcagagatgggacgagaagacacgccaccctgggaactggcccgtgtcttcacacgtcctgcactgctgctgctgagaacgtctgcactttgttaggggaagagagtgttttagttaaatttatctggaaaacatattattagtataatgagattttaatgatttgaaattttgttggagcagcgcagggagaatttcaatcttaactgtgtgtgcagctgggcattgtttctattttattttgtttctttgcttgggcctcattgcaaggacatgtttctacaattattatttagtttttctttcctagagccctgctttgttacagctcttaattttcttgtgtagaagatctgctggagaaaaaagaatatcctttttgtaaatacttagctggcttgatcagaaccagagaatgagcgttgttaccgaaggagacttgtgtttgtttaaggtttactggcgcactctgtggttgccgtggagtggacccaacccagatgtccgttaactgatgagtggataagcaaactatgctccatccatacgatagaatactattcagcaacgaaaaggaatgacatatggatccatgctacaacatgggtgaatctggaaaacaggctcagtgagggaagccatttgcaaaaggataaatactgtgtgattccatttatttgaatatctagaataggcaaattgatagagacagaaagtaagattagtggttcccaaagcctggggaaggtacagtgacccctcatgggtacagggattattttgggggtgacgaaaatgttcttacattgacaatggtgatggttacacagctctgtgaatttactaaaaatcattgaattgtacacttatttatttatttatttatttattttgagacggagtcttgctctgtcgcccatgctggagtgcagtggtgcgatctcagctcactgcaagctccgcctcccgggatcacgccattctcctccttggccacccgagtagctgggactacaggtgcccgccaccacgcctggctaattttttgtatttttcgtagagacagggtttcaccatgttggccaggatggtctcaatctcctgaccccgtgatccgtctgcctcagcctcccaaagtgctgggattacaggcgtaagccactgcgcccagccgaattgtacactttaaaacggcaaattgtatggaatgtgaattctgtctcaataaagctggtaaaaaaaatagcgtggtactgagaggcagcgctcagagcttgtgagatgtttttctccagttggtattcgttgcatgtttccaaggtgagatctttcaccttggggtgagggcgggtggatccgggacagacatggaattttcagtcttcctcctcctcctcatcttcctgttcattgcccctgcagtggtggcagctgtcccatatcaaggtctcacactggccaggggctgggcttggtgctgtacgcagattgtcttattaggactatgaggcttttgagataggtatgataatatgtcctcattgagcaagtgacaataggaaacccccagaaattgtgtgcactgttttgcctgatctcacacactttggacagagactttgatcacattcttaggggcccacaaatggtcaaaaacctctgaactgagacagcagcattttttgtggtttttttttttttttttgagatggagtctcgctctgttgtcaaggctggagtgcaatggcccgatctcggctcactgtaagctctgcctcctgggttcacgccattcttctgcctcagcctcccgagtagctgggactacaggcacccgccacagtgcctggctaattttttgtgtttttagtagagacagggtttcaccgtgttagccaggatggtctcgatctcctgacctcgtgatccgcccgcctaggcctcccaaagtgctgggattacaggcgtgagccaccacgcccggcctgttttgtatttttgagatggaatctcgctctgtcgcccaggctggagtgcagtggcatgatcttggctcactgcaacctctgcctcccgggttcaagtgattttcatgcctcagcctctagagtagcttggactacaggcatgcaccaccacacccagctgatttttgtatttttagtagagacggggttttaccatgttggccaggtgggtctcaaactcctgacctcaagtgatccacctgccttggcctcccaatgtgctgggattacaggcatgagccactgtgcttggcttgggagagcaacttttaaactctctttttattttggatccatggtaagaaatatatttccataaaaaccccagttcaagcatacatttacctatatccatgaataaaagtttcatgaaatgatatcttcctataagcacactgacgtttgctactctactgttctttcatttcattaaagaaacgtgctgtccaggcaatctcagtactttgggaggccgaggcaggaggattgcttgagcccggtggtttgagaccagcctggtcaacatagcaagaccccatctctacaaaaaataaaattagtctggcgttgtgttgtgtgcctgtggtcccagccacaggtgcccctgcaggggcagggggctttcaggtgggaggatcgcttgagcccaggagtttgaggctgcagtgagttatgattgcaccactgcactccagcctgggtgacaaagagagagtctctgtctaaataaataaataaatacatacatacataaaatatgctagtcacagtttcctaaatggattttatgactcattgagtcaaaatgatagttttaaaatgttgctaagagagatgtaaggaggaaaatgtgttggtgagtgttgaggagcccaacttcttttgagaaatcattgttggatctggtgtctcatgtgttaccctggggtttcaactcctgtttgctcattcagttattcattgatcaccctgtcttccaggcatgcagtcattcattcaaggtgattattgagctccccttgagagcaggtatggggctgggggttggagatccagtgagtggtcctgcttgagagactggccctgcccacatggcactagtgggctgggactctcccatcactcttgtctccatcttgttgtgcactgttgatgctccattgaatgatcttggcatctttgctgaaaatcagttgatcatcaatgtatggatttatttctgagctttcaattctattatgttgatcaacaggtctgtctttatgttagtactacactgtctctatcactgtagctttgcagtacgttttgaaattggcaaatatgacacttcccactttgttcttcaaccttgtgttggctatttgggatccctcgagattccgtatgagttttagggcgtgattttctatttctgcaacgagccaccattggaattttgggaggaattgtactgaatttgagaattgctttgggtagtatctttaacaacacgaagtctgccagtccatgaacataggatgtctttccacttccttaagtcttctttaatttcccttcgcaatgttttgtggttttcagggtacgagtctcttgcctctccaggcagatttatccctgggtggcttatgctttcggatgctgttgtcagtgggattgttgtccttgccagtggtcgctgagcccagctgcagccttgtcttgcactgcagggtgtctgtgtcacctacttgcctagttctggccacttttcttgcaggaagtcagaagtgtactgatctggagtaggacccttagcacaacagagctgctccttggtgctaggagatgcgtcctgaggctggccatccatgtcagaggacctggcgcctcaccctcatcatgggatatcactgaccaccagtgggggatgcatctctgctgggcttggcctgcaaggtaggagctgactgcaggagtgggaaagagcccatggcccctgagggggcctacagttggctctcctgtggttacttggcatgtttgatagacgcctgggtctggcacagagaacactgcccgctgacaatcattgagcctcggcaggctggccccgatgacatgttatctccccacacagtccctggacacacttgattaaaggtgcttattactttcatagtgttggctggagtgatgtgataactccacaaaaggttctggcagaatcccagaccttggggtgttcccaccagtgtctctgtgttcaaagttcagcacagtgtggggtggcaggagatgggaacttggagactgaggccagagtctgctgacttgagcctctgctgaggtccttatcagtgccgggagagcagcagcctaatctcaagatggtttagaggatttagcgggggcgtgcatgcagagttgagaactggctcctgggtcggtgtgcggggggtggggatggcccgggggccgtagctacagtttgtcttccttcccccaccggcagaggtgaagagaggtgttttgtcctggagccaccaggcctatccatggaggagcagagcttcacatggagcctgtgccccgtcttagtctatttcgtgttgctataaaggaacactaaggctggctaatgcataaagaaaagaggtttacttggctcctgtttctgcaggctgtacgtggcactggcatctggttctggggaggcctcaggggcttctcctcatagtggaaggtgaagagggagcaagaaagggagaggaaggaggtgccatgctcttttctaagaaaacagaaacacagctgcattattttaagcaaaacacatattggcttaggtcgctgtattcatctcccagggctgtggcaccaaggcaccagacactgggtggctctttgggaggccaaggcaggcagatcacttgaggtcaggagttggaggccaggctggtcaacatggcgaaaccccatctctactgaaaataccaaaattagccgggcatggtggcatgaacctgtaatcccagctatttgggaggctgaggcaggagaatcacttgaacccaggaggcggagtttgcagtgagctgaaattgtactattgcactccagcttgggcaactgagccagactccatctaaaaaaaataaaaaataaaaaacccagcagaagtggattctctcacagttatggaagccacaagcttctaggggttagaattccaacatatctttttttggggaaagaggggcataattccccatagaagagcctgtaatctcagggagccttgacccaggtatttgacgttggtgtaatctacttgtgtatgtgtattggtggacaaaggggatggcctcacatcccttcagcatcttgggggtgggcggtgcctcccctccggctcccctgagtcagccccggggaagaccaattgtggggctggatggtgtgggaacccccagctccgtcctgtctccagccatcagtgaggtgtgcttggccattccccacaggaccagtgggcgggatggggcagctttgcagttggagaggatgggggttcaggcaggcagaacagatgcgcggacacagaagagctgtgcagaatgtggagttgagcttcctggaaggcccataggagaggcgagactgaaatcttcttgatactttttcactggggcctgaaagcctggtgcagaatgaaactgaaagcacttgtctcgttgagcaaatcattcaactttgttatttctgtaattgaaataattcctggcattaattatgtggagagcactcatgaccatgtggacatatcttttgggggcacatgaactgagggtaataatttcgctcgaattttttttttgagatggagtcctgctgtgtcgcccaggctggagtgcagtggcgtgatctcggctcactgcaacctccacctcctgggttccagcaattttcctgctctagcttccccagtagctgggattacaggtgcccaccaccatgcccggataatttttatattttttaattttatttttatttatttattttttgagacggagtcttgctctgtcactcaggctggagtgcagtggcacaatctcagctcactgtaacctccgcctccaggcttcaagcgattctcctgcctcagcctcccaagtagctgggatgacaggagtccgccaccatgcctggctaatctttgtatttttagtagagacagggtttcaccatgttggtcaggctggtctcaaactcctgacctcatgatccgcctgcctcggcctctcaaagtgctgggattacaggcatgagccactgtgcctggcctaatttttgtactttaggtgggatttcatcatgttggccaggctagtctcgagctactgatctcaggtgatctgtccactttggcctcctaaaatgctgggattacaggtgtgaaccactgcgcctggcctatttcactccattttgccgaggagggaacagaagtgtggagtcctcccagccacatggcctcggatccgggctgcaggtccaggctttccggctccagggctggtgccctctgtcctgtgccacttcccctgcaaaatgagatgaaaatgagtctcattttacgatgaggaaactgaggccctgagagagggtgagaaaccaggtctctggctgaatgcacctctcactgaagacatctccgggtggaaatgttctgagagctgctgtgtgtgctggtgtcagaatgaacaatacccatagtgcttggcgtagacaatcagcaaagctagggacccgttttctcctcccagccccctttctcacttcaggccctagacaagaatcggaggtccgtttctcaagtttagctcctgtctgattaaatttgaggttcgtttctcaagtttagctcttgtctgattaaatttggatttgctccactctttttcacgggcataaaaatatctgcggagtgaaaatgtgtgcagaggatgcactgcgtgcaggctgcggctcgaggtcaatcagattcctccagcgataaaaggcctgctgaggaagcggccccactcccagcacagccccattgattggcttttattttcctctgttgctggagtgatccaatttgaagccctgtttctgagcatgttgcaaggaaccctaggggctgccatagccctggagatactggctggaaatcaaattcaaattggtgctttcttcctattaaagcaggagacctctgcccgggaacgggccatttgggggctcagccatctggcacatggagtgagtaggttttattgccaaagccgtcccggccttggcctcagcctctgtgtggctctggtggggagtgtgtctcgatgttgtactgtgaataagccccatgcctacttgagtttggggtttctgttttacctacacttccatattgtgggcatgtggctgcggaaatgtgcctgcacctggactcgctgtcactcactggcttctcgtggtacagcctagggagggttgccccagccgtatttagttcttcctgcctcagatgaacgggcctcctctcccagctcctaatcaggagggcagagtctcgttggcggctctcctgtcctgctgccactgcctttacacttcttcagatatgcggccgtcttaaggtgtaaatgccttcctctgtttcccagtggttatctaaagcaaggattggcaaacagaatccacaccatagatttgaggtatgtttgttgtcctctttccttcttaaactgttagtaaacaagacattcctacaggtgacccctttcggcctttttttttttttaagactgagtttcgctcttgttgcccaggctggagtgcaatggcgccatctcagctcactgcaacctccgcctcccgggttcaagtgattctcctgcctcagcttcccaagtagctgggattacaggtgcctgccaccatgctaattttgtatttttagtagagatggggtttctccatgttggtcaggctggtctcgaactcctgaccccaggtgatcctcccacctcagcctcctaaagtgctgggactacaggtgtgagccactgcgcctggccagtcctgcactcttcaagtttctatgtgttgcagactggtggggtagcaatatcagttagagagacaggactggggtcacttgtcccctgttagctcagtgaccttgagctcagcttagacacattgtctctgaacactgtgctgatggcaacacctctctcacctgtcttgcagtcttatttgaggaattaaatgcaataacctgggagaaagtgcaggtatgaagtcagggcacacagcccgtcaccaggagcttgaaggaggagaagagtgggtggggatgtgagcacagaagctgaggcgggggctgagccgggtgtgtatttctgcctgtgccacagggacacccctttcaggcactgggcgcctagctcctgttgtctcatctcctaagagagtctcgggaggcctgagactccctcactgctgcgggcttcaagagcagcatctgtgctgagtaacagccatgggggcagaagcagagatctcccgtgacagagtagttaggcagccgtaaaaatcctaccaccagctcgtggaaaaggtctcatttgacaggtgccatgccgtcaaagacttgtgctctgcagctgcaaattcccaactgaaaaatatcaacaattcttacgaagagagaaggggagccctgcaaagctgttgtgtcaccccgtctgtttgtaggcgctggggggattgatgatgaggtggggactgttcggctggccacactgccattgtagatagcctgtgactctgtggctggcgcctggctggcctcagtgaagcccttcagtcccagctctgaccatgtctctgtggagagacaagcaggtgatagtgttgggtgggcaaggctgtgctggtggcctgcttagcaacagcaggaaaaggaaggagataaccaccccaacctttcttgctggaaggagcccttcctgttgtcggcgctgtgtgtaaccaatgaggcgaatgccgggaagcgcttggtttgtgtcaatgaggggagaggattgtgcagaagtgcaggaagggaccatgggaggaaattgagtgaaggtctctgttaggggtttgtgttcccctaaaaggtatgtccaggtcctagtctccagcccttgggactgtcaccttatttggaaatagggtctttgcagatgtgcttaagacgaggcctgtctgaagtagggtgggcccctaattcaatgtgactggggcctttatggggagaggaggcaggacacagacagacacgggacacagaggctggacagagattggagagatgctgccacaagccaagatgcaccgaggactgatggccaccaccagaaactgggaagaggccaggacggatcctcgcctggagccctcagtgagagcacggctctgccgacaccttgatctcagacttctggcctccagaactgggagagaatcgacgtctgttgttttaagctgccagtttgaggtactttgttaaggtggccacaggatgcgaatacagtcaccatctggcctttgatcttctaattgcctcggcggttctcctgccagtaagggttgtgagtgaaacttgaaggtcacagttggaaatcaagttaaaagaattaagctggaagtgcaacatgagagtccgtcaccctgagaggcggtgtgaatgccaaacacaggcaggcagggctggacctgcataaattgtggttcgacagcaccgggagaaagaaggcccgggcctgctctcctcacctgattctgggaatgccgaacctacctgtgttcctgatatcaccccagtgctaacttcccaccccttgaaaatgtcaaaacattgtgttatgaatgttcttcattgagcaactgcgatctctttctgtaaagatccagagaatatttcagcctctgtgagccatcctgcctctgtaggaatgaatcaactctgccttggaagcatgaaagcccctatagacagttcataagcatagccgtggctgcgtccccctgaagctacaaaagtaggtggggggctgggtgtggtggctcatgcctgtaatcccagcactttgggaggctgaggcaggcggattgcttgagcccaggagttcaagaccagcctgagcaacatagcaagaccctgtctctacaacaaatacaaaaattagttgggtgtgttggtgctcacctgtagtctcagctacttgggaggctgaggtgggaagatcccttgagctcaggaggttgaggccacagtgaactgtgattgtgccactgcaccccagcctgggagacagagcaaagccctatctcaaaaaacaaaacaaaacaaaacaaaacacccaaaaagacaggtggtgggccagatttgctcactggctgcagtttgccaatctatggtttaaaccaacaatttaaataacacacacacatctttgtatgatgttacacatcttttttttttttttttttgagatggagtcttgctctgtctcccaggctggagtgcattagtgtgatctcggctcactgcaacctctgcctcctgggttcaagcaattccccttcctcagcctcccgagtagctgggattagaggcatacaccacctcgcccagctaatttttgtatttttagtagagacagggtttcaccatgttggccaggatggtctcgaactcctgccctcatgatccgccctccttggcttcccaaagtgctgggattacaggcatgagccaccgcgcccagcctgatgttacattttctagaagttctcagtgatgggcatttaaaggattcggctgctgctccctgtggctttcacagcgctgccctgaatgggtgttagggcaccgtacaggtagcggggatgcctgggaaagcccagactcacagcaacacaacaacagttaacagactccagtgaccaaatgtgtgggtttttcctgcaccaactggcggataccagctggatgtcccctagttcaattcaattcagttctgactccacctacctggagatggcatcagatcccacagggtgagggctcagtctcccaagactctgaacagtggctgtaagtcagggttcccacagccccatctttgggttcaattaatttgctagggtgactcacagaactcggggaaacatttacttatatttcctggtttattataaaggatattacaaaggatacagatgaggagatacatagggtgaggtgtagggaaaggggtgcagagcttccatgccctctctgggcgtgccactttgccaaaaccaagcatccagtctctggaagctccctgaatcctgccttcctgggccttttatggagcctcattggatatgcacgattgacagccatgtagaaataggattggacagcaagggtgtgatctaacactaacagatggactggggaggccctgcaagacctatctgtgcagccttccttcctccaaggtgtgggggcccctctctggagtgagggtctcattacttacaatctgatgagagtcctgccttgggcaggtgaaaggagggcagaaggttagagagattctgttttctgaggctaaagtgccccaacatcttttattattattattatttttgagacagggctggagtacagtgatgcaatcttggctcactgcaacctcacctctcgggctcaagtgatcctcccacctcagcctccctagtagcaggcactacagccgcgcactacaacgcttggctaacttttaaattcttttgtaaacacaaggtcttgctatgttgcccaggctggtctcgaactcctgggctcaagcaatcctcccgccttggcctcccaaagtgctcagattacagcatgagctcctcagctagaagagttaaactcatagagagaggaagtggaatggcagttgccaggggcaggggttgggggctgggcagggaggggacagggagttagtgtttctgccttgcaagaagaaaagagtttggcggataacagcgatggtggcacagcagtgaatgtccttagtgccactgaaccgtacacttaaaaatggttaaagtagccgggtgcggtggctcacacctgtaatcccagcactttgggaagtcgaggtgggcaggtcacctgaggtcaggagtcttgagaccagcctggccaacatggtgaaactccctctctactaaaactacaaaaattagccgggtgtggtggtgggcgcctgtaatcccagctgctcgggaggctgaggcaggagaatcacttgaacccaggaggcagaggttgccgtgagccgagattgcgccattgcactccagcctgggcgacaagagtgaaactccatctcaaaaaaaaaaaaaaaaaaaaaaggttaaagtgagaaattttatgtattttatgttaaatgtaccttactacaattgaaagaatgaaaaaaaaatactgggaaatacattacacatacaaaagagtgtacatatgtatagtttactgactaatattaaggaagtacccacgttcctgctatccagcttaagaaataacattacctgttccccgagccatatgccccgtacctcctgtgcgcctccctccccaccagaggtgaccagtgccgccttgaacgttgcatttagcatgttgtattagttagagttctctggagaaacagaaccaatgggagatatgtagctctctctgtctctttttttttttgagacagagtctcactctgtcgccaggctggaatggtgtgatctcggctcagtgcaacctctgactccctggttcaagcagttctcctgcctcagcctccccagtagctgagattacaggcactggccaccacacccggctaatttttgtatttttagtagacacggggtttcaccatgttggccaggatgatctcgatctcctgacctcgtgatccgcccgcctcggcctcccaaagtgctgggattacaggcgtgagccaccgcgcccagcctgtctctctgtctgtctctatccatctctctctctctctctctctctatatatatatatatttgaagagattgattataagttattggctcatgtggttacgagactgagaaatcccaggatcttcaagctggagacccaggagggccaatggcgtcagcccaagtgcgggaggagacccacgtcccagctgagtgaatccccttaccctgcctttcggtctattcaggtgtcaaatggattggccgaggcctatccgcactggggagggccatctgttgtacccagtctaccgattcgaatgctaacctcatctagaaacaccttcacaggcacgcccagaataatggttagccaagcaccaggccgctccccacccagtccaggcagctagtcagcaggccctgccccacttgcttgtctttccttgcgttttgcacacgcatgcatctctgtccctcactttctttagttttgcccgactttgaccccaatatgacgggagccccaccgtgcgtgctgtcctatgactcgagtttacgcagtagcctagctttggggcacagccccatttacttggggcaccgctgcctctgctgtgtggccgtgtgggatcccacaccaggagcaccgtccctttgtcacctgggaggggtgattctgtgcctgagttgcatgtggatttcctcctgctgagttttaattaagaggcagggagcaggtgggtgaagggcacacacacggatgcagcgttgcccgggttcgaattctgcctgcgccatttcctgcctgctgaaccagatcggacaaattactctacctctctgtgccacagattttttgttgttgttgttgttttgttttcattttgtctcgttttgtttttgtttttgagacaggttctccctctgtcacccaggctggtgtacagtggtgcaatcacggctcactatagcctcgaccctgtgggcttaagcaatcctcccacctcagcctcctgagtagctgggacgacaggcgtgcacagccacacctggctaattttttaattatttgttgagatggggtttcactatgttgcccagggtggcctcgaacccctgggctcaagtgatcctcctgcctcagcttcccaaagtgctgggattaagtgtgagccacctcatctggcctttgtgccccagttttctcaatcaggtaatgatgatagctctcaggtggtgagggtgactgtataaaatgtctggaaatggcacctgctctgtgcccaggggttagaggcttgggaccgagctgggggctgagctgggggtggagctgggggctgagctgggggtggagctgggggctgagctgggggtggagctgggggctgagctgggggtggagctgggggctgagctgggggcgtttttgttccaaggctttcttgctgataagtttctctttctctctctctcttttttttttgtcctgcgtgtctcaacctgacaaaaatgctcagtttagaagcgtgtcgttccatttgtgggaaaattaaacacatttaagagtaaattaaattaggggacttgtgatcattagctaagtaaattattttttaaaaatgtgatgtaccaagcatagcacatgtggcacgctcaataaatatttgttagaatgaatgataattttatgagccagtcgagtcatatataatgggattatttggttctagaactaatgaagtgactgtagagcaataaagcttctaaaaagaatctccgtgctcgcaaaaaatccaaaagtgggggaagaggctcatgctggatttcacccaagagcgaggcccgaggagagctgggacgctgtgtcctgagagctgtccaaggggggcccttgtgacttggcaggggtggttttggagcctgagtttatccgcactctgggtggactgggtctcgggggaggcctgccttaggtcagctcaggagaccagtggatatagcaggaggcccacttgcagttcacggtttgtcttgccagatgtgcagggggcccggtgtctcagcacttggcacctgtgggactgagagaggagtcagtctagcaccagacacccgcttggtgggggaggggagtggaagaggagggagaggagagagagggggctggagccccagtcccacagcttaggtcctgggaagccctgtgggttcatgcttgccttgaggggaggttggacggctcaagcagggaccaggagcctcccagtgtggcatgagctttgctggaagcctgggctctttgagaggggtggggctgagagccgctagacctggcttcatcctcctgcctgctttcctgtctggggtgtaccctgggaagggacataacttccctgaacctcggttgcctcccctgtccagtggaggaaaggaaggcacctgcctaactgggctcttgaaaataataaattgagataatacaaaatctgcattaatttcctaggcctgacataaaagagtaccccacactggctggcttacagagcagaagtttattctctcccagctctgaagaccagaagtccaagatcaaggtgtcagcagggccttgctccatctaaagtctccagggagggatccttcctgactctcttggcttctggggacggtgggcagtcctggcatatcttgatttgtggccatgtcactccagtcagcctccattgtcacaggtgtcccccttcatgcccctctgtgtcttcctatggtcttctctctgcatgtcagcatccaaatttctctctcccatgtggacaccagctgggcccaccgcagtccagtatgacctcatccgaacttgattacatctgcaaagaccctgtttccaaataaggcacattctccagttgtccaattccaggtggacgtggatttttttttttttttttttttttgagatggagtctcactctgtagcccaggctggagtgcaatggcacgatcttggctccctgcaacctcctcctcccgagttcaagcgactctcctgcctcagcctcctgagtagctgggattacaggcacctgccaccacacctggctaatttttgtatttttagtaaaaatggggtttcactctgttgcgcagggtggtcttgaacccctgagctcaggcaatccacctgcctcagcctcccaaagtgctgggattacaggcatgagcctctgcgcccatcggacgtggattttggatgagacaccattcaacccacagtacctggtgctcagttagtgactaaaacccactagttatggtcactcagtcacccttcttgttattactttcatagatgagggtgtgatgggggggggaaacagaagcagagttgattgtatcttcttagttctgcacaccctgtggcttttttttttttttttttttttctgagagggagtcttgctgtgttgcccaggctggagtgcagtggcacgatctcaggtcactacaacctctgcttctcacatttaagcgattcttctgcctcagcctcctgaatagcgggcattacagacatccgccaccacacccagctaatttttgtatgtttagtagagacggggtttcacaatgttggccaggctggtcacgaactcctggcatcaagtgatccacccacctcagcctcccaaagtgctgggattacagacatgagcctctgtgcccagccccgtggctagttattagactgttctaggtcttgatgggaaaggggaggaggacttgttcttctctttggattaataaaacaccgtgaggcttgtgtttgcacagtgcccacagcttgcacactgacaagcccttttaggttgacttctgctgagtcatttcatcctgttccatttgtcagccataaggtaaggagcagtttttctgatgtactccttttgcataaatgctactctccatcagcctcgagaagtagaaggcaccggtatggtatcccaagctcattcacaggggagaagagatgcctgttgccacaaaatgtgaatgttgggtgtacattcaggtgtcacgtacgtggtgttgattgtctcagcttaataaagaaagatgccgtacacattttcctttaaaaagtctcacttggcttgtttgacaggcacagaagatgtgttattaaacacttgcaaagcctgctgtcatttggttttaaacagcactcgtcgtctttggcggggcgtgtttgctcagcatcatggaagggggatgtgaggtacccaggtggcagtttctctaccacgatgctttctctgcttgctatcgggagaaatgttctttcctatgttgtgggaaggcggaaagggcactctgaaatgtaaggtggccttttgtattagaatttcatggctgagaccaggcgtgggggctcatgtctgtcatcctagcactttggaaggccaaggcaggtggatcacctgaggtcaggagtttgagaccagcctggccaacatggtaaaatgccatctctactaaaaatacaaaaaattagctgggtgtggtggcagccacctgtaatcccagctacttgggaggctgaggcaggagaatcacttgaacccaggaggtggaggttgcagtgagctgagattctgccactgcactccagcctgggcaacagagagagactctttctaaaaaaaagaaaagaaaagaatttcatggttgattgtcacaggaccatctttagtcccaagatctgaggcaagggaatcgttttcaataggaaacttttaaatgtttgagcagcagaaagggagattgagccagaagaacttgctggtggaaagatggtggaagctgggagctttgaggttctaaaaatcctggtgtgtcaggtcaggtagtggggcaaccggagcttagggtgagttatacctgatgggacttaactgggtaaatgtcatctagtaacccaactacattcggcattaatatctggacaaaaggtggaatacacccgggttctttgggcacaggcgaaggagaggtctcatagtttgatgttgctcaagaagggaaaacaagcaggatgggaagaggtctaatcagccggctggagtggggtgctgggtttagttcattccttcttaaactcagccagttctcattattcatggtggttttgatctataaagttgccacaaaccccaagttagccaatactgagccatcactcctagggcagtacagcgctcggttcctgcgagcctctggtcacaacattttcagcaacagatccatacataactttttcttatatatgtttctttttaaagatacgttatttaaaatgtattgttgattgattaacattgagctcacggccaacagcagtataagtgctgcctgaatgaagcttctctgacctgtgcgttctctgcaaggcatacctcagccttcttgcacttgggaacactaggagtacccctcgccacgcgtggggacccattttaaacagcaaagttggctgggcacggtgactcatgcctgtaatcccagcactttgggaggccgaggcaggcagatcacctgaggtcaggagttcgagaccagcctagctaacatggggaagcccagtctctactaaaagtacaaaaaaattagctgggcatggtggtgtgcttctgtaatcccacctattcaggaggctgaggctggagaattgcttgaacccaggaggcagaggttgcagtgagccgaagtcacgtcactgtactccagcctgggcatcagagcaagacttcatctcaaaaacaaaacaaaacaaaacaaaacaaaacaaaccaaaacagtgaagtcaccaacaaatagcagaaaaatgtgaaaaacatggcattaaatagaccatgaaatggacacttgtttatgatgtgagacctcagacaagaaggcagagcgccccgtgtttgacctcaggtggggacacatccggcaactcagattcttttttttttgagtggagtctcactgcgtcacccaggctggagtgcagtggtgcaatctcggctcactgcaacctctgcctcctgggttcaagcaattctccagcctcagcctcccgagtagctgagactataggtgcgcactaccacacccagctaatttttgtatctttagtagagacggggtttcaccatattggtcaggctggtctcgaactcctgacctcaggcgatccacccgctttggcctcccgaagtgctgggattacaggtgtgagccaccacacccagtcagattctttgcttctgtgtgcaggtctgtgaatgaatgtaggccaagagtattgattctgagcttacaaattttagccagtagacacatttacacatacagaatccatgaatcaaggcgattgactgtactttgacaattatttgtttagcactgtaggaggaacctgcaaactgttccttccctctgctcacatactgcccagggtaagacttctgacaccagaggtgcagggatgcttcctgccgcacctggcagttctccagcagacaccagctgggtgtcctgcagttcagttcaattctgacaccatcgacctggagagagcctcagaccccacaggtgagggctcagccccacgagactgcaccccaaatcagggtccccacgactgcttcctcggttttgattaatttgctgggactcagaacttggaaatgggccaggcacggtggctcaagcctgtaaccccagcactttgggaggccaaggcaggtggattgcttgaggtcaggagttcgagaccaaccgggccaacatagtgaaaccccatctctactaaaaatacaaaaattggttgggcatggtggtgggcactgtaatcccagctactcgggagactgaggcaggagaattgcttgaacctgggaggtggtgattgcagtgagctgagatcgcaccactgcactccagcctgagcaacaagagcaaaaccctgtctggaaaaaaaaaaaaaagaactcagggaaacactgcatttgtgctccctggtctattataaaggagatgataaagggtgcaggtgagcagaacaggaggaggcacacagggtgaggcctgggagggcccccagcacaggagcttctgttgccctggagttggggtgtgccaccctcctggcacctggatgtgtttacccacccggaagctctctgcaccctgtagttcagggatttttacggaggcttcatcatgtaggcatgtctggttattagttcaatctccagcccctctcccctttctggagggtggggttggggggtgtggagctgaaagctccaggcttctaattgtgtctgggtctttctggtgctcagcccccacccaggagccaccaagagtcacctcattagaataaaacatccttttatctccctggaaattccaagggattaggaactttgtgtcaggaaccagggtcaaagactaaatattagaacaaaagattgtcctggcacctggaaattacaaggttcttaggatctgtgtgccagggactggtggcagagaccaatatgaatatttcttttcttttctttttttttttttgagatggagtctcggtctgtcacccaggctggagtgcagtggtgtgatctcagcttactgcaacctccgcctcccgggttcaagtgattctcctgcctcagcctcctgagtagctgggactacaggtgtgcaccatcatgctgggctaatttttgtatttttattagagacggggtttcactatgttggccaggctggtctcaaactcctgacctcaggtgatccacctgtcttggcctcccaaagtactgggattacaggcgtgagccaccgcgcctggcccaatatgaatatttcttattattttacaagcacttgcggtgtgtcctgtggtctccgtcctcagcgtcgtggtttagagggtgcctgacaggcagggtgtggggttagtggggttggggagtgatttccggggcacagtgatccccagagtatgtgtggttgtccagttcactcactcctcgtggcctgctcggtgctgggggtccacactcacagagggcatggtctgtgccccttgggatcaggcagctgctcctggtacagatgagttgggagatgacttcctccagggcatgtgagaagctctcaatgaccaggccagctcggattcccagttctggccgagccgatgtgctctctgttgccacattccgtgtcacttcccaggcctccccggcttcccattctcggggccaggtgttccgtggatggggtgcggtgcggcctttgataccagaggcctgggatcgctttcctcctcggtttctgtgtggtcagtggcgccttcacctgtctcatgccctgccatgctgccatgcaagggcagagggctggtgttggggtggtgctggggcctggggagtggaatatcctgctctgttaagatgctggggatcgcatgtgtgatgctggccacgtcagccagtcttccttcctgccgagaccaccagccctcggtgcagccagccgtatcacctggttatagtcacgccgaaacccagctgtttggaagcgtggccgtggggccttggatcccttttcctttccacgtgttttgtggagacgaataacacaggcatgcgccgtgcccaggtggaggcaatgttaggaaagcaggaaggagctcagagcaggaaatgtgtgtggactcgcgtttgttgaagggcctggccgagttccccagaggctggggtcagtgttcaagttctgatgcttcacgtccttggaggccaaaggacgtgaccttgaagaaggggcagttctcacctgtgggcctaggagaggtcgttggccttaagacattactccaggtaattatatgtggttcctacctataatcccagcactttgggaggcagaggctggaggatcgcttgagcccaggatttggagaccaccctgggcaacaaagtgagactcctgtctctacaaacaaaaacaaaaacaaaaacaaacagttggctggatatgatggcatgcacctgtagtctcagctactcaggaggctgaggtgggaggatcacttgagcccgggaggtggaggccacagcaagctgtgatggcactaatgcacttcagcctgggtgacagagtgagaccctgtctaacagcaacaacagcagcagaacattaatccggatagttctaggatgagggttctcagagctagatgggcctttgcaagttctttccactgatccccaggtttggttgattgtatgaaaccaagaggaaatgtacagggtttttgtgaagaaaggaaagtgtcatttctttgggttttactttgaatggcattggatgaggtcctcagagcttatgtggggccagcccagcctgccccatgtgccccactgagaccctggaaacttggctttctcccactgctcccccagtgctcactgactagttttggggttttgtggggaccctttgtctatctgcttcgtcttccccagatgaatcaggggacgtggtggtaccatagtggtgctgagggcagcttctgggtgggggttctcagaaggagaagtctgtccaggaagattatattttattaccttctccctcatcttatttattttctgtttttttagaggctgggtctctatgttgcccaagctggtctcgaactcctgggctcaagcgatcctcctgcctcggcctcccaaagtgctgggatgcaggtgtgagccactacgcccagcctcccacctctttcttatttctttattgtttatttcaacaggtttttggggaacaggtgtgtttggtgacatgaataagctctttagtggtgatttgtgagattttggtgcacccatcacccgagcagtgtacactgcacccaatatgtagtctttttatccctcacctacctcccaccctttccccaagtccccaaagtccattgtatcattcttatgcctttacatcctcatagcttagctcctgcttctgagtgagaacatacgatgtttggttttctattcctgagttacttcacttagaataatggtctccagttccatttccatccaggttactgcgaatatcattattttgttcctttttatggctgattagtattccatggtgtgtgtgtgtgtgcatgtgtgtgtgtgtgtgtgtgtatacactgaaatttctttatccactcattgattgatgggcatttgattggttccatatatttgcaattgtgaattgtggtgctataaacgtgtgtgaagtatgttttttgtctgatgacttcttttcccttgggtagatacccagtagtctcctacttctttttaaaggaagccttgctctttcttaaaagctgctaaaaaggaatgagagtggcgctacagcaaacatctattgagcgcctactgtgtaccaggtgggtggctatggtggaatctaccacttcttaaaagtcaccatccaagttaccgtttttctgaaatactttgtctttcaactgagtgctttgtttttagtgatggccagtgaagggcccaattcaaacagaagcagagccgggggatactgaagggcctttctccctgtgagccccttagaactcaggcagaaatattttagcaaaaagtcgaatctgtacttctctggcttttaatgggttatattgaaaaggatatgacctgcctctaaggttgtaacttacgtttggctcagtcttaattatcttaacaaggggtgcctccccacccatcatccccataccttgtatttatgcatgtattgacttttctcccactttgatagcttgaaggcagggctgcagtgtttctcaccttggcaccccaggcttgagtgatgcctggcacacagtaggtgcacggcacacatctgagttgagatcctgatacgcaccctgtataagaccttcaacagcctgtcgaccactcactgcctccgtttcctcatctgttagatagggatgatcataagggttctttcttgcttgccttatggggccttgatgagaatcaaatgaaatgatgacatcagtcccttaattatttctcctcctcctcctcctcctcctcctcctcctcctcctcctcttcctcctccatctcctcctctcttcttcttccttttttttcttctttcttctttctttttcttcttcttaggcagggtctcactctgttgcccaggctagagtgcagtgggatggtcataggctcaagtgatcctcctgcctcagcctcctgaataactggaactacaggtatgtgccattgtatctggctaagtttttgtagagacagggtctcactatgttgcttaggctggtctccaactcctgggctcgagcggtcctcctgccttggcctcccaatgtgctgggagtacaggtgtgaaccactgtgccaggcccctttaatttattctgaaaatggcgtgtcaggagctgggtcttggctgccttgcttgcattgtgaaatccccttgcctggcaggtaggaggcagtcgatgcatacagggtgagtgaatgaaatgttagttagttgcattacattgaagtggtctaaacctgactctaagatgtgactactaggctgctgatccttttatgatttttcaagtgcgtagttattttccttttaaaagctaatcacatttcctttcctgactgatcctctgttatttctgcctcctcccccaaggggctgaccaccagccccaggcatctccttggccagctcagtggatacacacacgtcaggaagaccctcccttgccccagccttccttcgtgggtggcactggacactgggcagatggaaaggccctctccatggagcactgggctggcgagggccttcctgtctgtgccctcatgatgtcctcacttggctgtcgaggcatctcctgggccatgaagtgctgtttgctgtcctggccttggattcctgcatcaagtctcccagcaggaaaactgttaaaccaaaaccagtgttgggaactgcatcagagctggggaccacatcagtgctggggacctggatcagcattggggacctggattagccctggggacctgcattagtgctggggactcgcatcggcattgggtgtctttttgttgcttcctcaagtcctagttttgactctggatgaagcttggtttgtgccgtgggagtggagtgttgggggacaggggtgaccggcgggtgagccctcactgttgatcctggcctcgaatgggagaggggcactagtgcccctgggagtgggccaggcatgtcccagtccactgcctgccccagagccccgcctggagcacctgctgggtcgggacatgggcctcccgtgggcctcaccgcttcctgcttcagcagaactgggattgtcagttaatcgagcaacacctccaggaagccagcctcaggaaagagcttccacagggagttgggggactggtaattggaataaataaaagctaatcgtgcttcctggatgccaggaaccactgaaatttgtggattcccacagcagcacatgaggctggtcattgttaataacccctttttaccgacgaggaacccagaccagacagagagcccgcctgtgtcacctggtagggaggggctgggcctggtgttataaaccaggagagggttcaggccgaggaaagggggagcaagttgccggccaaggtaggtatcatgcgagtcctacttctcccctcattcaaggaccttcctttggggaagtgagtgctcccgagagcagcctgccgcctccgtgtcggggcagcctcagcttcttctttctgtgtccgatatttgatttctgttgtcgtggaaacggggtggcaagtgttccatgtgttagcatttggtcctcctgacgtagtcggcacacgggagatgcagctggggtggcacgtgcccacagtggtgccacctcttgccgggggtcaggcagaggagacccagctccgtgccagcttgcagacccccaatcacttctcctgtctcagggcccagagagcaaaggcagtgggaggccaatgtctgttgttcagtttagctctgagccacgtgcatcttcagtcagcccaggggcctgggcgcgcccttccttccttctttgtgcatgggggttttcctggggagcagttgccctggcccatgaggctgatgggagtcaagacagaaatagtggtctgtggtcagcaaggagctatcgctggaaacaccccggtccttccacagcctgaccctctgtgaccttcctcaaaggctccccaaagaggctttcccttgaagtgcaagtcatagtggcgcccctgccacgtccctatatgaacggggtgtgtgcccgcctgccctccgacgtccgccggctgtgctggtctgcagagctgccgccagctgcaccctcctcgccagtgagttctgttgctttcgtatcattttcagcaggagctaaacccaggccagcccttcttttcttttctgctttatggcagaattttgttttgcaagaatggaccctgggtggctgcttgacttttcccaggaaggtgatggggacgttggtgttaggacgatgggcaagggggtccaggttgtctcactgcggccccagagggatgagggtctgacttgtggagtgaaatttccagcactctgctgggggcgagtagatcattgggcccagaagaatgggatttggaacattctcaggcacatgctgcaattaagattttctttttcataggggtacctgatactgtgggtttctctctctctgtcttttttttttctctctgagatggagtcttgctcttgtcacccaggctggagtgcaatggcgcgatcttggctcactgcaacctctgcctcccaggttcaagtgatcctcctgcctcagcctcccaagtagctgggattacaggctcccgccaccgcgcctggctaatttttgtatttttagtagagacggggtttcatcatgttggccaggctggtcttgaactcctgacctcaggtgatccacccacctcggcctcccaaaatgctgggattacaggcatgagccaccgcgcccggccatgggtttctcgttagtggtcttcggttctgtgtttcccctctaagtagctgatcgtggccggtgcctggctttcccctggtcaccactagatattctgtcttgtctttgggaggcagagtcagtagaaggtgctttgcactgggcatgcctgggagtgagcccagccttgctgttattagcgcccatcgtgacggtcggccaggctgccctatgttcgatttttcctcctgtgaaatgggaacaacagtagagctgatgtgtcctgggctttctgcatcccagggactatcccagctccttaacgtgctttgctcagtgctatcctcctaaaaagttttcttttacagttgagtaagctgaagcccagagaggttaagtaacctgcccaaggtcacaccgcagatcggaatgggagtcaggagtgtacccaacagcctggctccctagtcagtgctctcaacctcagcttgaaggccgcctccctgggccctgctaggggacccagtaagatgacagttattcacattctcctttgtttctgataccaagcaaactcctggtaaatgctccttccccacttttgtggaataaagaatgcacatttttttctgagctctgcctgggtatccttaaggagagggacgctgtgcctgggacgcagatgaacaagataggagctgtttcctggaggagctcccaggctgatttttgcctttgatgttctgcatctttttcacaggctttttgtagatgtgtggggatatttctagaggagaaaccagaggtggaaggaggggcataatgaaattgaatgctgggcatctcttagctcacattatatgaggctcttcagggacaatagaccttgcaataaaaggcaaaaaggtgattgcgcacagagtgcttttcctgcacagtgctgggcgggatggggtggatggggcttggcggctggaggagggtagaccctgcccgcacctcctgggacctgtgcgggactttgctcaccttgctgtttctaaccaaggtaccagattctcttcactcaggtgtgtcagattttaacccttgaggctagaaccttgccaggcttattcgaagtcagtggttcctagtagtcacagggcccctgccctagaccccagaccaggaccccccggcccctgcccgcccgccttggcctggtggggtaggagtcactgtgaaaggggtcctggagcccagtatcactccagcgacatttcccagagagcatcctggggccagtgtggggtgtgggggaacagatactgagcgctctgtcccctccccttggagaatctcacagtacattagcagagtcaagactctgagaagtccggtaggaaaagacacctgcttagcttcccttaacttcacgactcctccacctccttgacctttgcttgattcatgtgtgacctgtgaacgtctaaactgcaggactcactttgggagatactgatggagaccaaataggtgtcctgctcatatatcctccacttcttcagttttgctcaggatccactgggcttcctaaaatgcaaacgaattgaaaagctgtgctgaatgtgtttttctctgtctgaaagtacagccacccacgaaaggaggaggtctgctaagttttcttttagaaaaggggtccccaggctctgaatgcttgaggacctcattgggatcaccccctccattgtgggctacccatcctccacccgctgtggcctattgataacctcccagccaccacctatgctcctagaggccctgactggaatccctgtcctcaccctgagtttgtcacctccttccaaacttcgtgtcctctgttgcagttgaggacctggaagtcatgattgggctgattagtgatgggtgtttattttgaattcttaactaaacaaggaggaatcacatcctagctccgtattttactagttatgggaccttgactttcccaagatctactttccttgtcagtaaaatggcaataatcggggtaacccataccctgattgctgagaacccctgtaggcgtccatgcctggcccaaagccaggacccaggaagggaggcgcagctgggcggcctcttctgcgtctctgccagttgctggcttggattctaacaccctccttccctccctccctcgctctctaccagtgggatctgagaccatgaaaacgtttgaaggtttctcaagcgtctgtgactgccccacgtctgtcgttgggtggaaaggactttgtaattgaacggagtcagttgtaatgtgaatgtcatgtggagctgcttttccttggcaagtccttgctgtgtgagccattgtttccagatctgtagaaccctccctaccctgtccccctttccgggctattgggaggctgagcgagctcatcatgaggcccctgaaagatagtttctgtgccctgtggagctgagtccccgagtctctgtccccacctcacaggccccctctcaccaccctattgggttggtaaatttcaagttgggcatcagataggacaagggaaggggactggagaaggaagagccgacagtttgccctcaggacttcagagtcactcttttttgtttggttggttttttgagatggagtcttgccctgttgcccaggctggagtgcagtggcgtgatctcatctcaccgcaacctccatctcccgggttcaagcgattctcctgccttagcctcccgagtagctgggattacaagtgcatgccatcatgcctagctaatttttgtatttttaatggagacgggggcttcaccatgttggccagacttgtctcgaactcctgacctcaagtcatccacccaccttggcctcccaaagttgctgggattacaggtgtgaaccatcgcgcctggcccagagtcaccctttctttttgtgccttattagacatcttcctgctacaggatagcccagaagaaaggaacaagtttccgtcatgaataagtcccctacctactagggatgtagggataaaggactggaactctctttcttcaccctgcagggcaaactccttcaagactcagctccaggaagcctctctggactactacactccctcctgagcccccagccttctcacatacctcccttatgtgtctcctgggtgctggagccctcagagcagggcctgtatctaagtccccctgtggcccacccagtgccccgtgccaggcctgaccatagtggatgtcactaagcagttgttcaatgagtgaatgaacaaatgcaaactaggcccaatcttatcaaattatactagaataattgtataaaaaaccagacttctttaagtggaggaaatttaaagtcagaagtgggctgggcacaatggctcacacctataatgctagcactttgggaggctgaggcgggcggatcaccggaggtcaggggttcgagaccagccagcctggccaacatagcgaaacccgtctctattaaaaataacaaaatttagctgggcgtggcggtgcatgcttgtaatcccagctactctggaagctgaggcaggagaatcacttgaacccaggaggcagaggttgcggtgagcggaggtcgcgccattacactctagcctgggcgacagagtgagagtcagtctcaaaaaaaagaagtgaatgaatacgaccatacctgcttttccagctcctgactcttaaacgtctcgaataccaatgccaaataaagggaaccgagagatgaaaggtgtcactgtcctgatcttcagatgcagaaatttctgtgtagctgaggaggtggggcccgcttgcccccctttgaattttgggttgtgcttgagcagaagcattcattgcttggagaaagcagaggagaccccagaagcacttccctctgaaagggagaagcaggtaggccaaggcagcggttctgggaccagctctggggccacctgcttttcccacactgggtctgtggtgggctcggcagctggcctgcacacaggagatcctcaaaacagatgagcgagcatgattgccatttttacactccctcatttaatccgcagcactggaggaggtgtgattatggtgtgtattttgtgcagccatttggtggacacctaccgaggacccgccgtggggcaggctgctggctgggctctgaggatgctgacgaggacccttctttgggatcctctgttcgggttgaagacagtttatgaaaacataagataacagaatggccgactctgaggcaggagccaggggtgtgtgagtgggggtcctggaaggggtctctggaaaccagaggaggagtggtcctctgaggctggccaaggctcccagcagagagacgggggcatgggcagaagcctgtcgtgccagtgagccctggcatttctgagcccctgatcggttctgttgcctgcacgacggcctgggtgagcaacactgacaggagacccctgccttagtaccatgtctcctgggctctggctagtggcgcctcctggcagcagctgcccaggccacacaggatgctggctacatgcttggctggtctggccatccctgcatggccccgctgtcactggtatctggagatcacacccagccagagcctagtgccaccctcggatgcttccttggggagggaggatgccctgtttccatggcaaccctaggtgggaggccagggcttcaggcaagctgctgagcttttcacagccctgggagtgaggagcagggcaggctgaccctggcctgtggggcagaattagtagaggaggagccccaccatccctgagaagaggaggggagtggggtggggaacattagacaatgttcactgcccctccctcagcttcccagctgcccacggcagtcccaggccaggccagtgtgggcgtggggggcagttagagcgtggccgtgtggtgtgccagcacgcagtgcaacagccaagacaatggagtcatcccctgcccctgggcccttccctccaccccacctcatgtctgcactaggtgaggaagcagaggacggaggagcccagtgggctctgggagctcctgggactcctgagtcggtggggacggggcttcccagcctcaacactgaggattcttggttgtggagctctcctgagcattgcggggtgttgagcggcatccctggcctctacacacgaggtgtcagttgtgacaacccaaagtgtctccagatgccactacgtaccctcccagtgtgggggtggaggaatcgtccccagttgagatccgctgagctgagaggctccccggaagcaggtggtgaaggaagggaaggccctgggccctggagacatggatgcctgcctgggacacacacaaacacgcacgcacatgcacgcatgcatacactcactcatatgcacacatgttcatgcatgcacccgcagtgaccctgaagggactagactatttttagagcacttttaagttcacagcagaattgagtggaaggtgcagagatttcccgtgactgcacggccccaccacgcacactatcaacatcctccccctctaacaacgtccagaccagagggtgcatctgtggtacctggtggacccacatggccatatcagggtcacccagagtccacagtttccatgaggggcccctcttggtgctggacattgtgtaaggacagggacccccatggtagcagtgacactgccctgagatccccgtgccccacctgctcatccctgtctccctctcactcctggcaacctctgctcctttcactgtctccgtagttttgcctgccccacagggtcgtgcagttgggatcacactgtctgcagccttttcagactggtttttcactcagtgagatgcatttaagtttcctccacgccttttcacagctgacggcgcgtttcttcttggttccaagtggctctttctgcattgtctggacggatccatttgttccctgtttgcctcccagaggatccgctgctcttgctgcagatgtatagcccaggtgctgtggagttgggatggagcagtcgagctgggatcagagcccaggcccctgccctgaggttggagctctctgactgcacctggcctaggcctgtgcattgtctaaactgatggccgtggggcaggggacctggagcgcaaagcaggagaggatgctgaagggggcaggtggggccgggacttgggagtgtctggaaggaggaccgcctgcctcaacccagggctggtctgtggaggccagagcgctcagcccctcaatgctaggcctgttgtgagtttctccatgaggtggccctctcagaaagagtggctccacagcagctgagttgggggccccatggcagctgagtcgtggactccatggccgctgatttgggggatgcctgtccttgtagagactgtcacctctaggaatggtgaaagggcggccacccgcagccctgtgtcctctttctagtcctctgtcttgtaagcccggtccccacagtggccccagtcctcccctgccagaaattcgttctcctcagaaatccgttctcctctctgatctttcaggcctagagacaggctcttccctccggagggtgcagcccaggggttctggtaagatacagagcccagcctcaacatagcaggaagtttttccacaaatacacagttcttcaagaccacatgcagctgtgcgtggggtgtgttttgaagggcaatggcaggagcagtgtatgcctcgtggtgcagggagcacgagttgtttataggcgtgcctgggtcctgggtctctgtgcaccctcctctagattcatggggcatctgcccaccgtgagatagataagccagggtgcctgcccctttctcaggtgagatgctgagggccagaaacatgctgctgtgtcccatggaggaggtggcctgccccaactcccctgcaccctagggagagtgcccacaggctgggggctggggctgggtcctgtgccccctccccagccctcggtatgtggctcgctgaggtgtgcgccggaatgttgggcacatcctgtctgataccagcttggctggaagtcgaattatgatcagaatatcacatgatgtgtggcctgggtccccctttggttgacactcttgagtatgggtcctgtgcctgcccggggccaagcagcaggtgcaaccgggcctgccctggggcagcatggggtgtgctagtgtcctggggccactgtaacaaagcaccacaacctgagtggcttaaacaacagaaacatagtctgtcacagttttggaggctggaagtccaagatcaaggtgtcagctgggctgtgctccctccagggctccgagaggatcccccttggcctcttccaggctgtggtggctctggtgttccctgccgtgggccacatcactccagcctctgtctccctcttcacgtgggcctccttctccgtctgtgtctctgtcctctcctcttcttgtaaggacgcctgtcattggattagggcccaccctaatgaccgaatctgcaacttgattacatctgcaaagaccctgcttccaaataaggccacagtcacaggtgttgggggccagactccagtgtgccttttaggggagatacagtgcaatacacagcacacagtgaggtcttccagatccccagacctatcttcttccagaccgccagacaacaccgataagggtgaagttggcttacgagtcctggccaggatgtgacggggagtcgccaggtgggtgccggggaggtgggaagctctgcaggggattggagaaccacacgtcattgcccacatgtgactttaaaccttagcaatgatattggagggggatagttactctttttttttcttctgagacagtgtctcattctgtcatccaggctggtgtgcaatggttctagcgattctcctgcctcagcctcccgagtagctggtattacaggcacctaccatgacactcggctaatttttgtgtttttagttgagacgggttttcaccatgttggccaggctggtttcgaactcctgacctcaagtgatccgcccacctcagcctcccgaagtgctgggattgtaggcaggggatattactctttacagctagggaaacagttgggcttggtgacatgatagagacaccaggtcccttgaggacagggggccatttgcagagccgtgtggtggaaggagcctgaatttggagccccaagctcacagcgtgggtccttgtcacatgtcctgtgagctctgtttgcatccttagctcaggcaagctactgtgttgaactggctggacacagtgtgtctgtctctccctcttccagagaagtcctcacttaaggttgtgtcactgtttttactgatgttggaattggcacttggagatgtgaactttcccaaggccacacacccagatgagtggttagacccggacctgcctaactccagcatatctttttcagggggacacaattaaatccacagcatggactgagttcccctcttctctgccaccatcctgaccttttcctggccagggttaccatgtcggggcaggcatgggggaagtggtaagggaggtatctggacctagtaaaaggctctggtcctcctgcttcctcttgtaaggaccctgtcaatcacatcgggccccctgaataaccaggctaatctcccaccccaaggtccttacctaatcacatctacaaagtccccctcttgccatgtgaagtcacaggttcctgggacttgatgtgaacatctttgcagggaccatgatccagccttccatagaggcagtgacagatggagtagaatataggtcctttgagtatttatttatttaagatggagtctcactctgtcgcccaggctggagtgcaatggcgagatctcagctcactgcagcctctgactcctgggttcaagcgattctcctgcctcagcctcccaagtaactaggattacaggcgcagaccaccaagtgcagctaatttttttgtatttttaatagagatgaggttttaccatgttggccaggctggtctcaaactcttgacctaaggtgatccacccgcctcggcctcccaaagtgctgggataacaggcgtgagccaccgcgcccggcccctgtgagtttttacaagagacactgcagtagagagaatggtagagtcctcaaaccctgattcagtcgttcatgaattcactgagcactcaacgtttcccgcaatgtgtgtcctcttctttgccagcctgctggtgtgctcctggtgcttggtccaccatagatgggtgtgcttggtccaggaggctgatggtgctgacatctgggctgatattcaccgtttttagtgacttgaatgacgtccatgcagaagagctagtgcaccatccttgtgtttgaaaatgcccgggctccagcctgagaacctggtaggccagtaattggagggacagtagcaggatcgagaagccatctgtgtcacgtgttcttggggacaaagaggagacacaggctcaaggaacagcaaggtttgtgggacacagctgtgtctgaaaacgtcaagcagttagctcatccctggctacttcctgtgaacccattaaatccccaggctgaggaggacagagggtgagggaatctgaccccttactcagccctttagccagcggctgctgtgctaagccattctgagaagccaccggtggagaactgacttcaggtcgtgctgactgtgaggccatccagttgtttttgcacattgaaaacaatacattacactttgggaggccgaggtgggtggatcacttgaggtcaggagttcgagaccagcctggccaacatggtgaaaccccgtctctactaaacatacaaaaattagccgggcatggtggtgggcgcctgtaatcccagctacttgggaggctgaggcaggaggatcgcttgaacccaggatgtggtggttgaagtgagccgagattgtgccactgcactccagcctgggggacagagcaagactccttctcaaaaaaaacattgttccggatttgctaataaggaggcaacctcctcagaccttggtgtcacaggagaatggcccgcggcagccttagggccagttgtgattttatccacagtgttggtcagatgcgtcctctgtgcttgtttaatattcattctgcttgcgtgaacaaagccatgtcagtttcagtaacgcttgtgccagggggcacccggtgtggagcagggctcagtaaaactgctgcaaagaatgttccaggctttttgaaattacgtggagttgctggggctctcttgaggctgttaatttacttagggctgctgtgacaaaataccacaaacccagtggtttaaaccaacacaaatctattattttacagttctggaggtcaggagtcccaacatcaaggtggcagcagggccggttccttccggaggctccaggggagaatcccattccttgccttttccaacttgcagaggcacctgcgttccttagtgcctggcctcttcctctgtcttcaaagccatctcccgatctttctctgtctccttcgccacacctcctctggctctggccctcctgcttcctcttgtaaggaccctgtcaatcacattgggccccctgcataatccaggctaatctcccaccccaaggtccttacctaatcacatctgcaaactccctcttgccatgcaaagtcacagtttcctgggacttgatgtggacatctttgcagggaccaagatccagccttccatagagacagtgacagatggagtagaaagtacatcctttgagtttttacaggagacactgcagtagagagaatggtagagtcccgaaaccctgattcattcattcatgaattcaccgagtgttcacggagcacctgcctcagtccaggcgtcatgttgggagcaggggagacagagcaggccatgcatctgtcctttcagagcactgtagacgcaaatcctgtagcacagatgtgccttagactaatagtgcctcgaaaggagaggaaggggaatggatgcggggagtggggaacctgacctgctttgtggggtcatggagtgactctccacctgccgtcatccctccatcccttgtttggggctgttcctccaaaggtgcagtctccagcaggggtgtggggacccctgtgggccgtgaaggcctttctccttttctgctgtgggcattgcatctgttcctgatgggtagagttgtctgtgcccggtggggcccaaggcagtgccatggtggttctttgagtatctcaggtgggaactgagctgccagcaccagaggccaatggcttccagcactccccaaatccacctgcttttggaaggggcctgtctccgaagcaggccgggtcctcctgttgggggaagctttcatggaggcatctgtgtcacttctgcaggggagacagccgctagagggcactgtccttctggcctttcccacatccccgtttccatggcaggtgcatagtaaagcctttctttttctaacgacttaatgatttaatcttcttattttctcagcagacaacgctttggacttccctggatacattgggacgttaccagtcacattaattaatacgagtttcacaacttgggaaccagcgaacgtgcttctccagacttagcttctgcacggccgtttctgctttcctttatgaagtgcgtttctctaagagcctggcagtctcatggggctcgtctgttgctggaagtgagcagcgggttccattgccccccgcctcggtggggctcattgtgcagcttgctggcaagtggctgggctcggaggggcggtgacggtgacacacgccaggggaaaggttggcatcctcttctgagaattgtttcttttgggtttcacaccctgcccccaccttctgctgcctcgaggctcttttcttcttattattagctaatgacagatttcatgaccagtgactgaaatcatttggaagtaccccctgaaagccagcgtgatgggttggagaaatgtgacagacgcagcctctgaaaatcacagaggcagaggcttgcgtcgaaggacttgctaaggaattaggatgagagtggtcaggaggcagtggctgctgggcactggagctgagggtgaggggccgagaaaacgggaggcaaatggggtagctcttttttggggcgggggaggctggctttggggatgtgtatcccactgtgcaccgcaaggtgggggcactgggcggtaggttcccgtgctccggaagggtggcaattgaagggaggaattaaagaagttggccaggtgcggtggttcgtgcctgtaatcccagcactttgggaggccgaggcaggtggatcacttgaaatcaggagttcgagatccacctggccaacatagtgaaacctcatctgtactaaaaatacaaaaattagctgggtgtggtggtgcacacttgtaatcccagctactcaggaggctgaggcaggagaatcgcttgaatctgggaggtggaggttgcagtgagccaagatcgagccactgcactccagcctgggcgacagagcaagagtccgtctcaaaaacaaaaacaaaaacaaaaaacaaaaaacaaaaactgactcatgtggctttcagtctgagaaaccaatcagatcatcattgtctctaaagaatgtgtcctcctttgtagacaagaagctcaccggcccctccatgccccggtttctcgcccaggtgggttagacggccaacctgacattttaccgtgcacctggaagtctttcttcctgttctccttcccacaaaggattcatttttctgtggttctaacattttcctgatcaccccagggacaaaggggaagaaaagaccgtgtttctgggccaagggaatcatctgtttaacatgggcttcggagctttttttacatttctatgtaagcaacttttcgtattcagaagacccagtttccctgagccagatggactccttccatctcggggtggtctgtatttcagattcctgcagcaggtggctggtcggaatgcacaccccaggaggtgaggctggggggatgttggctcctgggctgcttgtactagcaagtccctaattgcggagcggactccttcctcctgagcccatcagcctctacgtggccacatcagggtaattgggttccttgtgaaacacgactgccaggctaatgtaaaccttaatggaaaccctctttttccacccaattaagtggctggaggtgggatgctgtgtgagagccgtcagttcagttccctgactttctcttgtagaaattatctatgtagctccatttggcctacataagcttagcatttgtgttcattcattcattcattccacagatattcagagagcagttatccatgtgctgggttttatgcaggatgtgaggccatggtcatgaatgggacctggcccctgtgcactccttgcggggtcggggggtgcagggagatgagcacagtccacaatcacatgatcggggaatagggtttgtcattgtcatgtgcacggggagctgtggaaacccagaggaggggcccgaactgcacccagggatagaggatgtgcagagtgtgctttccagacggtgggaaatgggtggagctagctgacctgaagtgaagggcattgcaggttgtggggacagtcgagcagaggggcagagatatgacctacagaagtggcctggaatggcctcatcagacgatgagtgtggaagcatggtaactgcagctgtattgatgagaggaggggtctgctcattaacagtcatcgggtaccactatgaaggttttgcgttttaccctggagctggtgggagccatggggtgcactgcagcagggagtgaccaacgccagctttgtgtattggaaggatttctacatcagacaggactctcttggtttgcaaaggacagaaaacccaactcaaaatggcttaaaagcaaaacagaattcactggtacatttgacagaatggtctgtggggttggatggcctcaggtaaggcttgatccagcacatagaaggtgttgctagatcctagattctgttctccccttccccgagctctttcgatctggtgccttcatctccaggctctgtatagtggtaagatgatgggacggcttcaacctccatcctttctgggtcaaggccagtgggaaggagtgcctgtctcattctctattcctggtaaagtctcagtgcagttcattagctctaactgggccatgcccatccctgactgtgttcctgggaggccagtgtgccagctggctttgtcctgggatgcctgctccaccccagagctgaactacaaggcccgagcatggtggcaggaggggtggctctctctgagggaggctgagtcttgtttgcctgaaaggatcaatggatgctggagaagaaaagcaatggtgtccataacagtcacctccagaaggggagaggctgggctggggtgggaagagtttagggcagggcttgcaggggccaaggtggccatcctggtgagaaagccccactggccaatccaagaatagggcacgagatgtgagcctgccaagggtactcccaggtctggcatcttggttctttccgctgcgttcttggcacagacactcatgccagggcctttgctgtcacccatagtctcagagtcatgttattattctgcagtcatctgtggggatgggaccgtgcaggactttccctccccagcttcctccctccttcagggtagctcactgtgtcccccgaggcagccagtgctgccgggagaggcccgagactccttctgggtctcagagccatttctatggttgaacccagtgtgtgtccttccctgtagaattggctgccactttgtttcctttagggtccccactgcaccctgtacataaccctgccaggacatctgtttattttccattcttgtagctttatttttatttcaaaaggagtacaagaacacagtctggtggcagagcctccctctgtctcctccttaccttcagccactgggccttgcatcagtaatgctgctcttgtcattctggagcatgccctttcatttctttttctgtgaattttgatacgtacacatagaaatacatagtggtgagttttctagttgtattttttacataaatatcatgctgtatttattttaaagtgtctcaccatgttgcccaggctggacttgaacccctgggctcgagtgatcctcccaccccagctccaagtagctgggacaacagatgtacaccaccacacccagcctttgctgtattgttctgcaacatggttttctttttctttttctttttctttttaattttttgagacaagatctggctctgtcacccaggctggagtgcagtggcgtgatcttggctcactgcaacctccgcttctcggcttcaaactttcttcccagcctcctgggtagctgggactacagattcacaccaccattcctggctaatttttgtattttgtgtagagatggggttttgccttgttgccccgctggtctcgaactcctgagctcaagccatccacctacctcagcctcccaaagttctgggattataggtgtgagccactgcagctggcccaacctgcttttgcttttttaaaaaatctcaacaccatgctatgtattgcacttaattaattgtgcatcgaatccttcacgagccttctgtgccaggtgcgaggtcggctgctgggtggaagtgaccaggatacgtcttccctcggctacacgcagactctccacggtgcaagggcagggcctgcccagccccatgcccagccctttggcatccatccaccagtgttagttagatcagcaggctgtcatgcccaaggcttgctgccatctgaataggacagggtttcagcagtgagctcttgatgtggagtctgcgccacctgttgaccttctttggatttaccttattgaaatgttcacacatttcttttagcttctcaacttatttcatcttgagaaatgggctggaacctcatgccccagcacaacaagccccataaatcagatgttcaagctgagcgatccttccggtttgggccacagtcacggggctttcttactcctctagtcatgtcagcaccgttcagaaactcatccttggcttagagatgatagtgagttacatgtacataaatacaccgagctcattaccctgggccggcatcctgcatgacaagggcccacatccatttctcggcaaaaacaaactacatctgccacttgaaacgtcaagaagcgctttcttgtatgttgtgctccatggatcactggaagtcctttccctcttttcccatgtccgggccaggaggagcagctgctctctggcactgttagcctttgctgccttttatcctaggcaagacactttgttattcctccgatttgtaatcccaagaaccttggagattggacttggagttcgtaacctcctggggagggccaggcctcacatttcaaggcctttgcacgcgtgatgtgccagcaacagctcagccctttgaattatgatccgcgactccctccaatcaccttccttctggatgtcagaaaagactgcccaacagcatctcctcccagctgccgaggctgatgatgtttttattctgatttagatctcacttaggtcttattttaactccactgagctgcaagatcttcactgaagtacaactggacttatttttagaaaaactgctctgttaagaagaccttcgtgcctgatgaagttagttattctgataaattacagcttctacgaagaaaccacacccctctgagtacggatggaagttggaaaattcatagaaagctgtcatttcctggcagaggcctggaaaacctcatttaacagagatgtctttgggttcctgcttaagcccaagcgaaggatcccgatgccccctccccagctgggaagaggagctggtggcgtgagttggcacagagccgcacctttctttctcctcctgtatcctcccgcaagctctgaagaccactctgtttctttgagcaggatcagttgtaactagaagtgggtaggatttgaaaagggctggttaagtgtttaaaactggggcagctttcctgccattttccagttcttttagatgtgcagggatggagaatggctgtttttgttggggttttctctttgatcctggttcagacggggccctctgaaatttctcgccctgatcttttgttctctatgaaaaccaggaattgcacggatggtgtagaaagtccccgtaggtggcaaagcatctctgctgtgttgaaatgacacacttagaaaagtgtcagaaaatggagttgccattgctctggccccccaggacctgtggctcagcctccattgggcctttgtgtctgggccagaccctccaggcaagcccccagtgaggctcttgggcccgtgattgcaggggcgccttgccatcccccgtgtcctgccctggttctgctagtggagcaagaagctgatcagcctttgtgttttcagatttcttctctccgttaaggtaaccttgttctttaaaccagcttgctttcaaagttgttttcctaataatatcaaaagggggaaaaaaagctgcctgaaaatccttttttgggaaagagcctgggcataaataaataaatacaaccatacaaagaagaagattaaaaaaaaaaaaatcaaagatggaactttcgcatttggcctgaggtataaatggcaggcttctgatgacatgcttttagtttttgattctctttctttccttttatgttcttgtaattccaaatcaggaacgatggtgtttttttttttttttttcttttttcttttttttaaaccttgcccaatctttgggtggaggctttggaagccgcacatattccaccattatagttactcaaagctgacgcttcccgaggggtggctgcatgctggcgactgtgccgagggtgtgtgtccctgaatctttgtgatctctctgaggtgtgttaggccccactttacagatggaaactgagacacacagagccgtcaagcagcttgcccaaggtcacacaccttgtcagtggtcaagctgggatccaaaaccagcagcctggctctgggattctaagctctctgttgtgctgctccttgaatatattaaaaggcctactatgtgcaggaactgggttggcactggcaggaaggcaagttcgggaaggagatagttacatggctgtgtggcttcagctggggagaggggaacacccaggagggcttcttggaggaggcggccagtaagatgaggttgaagataggtaggatttagtagggcacagtgaggtgcaagatcaggtagaactggctttagtcctgactctggggcttcacatctaacagcacaggaccagccactccctcacagacttgtttatttattattattgttattatttttgagacagacggagtctcgctgtgttgcccaggctggagtgaagtggcacaaccttagctcactgcaacctccacctcccaggttcaagcaattctcatgcctcagccgcccaagtagctgggattgcaggcgcccactgccacgcctgactaatgtttgtatttttagtagagacagggtttcatcatgttggtcaggctggtctcgaagtcctgacctcaggtgatttgcccaccttggcctcccagagtgctggaattacaggtttgagccaccgtgcccggcctccctcagacttgttaggagacaaggtgaatggctggcatggaagatgccctgcacatagtaggtgctcaggaaacgttagtggtgctctccccctttccaatggacagtcagcaatatgggttggacaagtatgttctgtaatccgaggttgtgtgccctctggctggcccacaaaatttgaattaatggctcgtatttataaatggggagattccacaccaaaccccacatttccagcttttcttgaaaactcagatctggtgactgcagcctgcacttcccactctgccatcccgggctgagcgaggagtgcccgtctccagagacagtgtgccaaggggccctcctcctatcaaatgccctcctgtctctctcttcctacctggccccccgtgcaggccacagagcgtggtgctgcaggtgaactctgctgcggtgggaacgagttggcatcgactccctcgtggctggctgctgggtttcgtgtggacagagacattcatcttagaacaatgcagacacttaggaaaacaagcacaaggcggtctttttcccttaatcacccatctcatgaaatcaagccccagtcccttggaagctcacaccctccacaccctccagacactgagagaatgcatgccagcatgcctgtgccagcgcgcctgtgccagcacacccgggccagcacacccgggccagcagatctttctctgtgactgaagacagccggcacttcacatctttgaagggtttgtctttctggcaagtagaccggtactttaaaaaccaaaacattcctgggattcactgaaagccagtaaactggcaccgttcaggtggcgggggggtcgggggaggggggaagccaagggtgtgagaggagcccctccttccaaaaatcacaccgatcctctgaaggtgacgatcagatccaggctgcaagttcttctgcaaaggagctgtgtccataagggaacccaggctgcaaaatatagcaaggcccagaagggcatccctcaaaccttcatggggttcagctttggacatgctggctgtggtttgtctccactgcactctgcaaagagccccgaaggccctttccttagcctggccatatttcaaggccagttcaattgctgcctcctccaggaagccctccatgcttctctgtggaataggggacctcgcctgccttgtggtcactcttcctccagtctgtgtctctcttggagcctaatcacagagaccctgtacatccacagctgcctctcccacttgcagggagtagtttgtgggccatgtgtgggtgctcacggttccccttattcctcaggaaatgtgaggaagttcctgtgaggccggtattcccaccaccccatgttacagatggggaaactgaggcttagtgcggtgaggggacttccccgaagccacacaccaacaagtggcaatgcgagatttggactggggctctgtggccacaggcctgggctcctcctgccaaccgaggggtctgccagcctgtgcccccctcctcctggtccccgaagcctttgcttccctcaggccatcgtgcataaccagccccttcagaatgcgctgctgagcagtccctgggcggtgttcgtgagcacgtttctcatttattaaggtcacaaaatccctggccctgtttagtgtcatctttgatgttcaagggcggtgtggaaatctctgttttgatatgacccaatttctaggctttcaaaatgtggcttctctcctcctccctctctgtgtttttgaaatcaggtgagcagggctgcctcgaagcgttgaccacttgccccgaggtctccctccccacccctcaggcccaggcacatgggtgcagtgccagctctcgggccttgccaagaggactctcgggcgtagcccacctgtgtaatcctccacacatagggaaactgggtcttttgttcttcctctgccatcagcgtgagcactgcaggcagctgtgctggacgggacctccctgcccctgttgtgtcctcctatgatgccagccaggacatggaacttccaccccgaccccctgtgctccagggctatcatattcccaaggatttctgtgaaaaatcacttttccctgtttcctttctgccttttaagactctctgctggttacaactctctttgtaactcgtcatgtggtacaaatacttgctgaaatttggtccctgttttctcagctgatctgggtgacctgtgggggttcttctggattatttttagagaggtggggcagagggagtctcaaaactctatgtctgtatcatttccctgtgaaggtatttaacatttgtccactgctggtgtagcgttatgctaaggattttggaaattcaaggatgagtggtgcctggatcttcccttaggatgctggctgtgggtggaggacagtgtgtgcggcagccaggctggctcgcggctggaatgtgggttacctggagagggcctgctttttttttttttttttttttgctatttaaaaaaattgttgtaaaataggcataacgtaaactttaccatcttagccattttcaagagcagagttcactggtattaagtacgttctcattgtgcagccatcaccaccacccacccacagaactctttcatctttccaaaccgaaactctgccatcattcaacactacctctctatttgctacttcccccgcccctggcatccaccagactgctttctcctctatgcattcgcctactcgagggacctcctactggtggaattgtacagtgtttgactttctgtgtctggcttatttcactgagcagaacattctcaaggttcacccatgcggtagcctggtccgaatgtccttcctttttagggctagataatattccgttgtatacgtggactaccttttgcttactcattcatctggtgttctcaaatgccaagactcagtgactgcagcagtgcccgaaggttccctcgaatcaaagaacttcctaaccccaacctgtacctaggctctgatactcctgcatcaggcagtcctctaggataaggtgcctgtttaaaatgcaaatatattaccttcgggggagtgggtaactggcatcctggggccccgctgccattgtccttatgagggagggaggttgtgttgtcctggaagtcgggtccacggtcacgtcctgagagtcccatcacgtgccatgctctgggctggggacttgatgttcattgtttggttacatttagcccttccaaagaccctggcatttttgcagtgttacctataaattccatgtgcggaaacatgggttatttccactcttttttttgagatggagtctcgctctgtcaccaggctggagtgcactggtgtgatcttggctcactgcaacctccgcctcctgggttcaagcaattctcccacctcagcctcctgagtagctgggactacaggcgcacgccaccacgcccagctaatttttgtatttttagtagagacaaggttccaccatgttggccaggatggtctcgatctcttgacctcgtgatccacctgcctcagcctcccaaagtgctgggattacaggtgtgagccaccgcacccgacctgggttatttctacttttgggctattttgagtcctgcagctatgaaaatgggaataaaagagggtccgctttttaagaagctgaatatcggcctttgctgacatgagaggagctggcatccttgggccctgctgccattgtccttatgaaggatggaggttgtgtcgtcctgaaggctgggtccacagacgtgtcccaagagcccatcatgtgccatgctctggactggacgctcaacattcatggttacattcagcccttccaaaggccctggcatttttacagtgttacctataaatgccatatggagaaataggtgcagagaggtgagtgggatgtacctggggtctcacggccagcatgagtggggccctgttggcctgctgctccaaagccatcatgccacacccccttgctgttccatcatctgccgctgtggaggctggatgtccagagctagaggtgttcaaggttcaaggtgattctggtgttaaaagaggaaataccattttacttctgaacctgtttcatggagaaagaggtacagctccgggcacactggcctgggtacctttgcagcatgtgatcagggactgctccccagcggccctccaccagtgccatgaaagtggccagggccctacctgcacccggcaccatggatgcatcttggggctggaacctcgagtcttacatgcagcagaggctgaggctgtgactgtggagaaagcgtgacattacagaagcaagggttttggcacctggtgtctgtgtgggtgggtattcctccctggtggatgtggctgaaaggcctgcagggtctcactggtgcagggagatgaggggtcatttctggttctgggattgtccctaatcactgggcgttccagatcctgtaactgttcagcactcccttgagacaggaggtcatggtgtttctgacttggagcctctggctctctttattagattctgttgcatgttccagccatcctgacccgggtgttccatcagatttctgtgcctgtgaatgtggccatcaccagtgaccccactttaaactccagattcacctgtatgcatgaccggagggggttagcatcttgagtccgtggttcaggacgcagccccccggcagagggaaggcagccccactctctcatgccccatcgctgtggtccatgctttgtctgcctcagcagtcttggtcagatctggaagcatctggaggcatctggaagctttggtgtcttagttatgagtttcaaagggcagtgaaaacagactggcagagctcagcgagacctgggaaatatttggggtggggaggaactgcagaatgtattcttggttcagagcatttttccctctgactctttctgggcaacagaccttttaggaatgtttgttaaatgctgaaaaaaacaggaattgatttctctctgcgtccacagccaacatgtgaggccacggcactccgtgtatactaacctggtttttctttccttttgctcaacagtgagtgacctgcaggaagaaggcaagaatgccatcaactcaccgatgtcccccgccctggtggatgttcaccctgaagacacccagcttggtacgggggttcctccgctccctgccctgagacagttgagcttccgtggcactaagttggtcttggggaggccaatgaggagcccgatagatctggcctcttgatcagatgctgggggcatttgggagtctaagttcttagctcaaggtcatctttagaaaagtccattgggaaaagcaagtccttcattaagggtttctgccctagtcttaaaacgtaagttttatttttcaggtggtgaagcaaacagattgggagaagactgacttgaaaagatagtttgttaaactcatagttctgaaaggaggtgtagcaggccactcagggccatgccatgccacgccatgccacgccacgccacaccatgccaagccacgccacaccatagcacaccatgccacagaaggccacatggaaagcactagtgtgaggcagaggcagaaggagcagggctaatgcctttatttgatattttatgtatatattttttgagatagagtctcactctgttacccaagctggggtgcggtgatatgatcacagctcatggcagcctttaccgtccaggttcaagtgatcctcctgccttagcctcctgagtagctgggactacaggcatgtgccaccccgcccacctaactttttaatttatttgtagagatggggtcttgccatgttgctcagactggtctccaactcctgggctcaagcagttctcctgcctcggtttcccaaagtgcagggactacagatatgagccactgcgcctggccccaacacccttactgtggctttctctgaaggaatgggcaaggctgggtgaacaggcctaggcctggcttgttggaatcgtttcactgggctttgcggtgcaggagctgtcctgagtcttctcagtaagaagactcttcttcttccacaccacgtggcgtggcgtggtatggtgtggcgtggcgtggcatgtccccagggccaggggagattagggtgaggatattggctgggagtgtaggagccccgtgagagcccaaggaaagaggtggctggggactctgggctctgcggctcaggctctgagtggttttcatatgaaaggtgtgctcacagagggtggtttaccatctctaggaattagcttgccctggaggtgcaatctctccagagtcagcaaggccccgagatgccaagcaccagaaaatacagaaaacagggcgggcacggtggctcacacctgtaatcccagcactttggaaggccaaagtggacggatcacttgagttcaggagtttgagatcagcctggccaacatggcgaaaccgcgtctctcctaagaatacaaaaattagccgagtgtggctagcctgtaattccagctactctggaggctgaggcaggagaatcgcttgaacccgggattgggatgttgcagtgagccgagatcgcaccactgcactccaacctgggtgacagagcgagacatctcaaagtaaaaaaaaaaaaaagaaaaaaagaaaatgcaaaacacaattaatatgcttcttccctttgggccagccagagctgcccgcggcctgggcttgcagggtgggctctgccaagtggcccaggcccctgcgctcactgcctgatgtaatgggtaacagccaagacacattttccttaaagtgtgttttgggatctagctgatctggaaggcatttatggaacattctgcgtatttccaaaccctggttcgaagggaagtcccggttcatcccttttttgtggtttccgtgacgaggccaggccagcaagagcttatggagaagaaacgccgatgcaagttcagccgccaaccgacccgaagccagagctggtgatgctgcctgaggtcgcaccagggtccacggggctttctctccctccgcttagaagagagtggccccaccaggctcggtggctcaggcctgtaatctcggcactttgggaggctgtggcaggtggatcacctgacgtcaggagttcgaaaccagcctggccaacatggcaaaaccctgtctctactaaaaaatacaaaaattggctgagtgtggtggcaaacacctgaaatccccgctacctgggaggctaagtcaggagaatcgcttgaatccaggaggcggaggttgcagtgagccgaggttgcaccactgcgctccagcctgggcaacaagaatgaaactccatctcataaaataataaaataaaataattagccaggcatggtggcacacgcctatagtcccagctactcaggaggctgaggtgggaggattgcctgagtctgaagaagttgaggctacagtgagccaagatcacaccactgcactctagcctgggtaacagagtgagaccttgtctcaaaaaataataataattgaactcactcactgaatatttgcacagcacctgattctttctgaagtcctctttgtatatttcatatcctttgggctcataaatgtcatcattgtagcgaatattgggggtccactgtgaatgcttctactcctcagtcccttcagtgaccctgtgaggtgggttgtatcattatccccattgtacagatggggaagctgaggcacagatctaagatcacagagatcactagtaagtgccaaagtcttgaaccccgggcattttgcccccagagctaggctcctccccctgctctagaccctctcagtgaagatggtggccctcatcagaggtgagtaggacaggtccctgtccttgggcacgttttattgcagctggctatgacgcacaaggtggggagggcgggggctcggttcccacaaaacactggcacagagataccaccctggcctctgggcactgcttctcctctgactgaagtggagagaaacctgaaccaggcccacctagcctgtgtggacccagacctgctgaagattctgagcccatgtctgaccccccggcaccccctggatggagcagcgcttgctgtacccactgtggtgtcccgggactgtgggctcctcgaggggtcctgcctcagtcttggagccaccgagaggagcatggcacagtttagcgaccactaaagtcacacagctcagagatggcatggcggctggtgtctgctctcagcttccttttaggaaaaacaaggagcctctcacagcccttttcttctctcccagagtccctggagtcctgttcctcaatgcaggatgtcagaaagtcccagggcacttggcagtgagggttcctggccacccgaagacctaccaaatgggagtatgcgggcccaggcccctctgctttaaacatgcctgcagtgactccggggcccactgaggtttgggaattgctcccctctaggccgcgtgagcagcccgtagcagactgagggccatgatgtgcagtggcctgcgggggtttcatgtccagggtccccggtcaaggctagcaggtcatgaatgctgacaggcagcaagggctgactgtgagctctggagcccccagatacagaggtgtttctcatctggagcaagcgcctgctctgaatcaggcccctgccccgtgagacgcagctgctccctggtctgtgcagagcctctgattctggcctactgtcaccatcaccaggtgaccaggagatcccggcgggatctgcagacatggacacactgccacacatagctgcctgcctggggcctgctgtccaccctctcaggcccactgttcccctctaggcggggtcaggaatgaaagctaccccacggggacaggtaaagaccggagatgcctctgagaaagtgtttggtaacagtaagcctcgaaacggcatctctgtcctccacctttcacagtctctgggtcagacgccccattcctctcagtggtcccgccgactgaggcaggacccctcaagaagcacacagtcctgggacatccgagccaccatggcatgctgcccagtctggggtcagacgtgggctcagagccttcaggagggagcagcgagttccctgtgggggccacatgagctgggcgggcccgaatcttgcttctcctcagttcagcgagagcaaggtgtggggacatgctagatagggcaatgctgagatttttagtgtgggttgaaggggatgtttccagaaacgggctctctgaaggctgggattgggtagtgacctgctcactctccgtcctgcaccccctctcatacacgtgtggactcacggcctggccctgctccttgcccgcctgagatgggtggtccagagggggtctcagacatgggtcacacaggcacacaaagtcctctttggggctggagagcttggaagatttggcattcgggctcaaggatctcagctggggagctgaggtctgaagggtgaaggaaacatgggccagggagagagtgtcagacagcgggagcaggtgccaaggctcagggcaggtggcagcaaggcttcaaggagtgagggaaggccggatgggctggagcagattgcaccaggagggcaggaaatgaggcgggagaggggccttggaggccacatggaggacgccggccttgatcccagcaggagtgggaggctgcggaggcctttgcagagatatcatcaggactcccgagaactccctgcacattacctggagtgtccttttcaggcatcagatctgtatgacttcaaaattagtttctccatgttgtcagagtttacactctgctgccgggaagttgcatcacatccgtgtcagcagcaaagtttcactcaaagccattttctttctttcttttgtattttattttattttattattttatttatttttaaaaatagagacagggatttcactatgtagcccaggttggtctggaactcctgggctcaagcaatcctcccgcctcagcctcccaaagtgctgggattgtaggcaggagccacttacgctcagcttcaaagctgttttcattctgaccgacatggtcagtgtccccagccccatgggagcctgtctgggctctgggaccctggtctcaactgtgtcctggccatctccacttgtatgtcctgggggtaactggcttctgcctggagcccctcttgtgccttttttcctctttaagagagaggtgtggtatagagcctcccggtgagtggagcctgggccccacccgacccatgctctgtgcaggtcccggagctggacagtgtggcagcctgagacccccttgcccttccctgtgtgtgttcagaggtgctcggcgcccgctggcttctgtgtggtgctgggcatttctgctgtggagcacgcctagccttggtgggtgccccctccgcagtcccgcctccccactgtctccacggcactgtcctccatgacgggctcagctggctgcctggtgtctgtgggatccaggctgaaacgtggagggaaagcaaacaggtagagaaatagaaagagggtgaggctgaacacgttttgctgttacacatcatccccccccacctttttttttgctatttatttctcaatattttttctgcatgttattttacatacaacattgcatattgattcttttccatggaatgtaccaaacattttccatttcattataaccatccagactcttcaaatgtatttataaatagtggccacagggaactacctggtgcctgaagctttcccacataccagattccggccagcggaggcatctcatgccctgtgaatgctgctctctccttatttctcctgaaaaatggaaatggtttggaccagctgctggcggagtctgggaggagcgaggccgggcagaatgatgagtttgacttcatccctttccagaagaggggaaggcgggaggatgccccatccaccttccagaaggcggttccttgcagtcaccctcccctagtgctgggttctctgcttctccatttgtcagagatgagttggcctccccctggttccccgtgtccctgccacccccacaatcgctgaccgtgacttccttttgtccctggcagaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattcagatttaaccctgaaaagcaggaggggtcaccctggccactcctggccaggagccatctgatgccgatgcctgcgctgagtggacagtcagtttccaccacgtctggaggcgtgaatcccagctgggcgaggaacctggctgccccgctcccagaagtcagggaacagtgagggaaggggcccatggtgctggccttcttgggcagcggctgtccttctccagcgtggctcctgctcaccgtgaggcagtgcttgtgtgggtccaaggacagattgcagttttggttgctctgatcgaaaccacggtagggcttgagagagaatcccctgaagaggagaggctgtgggctctgcctgaccttggtgaacccagggtgggctcttgggcacacggctgtggcagacacttggcttccatagcccacggcgagcttgggcaccccgggattcttgaaaatgccgatggtgacagtgtctgccagaaacagacatttttctattaaaagtgctttttaaaaagcttctccaccttcaccaccacagtggacccaatgctgggctgtacaactgtgttttcatgagggctcattcagaataagtaagacggcttgcaagttatgttcttttaaaatctacattgaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcacctgtagtcccagctactcaaaaggctgaggcaggagaatggcatgaaccccggggggcggagcctgcagtgagccgagatcgcgccactgcactccaacctgggcgacagcgaggctccgtctcaaaaaaaaataaaaaataaaaaataaaatataaaataaaataaaataaaatctacattgagaccgggcgcagtggctcatgcctgtaatcccagtactttgggaggccaaggcaggtggatcacctgaggtgaggagttcgagaccagcctggtcaacatggtgaaaccctgtctctactaaaaatacaaaaaatttgccgggcatggtggtgggtgcctataatcctacctactcgggaggctgaggcagaattgcttgaacctgagaggcagatgttgcgttgagccgagatctcgccactgcactccagcctgggcaccaagagtaaaactccatctcacagaaaaaaaaaaaaaagaaattccaaatgtcagttttagggtccacccaaagatgttgattattaataacttaaattatttaatttgttttattttttccctctgaatacccactttgttatttcaaacagaagaacgttgatgaggaaagtcactgtcttttagccacgaaaatgttgttcttgggggatatttaagcaagggatgcatgagaattatcaggcttctacaaagaaacagacccaattgtgtcaatatctagagagaggtttattatgatattggctcacttgactacggaggctgagaagtcccccgacctgccatctgcaagctagaaagctggagggccagtggtagagatgccagcctgcgtctgcagccctgagtaccgggaacagggtgggagaagatccaggtgctggcactagcagtccccggcagagagaggtgaatcccaacttcctccacctttttgttctatgggatcagatgaggcccacccgctttggggagggctgtctgctttactctatccaccaattcaaatgctcatctcctctgaacaccattccagacacacccagaaacaatgtttcattggctatctgggcaccccagagcccaggcaagttgacacagaagatgaaccatcccatgcacctttctaaagatttttttctttgatttttgagcaatgcttgagagttcacaaactccattcacaggattatctccttgaaacaacaccctggggagctgtgtcattcttgcttccatgtggagactcagagagaggtgaaggggctgggcgccatggctcacacctgaaatcccagcgccctgggaggccaaggttggggggaatcacttgagcccaggagttcaagaccagcctgggcaacatggtgaaaccctgtctctaccaaaaaaaaaaaaattaactgggtgtggtgggaggcacctgtaatcctagctatgcaggaggctgaggtgggaggattgcttgagccccggaggtcaagggtgcaatgagctaagattatgcctgtgaatagccactgcactctagcctgggtgacagagcaagaccctgtctcaaaaaaaaagacaggtttaagtaactccccacccccaggtgctggggttagtgatgtgtctgggcttgaatggctctgtccatttggtgctgtgttcactgagccaagttgagtgcgtgtggggtcctgtgctgggccctgggattcggggatggataagtgacttccctgctatgcaggatttgatttatgttcctcctggatgtctgcagtgccacccacccctgcctttgctgctttgctgccaaagacccccaggctgttttggccttggtggggcgagggctggctgctgcatgtcttccaggtttcagattgagaagaaggccacattgaggggcatggggtggactgatgggaaagctaattagcatcctttggggcaaagtacaactatggggcaaaatacaactaagaacaggaaggagctgaggaataaatgcctctccccgacttccctgatgtgggcttctgagaccatggctcatggagatgggctgcatggctgatcatcagctgggttttcttctgaagccatagccagctcatgcacctgcctcacctcccttcccctccctgttgctcgtctagggtgccctcccctcacccccaaacccctgccaaagaaaaggcatcagcagtgagctttgtcctggctctgtttttcagggaacctgggccagaatcatggtccccaaagatgaccatgtgataatccctggagccattgactatcatcttacatggcaaagggacatggtgggtgtagttagtgaccttgcaatgaggaggtcatcctggatgatccaggcgggcccagtgtgttcgctagtgtctgtataagagggacatggggagctttgactgcccatgaacatggcagcttgaccctggaggcaaggtggtagcttctggctctgaagatggaagaaggggccatgcactaatggatgcaggcggcctctgcctctagaagtggaaaagacaaagaaatggattctccactagagaacccagaaggaaccctggagcctccagaaggaaccagccctgctgacacctggattttagcccagtggaacagattttggactttgacctctaggactgcaagagaatccactgagccgttggaagcccctgggtttgtgttaatttgttacagtagccacaagcaactaacaccatcctgttctccaggctgctgcctccagctgcagctggcgtgccctggccactggggccaggcagggtgggttttgatacctgcagcggcagcatccttggccatttcctggaagggccagttgccagacactgagatgcctgttactgcaactgtcccaccagcctggagcacgtgtttctggagacaggcaaattctggaaggctccacctgctctcagactgcaggttgcgtctcaaagcaggctggcagacattttccactcttgatcaatcattttccaaaataagcatagacacagcaacccggagagcagcttcggtttggctgtcggtggcgtgttagttactgtagtggtggcacagaggcgatatacgttaaatattagttctcactgactatagccttttaaacagagcagcgtgtgggtggcagcaggtgagttggctatactgagcttgggctgcccttggttgattcttgtttgtcaggcatgcagggggctctctgtgcgtccaggcatattccctgtctggatttgcttgtgttcatggattttcagcacctcctttcttctggtttgggaatgagtcaggtcctcactacacaaggccagagcagtatgcgtgtgtgggtaggggtgagcaggtgtcattccctgcctcccctcctccttcactgccccagccaccctgaccaccttgctgttctgaggacacactgagccagtgcccactgggcatcaggtgaaaggggacatcccacaagcccaccctcacttctgacaccaatggcaagttcaggatctccaacactgccctgaggtttggtcatttgctagagggactcccagaacccacttaaagctgtcaccctcacagttacagtttctgatggtgaagggatacacatgaaaatcagccgagggaagagttgcccagggcagagttgaacgcacccacacagcacctccattgtcctttcaccatggggtcataggcagcgttactctcccggtgatgtgggacaatgcgcatgcagtattgccagccggggaggtcatctgagcctccgtgtccagagtttctgctggagctcacttgcatgggtgtggctgactgtccacatggctcatctgtctccagcccctccagcagctggctgatagagtgcaacccaaagccccctccctgaatgacatagttactccctggctggcccgagggccccaggtaagcagaggtactttatctggcagggcatttcggagcttaggagatcacctcccaggggctgaggtcacaggcccaacctctctgtgggcaaggttaggttcattatcacgtacctggtctttggactttcaaaggcccatgcctggagctgtcttcaacacttctttcagttttctctcaatgcttcctccttggagacgtatttcctgcccctgtcactccatcactctcctcctaaccccagttactttttctttgctgggcttgctgctgcctggagtcatttcctatttactagtttgtttttggtctttctcctcccctagaatgtaatcttatgctgtgagggaccatgaccattctcttcccagctaaatccccagggctggagttgtgctgcacatgcagagctaattcatccttgatagatagtaagagaaccgatgggggtctgtgtcagcagcaccaacatgaggttcacaccagcgtctcccaagatggcatgcggcttagagacaagacagatgtggttgctttttgttgttgttgttttgtgttgttgttttgagatagggtcttactctatcactctatcacccaggctggagtgcagtggcatgatctcagcttactgcaacctctgcctcccaggctcaagtgagtctcctgcctcagcctcccaagtaaatgggattataggtatgcaccatgatgcccggctaattttttgtatttttagtagagagggggcttcaccatgttggccaggctggtctcaaactcctgacctcaagtgatctgcctgtcttggcctcccaaagagctgggcttacaggcgtgagccattgcatgcccagccagatgtgtttttttttttttttttttttttttttgctctaccccaaacctgtgagatggcagggaggaggctctgggaagagggggtgagggttggggtaaacctgtggattggatgctgatgtaggtggtcccaggtgctcccttgggaggagatggacagtccggatggtgcagacaaaacacctccatccacattacctgcgtaattctctttgctttccagaacatcctttgtgtactgtggactgtgatgatctaatgctagtggattacatctaagtaggccttagtagaagccacctcccagtggttcctcggaggcatttggtccagaagcagatgattttagtgcaaagcacagaccgtatgcaggcctgagcagatcaggggacagacagatctggctgacatcctgatccgctggctgtggtggtgtggccattgcttgtagccacattgcagtcttgaatgtcccccttggaaatgggggacatttccaaggatgcctgcctggtcctctagttttctctttctctgttctctgtcatctgcacttttttcctcttgtcttgattgcttgtcctgtctcccctagtagacaccccctctgacctctgctgcctcaggactgttgctgtataaaatattgtgagatgccctctgctcctgtttaaaaaaaaaaaaaatccttagctctgggtaagctaggcactgagaatgaggccagtcattcaaaacttgtctctgagcattgattatactcatgtattatactgttaaggggtgaaggtcggctctagggtcagcttcctggatttaaatcccaactcagattaaagtgggagaataatagcaccaacgtgacaacctcaaagtgtcatttgtaaggataatgttagatcatacacttgatcacccgttagcagtgtaagggcagtgtgggaacatgagcatgaacagggcagcccagaagggagttgaatggacagatgggcaatgccagtttggaagtgggtgcatgcatccggtgggttcaggagcctggaagacttatccaaaagtcatctttgctggtgtttcttcctgtgtattttctctaaccttctccagcagtgacctgaattacttatgggtgaacactgaatgctgcccaggcaactagaggtttatagatgagatactttaaatttttaatgattcttaaaagagggagtggctattcttatgctttccagaatgaatagccaagggaaacctgtacagttgccatataaggagaaacctagacctggccttagcctctaggtcctggtgcagattcttagcacgtagcgcctaaaacctttgcgatttcctgagtgataggagcgtcttttgttattcataatgagatctgggtttatgctaacgaggtgactcagggtgggggctggccccagagtaaccaacacaggattagagggttgggtctatcagtcctacccacccccagcctctgggtggggtggagaggggctggagagtgaatcaaatcaccaatagccaatgatgtaatcagtcacacttacataatgaatcctccgcaaaacccatcaacagtggggttcagagagctttggcgctgggaaacacacatggaggtgctggagggggacacgcagggagagggcatggaagccccgcctccctccccgaaaactctgtcctgtgcagtgtttcttattaattacactgtccctgagttctttttttttttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaaaaaacacagaaaactccctaagcagattggttgaaagcaggctgactgcatgtcatctgggggtgcgtctccccccaagagcaggtttcacatctcattccccggttgattggacaagacccttcctgtctttaagttctgttttcttcctccctttgtctctccgaagaaaatcagctgcatgaaaacgatcctctgggcagaaattggtgctgttggagccgcacagaggtgccctcccgtgccccctggcccccaccgggccgtgtctcctcctgcctgttgcaatcagccctcgtccgactctttttggaagtgattaaaacataactgtcatagctctgggggagacaggctgcagatcctgattataattcagaaggatctaaagaaaaagtaattttttaaaaaaattctggttaaagccaaagctcataagacgtgtgtgatggagtggtatgcaagagcacaattaatgtatgtcctagacatctgcccacaggattcagggctggcaaatgagtgcgtccctaaaaataatgactagtgctatctttaaaaagtcttttgtggcatagcagattaagatggatggcctgggaagtacagtggcagcgtgtgctgtggtatccaggaataagttgtacctcctcggggtggcagtggaactgggccgtgaacagcttttgcttcccagagaggactgccatggcctgctgcatggaatttgattttaatctgtttgttatttttgggtttggtcttggactgggtttgaaatccagatgtgacttttttttttcttttttcagttttctttatagcagcaatgttgtatcttgtgtgtttcctaacaagactgagctctgagcaaggcagcctctggaaccaaatgtctgcaggcccaggagacctttctagaaagttcataggtgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaaagttcataggcggttctgcagtttgagccccttctgtgggtctgtgcctgctttagccgcttgagatatggcattgaacaaaacacaggccccgcctgggagaagctgccaggccagctggggagacagacctgataagtgaaaatgagatcgcgtggcctgcatgctccgaagaagactaaggcaggaaacaggactattttctcccgactgaattgtcctggtatccttgttaatatcagttgactgtgacttgagacttatcttggacacccctttctgttccgtgggtctgtgtctgccttgatgtcagtcccacagtttcgacgactggagctttgtagtcaggtgtgaaacagtggagtgtgggtcctccagttttgttcatctttttcagattgttttggcaatccaggagtcctttgaatttacatatgcattttattttattttaattattaatattattattattttttagatggagtcttgctctgttgctggagtgcactggtgcaatctcggctcactgcaacctctgcctcccaggttccagagattctcctgcctcagcctctcgagtagctggaattacaggcatgcaccaccatgcccagctaatttttgtattttcagtagagacagggtttcaccatgttggccaggctggtctcaatctcctgaccttaagtgatccaccagcctcggcctcccagagtgctgggattacaggcgtgagccattgcgcccggcctatatatgcatttaagacctgcttgtcaagttctttagaagccatctggatagtgattaatttgtaaaaatgatacttattatctttttgaactgccaaagtaatatatgctgctgaaaacctggaagacagaaaaatccaatagaaggcagggctaattttttttttttttccatgtatgtcccttcaggcttctctgtgtttttcatttttcctacacaaatttggaatcattccagagctagtaagcatctagggccacatttggactagtaccttgggataaattagagctggaattgccgggtcatatagtgtgcacagggctagggactgacttattttcctttctgaatgaagactctgaggtctagagaggttaaatgagtgactcaaggtcacacagctaaaactctggtggagctgggtcttaatgcagaccctacatattcatgccatgctgtatttatacaggcatgtacaccagcgggtcgggattttagggggtgttttaaaattctgcctgcaaaacctttttttttttttttttttttttttttttttttttgagacagggtcttgctctgttgcccaggctggagtgcagtgtcaccatcacagctcactgcagcttcctcccaggctcaagcaatcctcctgcctcagacccctgagtagctgggactacaggtgtgcactgccccacctggctaatttttaattttttttgtagagatggggtctcattttgttgcccagggtagtctcaaactcctgggctcaaacactcatcctgcatcagcctcccaaagtgctaggattgcaggtgtgagccgctgccccaggcaaacccattttaaagccatgagccaaaaattataaaagacatgcaaaatattatgagtagtcacttatctagtatttgcggcatctctcaggcttggggctttgctgggagctctgagggggtggaagaggctctgtcactggccttacctggctgtcaagggctgagtgtttggtggagggaagacgtctgcagcctgggaggctgcgggtcagaaggaggtcagccggggagctgggaggatcgtggggaacccgtggtggaaatcagcatggcgagagagtggaagcaggcagaggagggctttgaagaccaaaaagggtagttaggattgctgctctgtgtgtctgtaaacttggtgttgtctctcgaatttaaatgacatgctttgaaaacaaaaaaacaaacaaaaaccaaacccataaaatctcactaagtggccagagcaagttcccggggggtggcgcatagatgcagcggtctgggttctgtggctgggggagttggcttggggtccgtggctgggtcagtcttcaagagccaccctgggtggcactccaggtctcttggtctggggggaataccctgaccccagcggtttcacggcctcctccccactcagcctgggggagagtccagggtcggccctgtccccctccccccactcctgtcactatcagtcccctgtgctcagcttactggcagggttcctcctggctgtcccctctgcctccagcgctctttcctcaggtgtccacgcagctcgtcctcacccttttctgtctctgctcagatgccgcctgaggctcccaaaacagggtctcactctgtcacccagggtggagtgcagtggtgcaatcacagctcactgcatccttgacctcccaggctcaagcgatcctcctgccagcgagcttgttacaattcctgcaccaacacggatacattgttactaactaaggccctacaccagcaaagatacattgttactaagtaaggccctgcaccaacacagatacattgttactaagtaaggccctgcaccaacacagatacattgttactaactaaggccctgcaccaacacagatacgttgttactaagtaaggccctgcaccaacacagatacgttgttactaaataaggccctgtaccaacacagatacattgttactaactaaggccctgcaccaacacagatacgttgttactaagtaaggccctgcaccaacacagatacattgttactaactaaggccctgcaccagcacagatacattgttactaaggccctacaccagcacagatacattgttactaaggccctgcaccaacacagatacgttgttactaagtaaggccctgcaccaacacagatacattgttactaagtaaggccctgcaccagcacagatacattgttactaaggccctacaccagcacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaactaaggccctgcaccaacacagatacgttgttactaagtaaggccctgcaccaacacagatacattgttactaaataaggccctgtaccaacacagatacattgttactaactaaggccctgcaccaacacagatacgttgttactaagtaaggccctgtaccaacacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaagtaaggccctgcaccaacacagatacattgttactaactaaggccctgcaccaacacaaatacgttcttactaagtaaggccctgcaccaacacagatacattgttactaactaaggccctgtaccaacacagatacgttgttactaagtaaggccctgcaccaacacagatacattgttactaaggccctgcaccaacacagatacattgttactaagtaaggccctgcaccaacacagatacattgttactaactaaggccctgcaccagcacagatatattgttactaaggccctgcaccaacacagatacattgttactaactaaggccctgcaccaacacagatatgttgttactaaggccctgcaccaacacagatacattgttactaagtaaggccctgcaccaacacagatacattgttactaactaaggccctgcaccaacacagatacgttgttactaagtatggccctgcaccaacacagatacattgttactaaggccctgcaccaacacagatacattgttactaagtaaggccctgcaccaacacagatacattgttactaactaaggccctgcaccaacacagatacattgttactaaggccctacaccagaatggatacattgtacattgttactaaagccttgcaccaacatggacacatcattactaactaaggccctgcaccaacacagatacattgttactaaggccctgcaccaacacagatacattgttactaagtaaggccctgcaccaacacagatacattgttactaactaaggccctgcaccagcacagatatattgttactaaggccctgtaccaacacagatacattgttactaactaaggccctgcaccaacacagatatgttgttactaaggccctgcaccaacacagatacattgttactaaggccctgcaccaacacagatacattgttactaagtaaggccctgcaccaacacagatacgttgttactaactaaggccctgcaccaacacagatacgttgttactaagtaaggccctgcaccaacacagatacattgttactaaggccctgcaccaacacagatacattgttactaagtaaggccctgcaccaacacagatgcattgttactaactaaggccctgtaccaacacagatacattgttactagctaaggccctgcaccaacacagatacattgttactaagtaaggccctgtaccaacacagatatattgttactaactaaggccctgcaccaacacagatacgttgttactaagtaaggccctgcaccaacacagatacattgttactaaggccctgcaccaacacagatacattgttactaagtaaggccctgcaccaacacagatacattgttactaactaaggccctgcaccagaacggatacattgttactaagtaaggccctgcaccaacacagatacactgttactaactaaggccctgtaccaacacagatactttgttactaagtaaggccctgcaccaacacagatacattgttactaactaaggccctacaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttagtaactaaggccctgcaccaacacagatacattgttactaaggccctacaccagaatggatacattgtacattgttactaaagccttgcaccaacatggacacatcattactaactaaggccctgcaccaacacagatacattgttactaagtaaggccctgcaccaacacagatacattgttactaagtaaggccctgcaccaacacggatacatcccattactaactatggaggtgctttattcagatatcctcagtgtcacctgttctcctttggccgtctcagggttcctcccaggacaccacattgcattcagtcctgaggcttctctgggctctgacagtttctcagactttccttgtttctgttgaccttgacagttttgaggattactgctcagagagtttgtagactgtccctctgttggggtttgtctgatgctttcttcatgattcgatcaggttgtcactttggggaggaagtctgtgaggtcaagtgccattttcatcgcatatcggggcacacccatctgcacaccttcgctattggcgtcggtcgtcatcacctgtgcaggcgtgctcacccggtttctccactggatccagctttattttcctttctatcaaccatcacaacctgaaactgtgggcgtccgtgtgtctcttggagtctagtagaatgtaaggccctcaaggcagaggcctcgtctgtcctgtttgtcaccagagcctggtccgcagtggtgcctagtaagttagtccacccattcaccacatccttacagagctctggcgccaggcagcaagtgctggtgctgcggacagagccacagacaagccggtcatagcttctggcctcatagaccttggagtctaacaggggagagcctttcaaagatttgctcccattgctaatgggacaggatgagacagggtgctgggggactgagagctgtgatgggggatgctgcctggagggctggggtggtctgagctctggaggaggaagtgctgctcaggtagtgagggagggggtggtatctgggttaggggaagtggcgtgtgcagaggccccgtggcgcagatgagcttgggctatttgaagaaccccagcgaggaggcagggtgttcaggtggctgtggctgtggcccaggggcaagagggagatggggaggagtggaactggttaagaagtggacagaagtagggtgagaaggcaaagtccaggatctgagacaggaggatggtggccttcctgcctcccttccttcctgccttccctggaaaggagcacgcctggggtgtggtgagtcctgttagagatgctcacggaaccccctctccccaccccgccccgtggcaggggcatggagaggcgggccctgtgcttagggggtcctgggttagggacggcgctggaagttgcaggagggcagaaaccggcctctgaagagagtggggagggagaaggggagctgtccagggccctcaggcatgcatcatgtaagggtcaggggagtcagggaggatcccccaaaggaggctgtagagggtgaaggaggagggcaggaagccagtgagtgtgggggtctgtgggccatggggggtgggggaggcagctctttgggaactgagggggttcgggtgcagccctgggactcccaggccagtgctctccctccccctgccagccacctcgcagagagagcccggggtggaagcagggtagttggtgctgtgccctgaccttcagaggtggcattgacaagaccagaatgccacagggccatgcacctctccctgcaaactgccctttaatttatttttacctctgttccttgtgggcttgtgtgtcaggttcgatatttttatgttactgggaaaatagaatgtgcttcacagaaatttgccttgtggccaatattgcaggttgcagctgtttcagagtgacaggggacggtatattctggacttgtgcccttttgttcatctctgagaggggccataaactcccatttccgagaggttactgggaccaatgagatcatttattagttttccttgcacaggaaaatcacacactctgtgccattgattgagtccattttattttgtggaatagacatgtcagaagcaggattggccaggtggaattgtgtttggcgggagtcctgtctttccataggtactttcataatggaagcaatctccttctgaagtgtatcacccggtgaactgaatggaaaatctcttgtgaaaaggcttaagaggaaggctggcctggaaaaatgaaactcacatccacagagagacttgtacctgaatgttcatgtcagcaccactcacaatacctaaaaaggggtgataaccgaaataaccatcaaccaagggatggagaaacaaaatgtggtcccccatgagatggaatatgattcagcgtaggcacgaaagaaggacggaaacatgctataacatggatgaaccttgaaaacatgctcagtgaaagaagccacacatgaaagggcagacatcatcggctcctattaatatgaaatgtccagaaagccaaatccgtggagaggggaagtagatcgaatcacacacttttaaaggatgaattgtgtggagtgagaattctatctcaataagggtgcatacaaaatgcagctgacggtggtcacaccaagcctgtcagtaatgatgcataacttccctttgctgtcctgggttagggtgggttgagacttagggtgaccagggaggaatggatatcttgtgggtcaccttgactgtcttggggtgatgagagggcagtattaccaatgcttaatcatttgcccccataccaaggtgaacacgagatgctctggtcctagtggctgcagagttgtgcagcctctgtccctgtgctagctctggacctggtggtggccgcagagctgtgtagcctctgtctctgtgcttgctctggtcctggtggccacagagctgtacagcctctgtccctccgcttgctctggttctggcggctgcagtgctgtgcagcccctgtctctgtgcttgccctgtccttgtggtggctgcagagctgtgcagcctggccccagagctgtgcagcctctgtccctgtacttgctgtggtcccggtggtggctgcagagctgtgcagtctctgtttctgcactttccctggtcactgcctcattgccgtggcgctggtggactgaggccataatgcctgcgtctcctgcaggtcctcctcgactggattaatgacgtgctggtggaggagaggatcattgtgaagcagctggaggaagacctgtatgacggccaggtgctgcagaagctcttgggtgagttcacagcagggacagctctgtcccacccccatctccctgcagcggccctgggctgggccaggattctctgcatagtgacatcggccacaggtcctaggaagacactcaaagctgcagtgtgcatctcccaggtggtgcccaggccctgggctgtggcttcagggtcctctctccccttgccgtttctacagagcacccagccatggggcagcagcaggttggggacagcttccaaaactgcctgcggctcccatcctgttgggtctcaggcccactttgtgtccctgccaccctcttttgacttgaactccttcggttcaggatgggaggcagcaggagggaagcgggtctgcagcaatattctgtgagtgaatgtgtcaccaaatacatgatagctcatgttccctcaccaggggcgggctctagtgtctgcatttgctgggtgaaggcagtttagtgatcttcccgggactgactgatgcatggtttgatgtgcagacaaaccggttgtttattcatcagatgttggatgagtcccgagggctgggtaccagggatacggtgatctttgaaacagacgtggtccctgtcctcagaacttacagtctgtctgaaaagacaaatatttttgaatggttacagttactgttcagattgcttgtgatgagggccttcggagatgccgcaggttctgagtagaggacgccggcctggcctgggggtggggcggccttgcagctcatatggaagaacgagcgaagagttgccaggcaaagaacggaagagcagagttcgcagatgatgcatgagaggaattcttggacttgtagtgggttctcacgatgcctggcactgtcatgtctcattgtcacaatggtcctagggggcagtactgccatcgccttcgacaggtggggacgttggggcccacagtctcctggtgaacagccgggcagcctggccccaagcatagctcttgagcccggccgcggggcctttctctgacctgtctacggagcagccccaggtacagggcctgggtcaggcgctcctgcatgatcacagctggttctcacaacagccctgggggtctggctgaatgagcagatgtccctggttgtccccacgatgccttttgtttggatccaggagtgaatcacacatgaacgtttgtctcttcttttaggcttctttcatctggaaccgccttccctttccctctctccgttctgttctgtctttctgtcttttatgacgttttggaagggtctgggcctcttgtcttgtagaatatcctcccatcgggatctgtctgtctcctcacgatgagatctgggtcacatgtttctgctgagagtgtgactgcgctgcctgcttgtcctcctgggggcatcgtatcaggaggagcacacaatgtcaggctgcctgtcattggtggtgctgacagtttgatcactgggttaaggcagtggcctatgggtttctccattgtaaaggtgcttctttcctgttaaaaaaaccacttttttatttgttctattttggtagagtcaggatctcactcagttgcccaggctggagtgtagtggggtgaacatagctcactgcaccctcaaactcctgggctccagtgatcctcacaccttggcctctagagtagctaggactacagatgtgtaccaccacacttggctgttttttttttttctttttttgaaatggagtcttgctctgtcacccaggctggagtgcagtggtgcgatctcagctcactgcaacctccgactccctagttcaagtgattctcctgccttagcctcctgagtagctggggttacaggcacataccaccatgcccaggtaatttttgttttttagtagagatggagtttcaccatgttggccaggatggtcttgatctcctgacctcatgatccacccacctcagcctcccaaagtgctgggattacaggtgtgagccactgtgcctgactggctaattgttttgtattaaatttttaaatttcatttttttgtgttagagacagggtccttgctttgttgcccaggcctgttttgtactggcctgaagcaattctctcatgttggcctcccaaagtgttgggactacaggtgtgagctaccatgctcagcccttctttcctttttaatacatggtctctagaggggcagactctgggactttgtgaacgtcctgttcacccatgatgcgctccccatgattttatcatccgctgattatcattctctaaattatgctaaatatcatctctaaatattatgctggaggttgcaaaatagtgatttctgtatctttatcatggcttccccacttattagctggcattttcttctgtaaataagtgcttttcttctcctgtgtccttttttaaaaaaaaaaaatcccctaaaatagaataacacattcccctggactgatgaattattttatgttcaaaagagaatggtaattagatagcaaaatctgggccttatgggtgcttgtggctcctggggtgtcattgcttctagtctctttaagccaaaagaggtagcaaatatatagttttttaaaaattgtgagttcacactgctacttctaattccagttcaatgctacaagtttatcccttaactgtcagcattcagtattccagtctccagggagaaccttggttccagaaatatatttgctatttactctgattgcatacaaaaatagtgtcagaattacaataccaatacctctatcaactacaaacatgctaggtacaagatttctttgccattattttttaagtacaatatatccactaagagtatatagtcagaattctgtgttcagaacttaactgaattattttctttttgagtggtcatgtcatccatttaatgtataaataaattaatttgtttctctctgtatttagtttttgtgtatatgtttacatttaattttatttaatattacttttaaaaatgtaaagcatttacatgcttcaaaagtcaaaactatggaaatgacataccttgaaaggtcttagccaggtgtggtggctcagcctatcatcccagcaccttgaggggctgagccaggaggatcacttgagccgaagagtttgagaccagcctgggcaacatagtgggacctcgtctctacaaattaccagtcgtggtgatgtgcaccgtgcacctgtattcccagctgctcaggaggctgaggcaggaggatcacttgagcctaggaagttgaggctgcagtgagccatgattgtaccactacattccagcctaggcaacagagtgagaccctgtcgatcaagagagagagagagagagagagagagagagacagagagacagagagagagagagagagagagagacacagagacagagagagagagagagagagagagagagagagagagagagagagagaggtctcactgctttctctcccacgtatacactcccaggtaacaattttcaatggattctgattttatccttcttatgtttctttacaaaaatgtccatatacacacctactcatttcccttttattccttgcataaaaggtgatgtattttgtacattcttttacacaccctgcttgtttcgcttaatatgttctaggaatccttgcatgtggagatcacctttctttttctttatggctgcattgtactccactgtgtggatgttccttcgtttattcacccagtctcctatgtggggcatttttgtcatttctaatatttttctatcaccagtaatattgtgggaatatcctcgtgcagatgttacagaaactagaattgttgacctcaagtgtaatgggttgcttccttgagctgaccactgtagaggaaggaattctcaaattctgagaggcttcacctctctcacctctggccttcccaggtctgttgtgccttggttgatctttcctgtagccactttctgtcttccctggactgttcagtgtgcagacatgatgtaatatttccattaaaaaatggctcccttgctcctgcaacactccaatttctctgcatcactcaaatgtattgaccattagatttggcaccggatgggtcattggtggcccagatgagagcagttttggcgcagtggtgggggtaacacgctgatcggggagggtccaggggcagagaactgtgcctttgaggtacataattttgagagggagagagaggaagggagtgaacctgtggttgctgcagctgcttttcttttcaagacagggtctcactccattggctggcctggagtgtgggggtacaatcatggctcactgcagcttccacttcctgggctcaggtgattctcccaccttagccgcccgagtagctgagagtacaggtgcatgccaccatgcatgacttattttttgtattttttatagatacgaggctttgccatgttgcccaggctgatcttgaactcctgggctcaagcaatccacccacctcagcctcccaaagtgtggggtttacaggcatgagccactgcgcctggccaatacgaggctttgccatgttgcccaggctggtcttgaactcctgggctcaaacaatccacccacctcgggctcccaaagtgtggggtttataggcatgagccactgcgcctggccatagtagctccttttcatgtctgtccactgggaaccatgcaagctgcctgctgaaattacgtggatggagcccctggcacagtgcctggcacaggtctgtcgtcaataagcaggagttgttattgctgttgttttttaaacagacaaataaatgccaagagcagaactaaggagtatctggctcgctgctgggtaccccatccaccccaagtcccctgggtgactggcacatgacaaatatttgttgattaagtcaatgaaagaattcctgcagtttcattacctatgaagattgtggggtcctcttgtgggacatgaaagggggacagatagatgagtattgtttggatttttggtcctcagtgccatccacagactccagaagggatcagctatttgctgaacaatctttcagttctcatagagccctgatatgttttcagggtccacaaatgcctgtgacggtggcctcaagaacccagtgtccccttgtaggtgggatagcatacctcttaaaggtcagcatgagattccacccatgtcatccccagcattggtggggtcagcagatcctctctctggggtttcttttctgctcaacctccctgctttgatggactgcacagacaagccccatcttggtggaagggtctccccatgggctgtcctggagggtcactcccacagatatgccccatcctggtggaagggtctccctgggggctgtcctggagggtcagtcccacagacaagccccatcctgtgggagggtctccccgtgggccatcctggagggtcagtcccacagacaagccccatcctggtggaagggtctccccgtgggccgtcctggagggtcactcccacagacaagccccatcctggtggaagggtctccccatgggccatcctggagggtcactccctcagggcagggctggtgactggggtgggatcatgtttttctccgctgttgtgacagaggagtatctgctgcaggggatacgtggactgcggggggactgccacaaggatgtgaatgggtagggggtggggtgctgtttaggagagagagagactaggggagcccctgccagagaaacttggccctgaaaacacaggggtgcagcatctgtagctgcctctggacagagtttgcacactctgcacaaatggctcttacagaccagctcttggagggaaacctcctaggcttgtgacaggtggtggtgagggtggggggatgaggtgctggggaggccatgtcccataactcactctgaaggacacagtgatgcttggaccacattgtttgtccttattcatctggccctcagaaagtatatttggagggaaacatgtctgtgtttgttttggtcacacattcattcattcatctgatgaatgaatgttcattggcttacatgtgtcgggtggctcttggctgtagagacacagtgggaaacaagagagatgagccccgcaccctgcgcctgcccactcccccagcacacattctagcagagtgaagaaagagaagtattatggggtggagtggttcaacctgaaacctagatgatgttttaaaggaatgacaagtgctaggaggaaagtaatagaaggttatggggtacagtggtgggtgggggttggggaaggcaatccagggaagctcctctggggaggcgacatctgagcacatgtctgcacagtgagcttgggaagggcgttctgggctgaggctctaaagcgagaaagagcctgttgtgttggaggagcagtgaaaagaagcggaggcggggcccaggtggcagagagggagggagagagccaagagatgaggctggggccagatctcattcagccctgctagacaacagtctattccaagtgacaggaagccattggaggttttgggtagggctgtgacgtggattgggttagagtttaaaaggtcacttaggcttctgggtgcaggatggatggggaggagagtcaggagttggaactgagagatcagtcaggacaccattgccatggcccaggcatctgatgaagtagctcagcccccagagtggaagggcagacatggggaggtactgtacagttaaactgccataggaaccaagactgatggccaggtttgtggcttgagcaactggtaaatgggaagccgttgggagtagggtgggaggttgggaaggcgggggtctgtgttgtacatgctggggctgagatacctgcccttttggaggtgatgctgagcaggtgagcctggagtccaggctgcagtgtacgtgtgaacccagcagcactgagctgatgtttagcaccgtgggactgcacggcttcacccaaagagggtgttccaaattttatttggctgaatgccgaatgcccaagaattaacatctatatttggctaaggtgagaatccccatcttagaatgagatcccatggtacaagaataagtctgaaatgttcatcaagattgtgtcataattatcacaattttattattaaaaacgttagtggccaaagttttgatgttttgcattgcagtatcagtacagtcacacccagcactgttgggtaccacttgctcttgaggtcttcaaaccagacatttgtgatgctagatgctcactttcaactcagaaggctggaggagcacgtggacctttggctgatgctgtctgaagggatactcctcatgtgaagctgcccctgggctgtcagtttttctctctctgagtggctggttatggtagagacttacctcctctttgatcttggatgtgaagattgggctgttgctggtgatggccctctgttgaagcagtccccccaattggtactttgctccctacctgaagcagatattttctaatattttcagaagcaaacttgagtgttttgttcactttcattttttatttctgattcttttgcctgcacctgtggcttctcccacccaatgacttgaaacagtatgtcagcaagccttgtatctggcagcctggctgtggaactggccctcagaatctcaggacaggctctgaatttgcatctgcatctcagccgtggttgcctgtaaaccatgccagtgccttctatagagcagaattacaggggcatctttaaagctgcatcttcccctctcaaggcacatccttttggttccctcttcagttagtgctagcaaatgcagcacttactccggagttgctgtgattgtccatgagtcctgctatatcagttgtgttatccataaagtataacatgaggcttcctttggctcaagcagcctttttcttgtggagtagctgctgttccatcttgtttgaataatcacataagcacttgagaaggcaattctaaaatctcttgagtgtcaagtggtttgacatattaaaaccactttttttttttgtactgaaaaaaagaacagtggactagaatattcagatagtaacacagcatcagaatgtcttgcctcattttgtgaatgttgttacactgaaatgacataatatactgttgatgtgagatcctcttgatgtgatactactgatgtgatcacctgatccttgagctccaggatgccaggaatgacactgatgtaggcattcagctctttggctttccaaaggcagaagcccaaaccaaataggagattttagctgaataccaaggtcaaagccaacttctgtgcatccgtagtagagaagaggtctgaggactgggtctgggctgtcagccattagtggtcaggaagaggaagttctggcaaaggtcagtcacaagggagggggagccagaggagtgttgcattcaggaagggtaaaggaggtgtttctaggaggtgagaggaggaaagagaacagacttctggtttggccatgtggaaattgcccagagtgaaccagcaggacccctgaggagtccctcttctttttttttttttctcttgagatagtgtctcactctgttgcccaggctggagtgcagtggcgtgatcacagctcactgcagccttgacccctaggcttggatgatcttcccacctcagcttccccgggaagctgggatcacagatgcataccaccatgcccagataatttttgtattttctgtagtgctgaggttttgccatgttgcccaggctagtcttgaactgggctcaaacgatcctcccaccttggcctcccaaagtgcagggatcacagggatgagccactacacccagccgaatccctcttcttgagagaagattctggaagcagctgccgggttctctgccacatgccaggtttctgggggtgtagctcccctgtgtttgcagtgcagccctcaaggtagactgcatatggccagagtgaggtgcccgtgctgtgggagctcctggctgtcgtcctgctggtcactcacgggcacaccctctccttgtgaaggtgaagttcttcatcacatgtgtactcaacccccatgtggccatcactcagggtcacctgctacatgggagaatcctccccagttttctctctttctgtgctaggaagataggggtcctggccacaacagagccctgagctgctcctgcggcccccgccagtgggcacagtgatgtctgatgatgcaagtgatcatgtgccgtattctctgttgcacaggagtcacccaagacccagcctaaggcagcacacaggcatggccagtctctttggtctctgttgcctgctgtttccaccaccaaattcatattttcaagtcctacatgcagggcccacccatgtgacctcattttaccttaactgcctctttaaatacaggcacattgcaaggtatgagagcctcgcccactaggagagatgggtagcctggcagcctcccactgtccctgctaccagccagccctgcaggttgaacctcggaatgtgactgtatttatagagataataataggctgggtgtgatggctcacacctgtaatcccagcacttccggaggctgaggtgggcagatcacttgaggtcaggaattcgagaccagcctgatcaacatggtgaaaccctgcctctactaaaaatacaaaaattacctgggcgtggtggcacatgcctgtaatcccagctactcgggaggctgaggcaggaggatcgcttgaacctgggaggcagaggttgcagtgagctgagatggtgccattgcactccagcctgggtgacgagagtgaaactccatctcaaaaaaataaaaaaattaaaagaggtaatgaaagtaaaatgaggccatacgagtgggtgggccctaattcaatatgtctagggttcctataaaaagaggagattaggacacagacatgcacagagggagaccaagtaaggacacaggaaggagagggcagccatctacaagccaggagaggggcctcagaagggtctaccctgccggtgccttgatcttggacttctggcctccagagctgtgacataaatctccgttgtttaagccgcacggtgtgtggcatgcttcgttgcagcagcccagacaaacgaatccagtgtcctccgctcctctgccgactcctcttcctccaccctgggtgacgtggccatgttcagtctgcggggccggatggtggcaggtgcaacgggggcgcgtcaggcttcccatctccctggtgggcgaggctctcagaccacccagttctgtatgatcctatctctctccttccttctccaagctgccctgctctgccctttccatggttgttgaacacctgtgggacctacttgctctctacttccagggcgcaaattcagacagacagctgtggatgactcagcgaggagctgttagatccagatggagggaaatcagatgaataagcgggaatcgtttccactcccctgcaggatgtgttttgttgggctgctttgttttttctcttgcagtcattgccacccaatcagatgttttttacgggtgtttatctccccactagggacctctgttatctgtgccatatccagcacctaggacagtgcctgtcccatagtaggtgttcagtccctatctgtgagccaacaaacgcatgatcgaaggggtattccgagcccagcaggccttgctctagaattttattatcttgaaagggatgccaaagctgtttgttttctaattgagggaggggaggctgctggggagataacactgaagacatgggggcctccagctaaaatgttttaaacagaactttgtgctgggaaccacttgcaaaacagaaaccccatttgtgactggcctggacttgattgctttcatgatggcatgtcaatgccgcgtcactgacagcagctgtgtattgaaggctctgtgctgagtgcttgcagtcaccctcccagtgaaccatctcacgatgctctgtgacgtcgcttttgttgttttgcagagtggatctatcagtaaacactggagtcttagaatcgaagactagcagggaaactgggggtccttcctgctgtgtggccctgcagcgggcgtggggtggggcgctggtggccggcacctgccagtacctactgctaacaaaagggaaattgaaggaggtgcaggctgggctggagctcagtctcagtaattgaatcttgatgaaatgtgacagttcttgtctgtgctcctccggattgtttcctgttcattcttggtaataaaatcatcgccagttctgtgaatatctaatctaacttcctattgtggcattagaatgtttaagaaacaagaatgggagcctcaggtgtgtggggaggcagaggcagcttttaagaccttttttaaaattatctttatcagtcctctcccttttgggacccacagggacagtcttctcacctcctgactcccactttcattcttcccaggtaacctccttgcctctcaactacatcttattatgttttttccattttgtatgcatagaatgttcccgagtataacacccacagttttatccttaactattcttcccttttcaatctggcgtcattctctaaggaagattagtgacctggaagctcagcgttcatggttcaacatctcaagacgcccccatggccacatggtaacctgccccgcttcggggacctccttgaggctggggtcttggtggttttgagttcctccagtatatctctctccccttcctccctccctccctccctccctccctccctctctctctctctttttttctttcttctctctctctctccttccttccttccttcctttttctttctttctctctctctctctctctctttctgaggcagggtctcactcaggttgcccaggcttgggtgcaatggcatgatcttggcttactgcaacctccacctcccgggttcaagcacttctcctgcctcagcctcccgagtagctgggattacatgtgtgcgccaccacgcctggctaatttttatatttttagtagagacgggatttcaccatatttgccaggctggtctcgaactcctggcctgaagtgattcacccacctcggcctctcaaactgctgggattacaggcatgagccactgcgcctggcccttccagctttttctgaccctcttctcttgtgcttctcattgcagaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactgtgagttccacgccacagggggagggactgtctggagggagcccgtcctctcgacattcgtcatccacatttgtcatccacattcatcatcatcccatctggccttgcatcttaaaattgggttcatctccctgctctgtaagaggtagaacattgcaggggagaagaacaggagaagggttagggagatcctagaaaagggacctggtcaggccacaattctccatcctccccatgctgcagaggagagaggcaatgtttatggatgggtggatcagagggactttgagagagagaagcagccttggggggttcttgttgggactcaaccccaaatactggtggcagcaacacctagtgggctgtttgtctatgaccctggcattatgagatgtgacatcacggtattttcagccaagacatgaacccggcaggtgaaagactaaaccaggagaagctggaaagttctcctcggtcctgcccactccttccccacctccctcccctggaagcagggccatgagggtgtggcttcagggctctctgtgctgggccagaggtctccgtgctttggtgagctgggctctcagtggtaggcaggagaccctggagcctggccttgcacccggtttcttggtatcgagaccttgggcagacccaggctgtctcgtgggtggctgggtccgtgggtggggaatcgggtgccttgtaaactgtaaaaccctgcaggagaagtggtgatgttgaccaaacctgagtccgcatgctgaggaagagagaggacagactcaggcaaggcaggggctaatgtctaatgtccccagagtggcctctgctcttggcagcctacccttgttgggatggttcattgcggagagggagcccttttttagtgccagagataataacgcacatccttgtgatgggtaagtggccgtgacctgctttccatgctcttttcccttctgtgctaattttactatcctgttcctttccctcatcactgcccaatttattgcttttaaaaacattgtgcttctaaaagtggttgcacaagtcaccttaggccaacaggaaaggagacagtgaagctagaagtaaattcaccaggttgctcatcagctctcttgatttgtccacacttcgctccatccttgtctcgctggggtctcatttagatgctgtgtctctgttgccttctgcacgtgggctcaggttcctgtgtaacctgatctaaagcgtctcccttcctccttcctcctgcagcaattcacgggaagaacctggtggccatcctccacctgctggtctctctggccatgcacttcagggcccccatccgccttcctgagcatgtaacggtgcaggtggtggtcgtgcgggtgagtataaccgagtggtcggcctgcctgtaactccgccagagaggcaacatcttcctcctgcagttttcctgccctccccctccttttttccccccaggaggctaccttctatttttcccttttgacaaaatgtgtgtctcaccctggctccgagataaatgattggaacgggaacaatggcattgatttgatgagaggcagaagcagaggcatgagggtgttgaggtttaattttccacatttttgaaaagaacattcatttctctccaaagccaactggttggaattcaatccccttgaatgtgcttattactcattggaggaggttggccccgcgggatgaaacagacacccaaattaaagccgctttgcattcgttggggattattcatcatgccccatcatctctttttttgggttcatttctcttgattcacttggagaaatggaaccagaacccaggtccttctaacagagggtgaagtagagttacctttctcttgctatttcccttacatttattttttattttattttatgttttgtgaaagggtttcactctgttgcccaggctggagtaccatggtgcagtcatggctcactgcagcctcaacctcttgggctcaagcggtcctcccgcctcagcctcccaggtagctaggactacaggcacatgccaccgtgcctggctaatttcaaatttttgtagagacaaggtctcgctatgttgcccaagctggtctcgaagtcctgggctcaagcgatcctcccatctcagcctcccaaaatgctgtgattataggtgggagctgccatgcctggccttatttcccttacatttaagtggacagtcgctgcctagggttcgtgtgtgcagtttccctcagtaaatgtgcaatgagcgcctactattctctaagcactcagcataggctgccgagccactaaaggaggaacacatgcctggcgtctgtgggggtgaccactgcggccagagttgaggtcacgctcggaaccttggatgcctctgtgtttattttactcgagacatccggctccactttcctctggtttttaaacttctcagtcccgtggtctctgtggtcggggaggacctggctgtcactgtgttttccgaacccattctggcccctctgttaccctgggagctcagtcttgaccggacgggaatgctcctctctggcatccggcaagggccacctgccatgtgtccatgtttccttcctaaggaggatgtttgtggctggtggtggtgactcgggacctggggggccattcctatggccccgtgtcttggccactggttcacaggcagccggcctgaaaaggcttccctaggacacattgggatgtggttcccaagcctacctacgtcagctcggggccccaggagccctgtgcaggctcagaaactggagtatttcctttcaggcttgcacttgggtccaagataatctttgcggtttgcagaaagtttgaaccaggcaagcacttgctggtgcttcctgccataacgggttagaggagtgttgtttggccacgaccaaagcagaatgaaacgggagcagggggtcctgtgaaccgggcgcagttactccccagaccttagagccgccttctgtcttctctgcagccccctggcctctgagcttgctcaggggaccccttatctaaccccagatggaatggttggtgtaagggatgtggcatttccagggtggaaggaaggaaggaaagggccttatttactgcctggccacgtggctttgggctgatcacttgcttttgctgagctgcaatgcttttccccataaaaccaagattttactacaaacctgtaaaacatccagcttcatgtctacaatcctagacctgggcccagcacctggtgggtgcctcaggcatgtttgatccttgactaggtgaacacaatgtctggaccttccttggcaggcactcctgagaatcaggataaatgtcacccacactgttgttcaataacaagcaccaaccctgagtattccatggaggtcaaactcaggaaagggatggaagcccagatcttggtggtgtccactgtgggctggcccagcgggaaatgagttcccagtcccttgaggggttcagtggtggttggattagccacccaggctccatctggagctcctgtgacaggcgggctgccacccctaccatcaccactgccatgcccccctcactaccatcattacttttttttttttgagatggagtctcactgtgtcacccaggctggagtgcagtggcacaatctcagctcactgcaacctctgcctcctgggttcaactgattctcctgcctcagcctcccaagtagctgagattacaggcacatgccaccacgcccagctaatttttgtatttttagcagagaccgggtttcaccatgttggccagaatggtctcaatctcttgatctcatgatctgcctgccttggcctcccaaagtgctgggattacagctgtgagccactgtgcccggccatcattgcttttctatacctgccacgctctgggagaagtgtgacatatactgtgtcagtttcctagggcagccataacaaagtaccacaaaccaggtggcttaaaacagcagacatttattctctcgcaattatggaggccagaagtctgaaatcaagatgttgtcagggtaggatgtcctccctcatgtctcctcctctaggggaggggtcttcctgcctcctccagcttctggtggtggctgtcagtccttggtgttcttggcttgtggccacatctctccagtctctgcctctgtcatcacatggcctcctccctctgtctgtttctgtgtctgtttcctcttctaataaggaggtgagccatattggattaaggaggggctcaccataatccatgatgacctcatctgagctagtatctgcaaagacccttatttccaaatgagatcatgttctgaagtttgtggtagatatgaactttgggggaccctcttcagtcccgtgcacacacatgattgcaggggatgttccctgttatttatgttccttccaattgcatgcctcacctctcctggctgcaaagcatagaggatccctttggggaatcctgacctggggtgtttctcctgagacccacacaaatgccaactctcaaggccacgtggagaccagagggtggggaggaggatagggacaggttgtggtcgctgaaaggcaccctgcccagggtcccctgctgtgtactcacccaggcctggcatgcgtgttcaacaccacccctccttctcctgttgctcttttctaagatgatctccggccccgcagcttcgtctgccctgtcagtgcatctttcctcaactctccactgcctgattttgtatgtttattttggggttttcagaaacgggaaggcctgctgcattccagccacatctcggaggagctgaccacaactacagagtaagtggacccctgtcttgcccttccaggccctgctgccccgagtgagtgggaccccaggctgccacttcagccagggacaccagcgcccatggggctgctcccgctccacaccccttctctgtagcatgtgattctcatgctggttcccaccccagctctcctccctctgcacactttcttcagagtttttaacattagaactgagttaccttccacagactttgaattttttcattcctatcttaaaaggtgagctgtaagaacattgcaaagtggggcaggcagagagagttcaggatggttagagagaaccattgtctcagttcatttatccatctacattagccccatcagaggtgggagctacatctttaaaccagaactttcctttgacagacactactaagccatctgttatctcctagagaaagccagagggcaggtgttcagaagtctaaaaggcttcaaatctattgaaaatagcaaatcaaacagtatctgtggtatgtggttttaaggactccttgtgataacctgctaagaatctttagaattcactgcatttgtgcctcttgactaaacctgtttcagatgaaacagaacatttaaaaattgattgtctcagctaatccatcagctaagttcacagagtgattaattactgtgttgtgaattcatggatggtatttcaaaaattggagctgacacaggaaaccactcgtggcttgcaagctctcagggaagatgatgggacagtggagtgcaggctgatgcatgtgcagaggcccatgaagaggcctcccagtctgccccaggcccacgaagggaacagggagagctggaaaaggggaggatgagaatgtggttctttgcccagcacagtgggcctttggcagcagctctgcctattcagcagtaggagaagggctgctcgtggggaactgggattgggctggtgtcttagttgtttattgttgtgtaacaaatcacccccaaagtcaagtggcttaaaacaacatctgtttcatttgctgctcacaattctgtgggtcagcaatttaggctgggctcagctgggcggttgttcagccagtctcgcctggggttgctcatatgatgcagacatctgaaggctggatggaggctggggaggctgagatgggctccccctacctctggtggttggtgttggcctcccctgggtctctttcctcctcacagtgctgggcatcttcccagggtgctctcagggtcctgagagagtgagaatgcagctgcagtccccttgaggccttgtcttggacatccatacctatgtcctcaattctgtgagtcaaagtgagtcacaggtcatcctggatcaaggtgcaggaaacagactctgcctccttgtgcaggaatggcctgtgcacattgttgggtggtgggcatgctgtgataggagttcccctctaggtgagggggtcccatatgaggacagcaaggaggagctgggccccctgccataaaactagaatggtccagagacagagaatgagcaagtgggtgggagaattgtctcagctattcatcagcagtaagtggccccaaggacctgctgcatgccagcctccttgctggatcaacagagacactgagaggtgggctgagtgcagttcttttcctccagggcgacccatcctgctgatgagaaaggatgcatccacagacatgtacagtctaacacaggggcttgtgggaagtgcctcggggccctaagggaatttccaggaggaggggagcaccccaaagtcagggaaggggagatttcagtgaaagccacctcaatcagatatcagatggccctgagcagtgaggaagggagttgggattttctagcctgagtcagtgtccctctgccagccagggtcagggtaaaggagaggctgggtcacctctccaggatgatgccccaggtaggttctcctcagggctggtcatcccatccttgtctcctgttccttcccctccccgtggctgcggaggctctgacggaacatttgaatcattggatgtctgctgaaaaccagcggcccaaagatccacattcagtttcctaaggcagcattgccacctcctatccagtctcagtgttcccctttctctttcaagaggtggctatgaggtcaccccttccaggaagccctcctgtctgccaagcaggagtgcttggcttcctgttagttcccttagcctctggacacatgtggccaacattgaaatattggcttatgaggtctgtcactcccaggcatcctgagggcagggccacatagtgtttatctccaggggatgttaatttctgtatctgcacagcctgcacatagtaggtactcaagtaagtgcttgttaaataagatggagccaaaggacttgagcctagagggatttggggacaaagtaaagacttccttgcctctcaggaaggcagtgcatggaaaggatctgtgcactcactcactgggaatctttgaggagaagctgctcaccactcccgtctcccccattgcttccgctgccgcctgcctgagatcagggcctggcctcgtggttctccaggatcctttagttccacaagtcctgcaagtacattgtgtttactcctggaaacatgagtaacctgcaaccttgtgtgtgtgtttgtttgtttatttatttatttgagacagggtcttgctctgttgcccaggctggagtacagtggtgcgatcccagctcagtgcagtcttgacctcccaggctctagcgatcctcccacctcagcacctgagtagctgggactagagcgcacgccatgacacccagctaattttgtatttttcttagaggaggttttgccactttggccaggctcgtctccagccttgcatttttttattgttttgtttgtttgtttgtttgttttttgagacagagtttcactcttgttgcccaggctggagtgcaatggtgcaatctctgctcactgcaacctccacctcctgggttcaagtgattctcctgactcagcctcccaagtagctgggattacaggtgcctgccaccatgcccggctaatttttgcatttttagcagagatggggtttcgccattttggccaggctggtctcgaactcctgacctcaagtgattgacccgattctgcccctcaaagtgctgggattacaggcatgagcccctgtgcccggcccagcctgtgttttgagcgttccacggctgctggaagacctgttgtctgctgaaatcttcatattaaccactcttctgatttaagtacctcccctccaaacaacattaccagggtggttaatgtgcaaatagagatggtgatttgctgctgaccttgtgcaaacattaataattcacacaagcacctctcgtttataattagagcaggctggaacacagcaccatgtgacttgcgttcttatcagtaggcctttacctgggcagcgagggcccagctttctggctggctctgtccctcatcctccattgtgctgcttgtgaaactgtgttctgagtgacccatctcatggctctctctgtgttcttgtttgcaggatgatgatgggccggttcggtaagtaaccccagggaaagtggggagatggaggcatgttagggctcccccaggaagctcccagagagtgtacatggttatctggagggagtgggaaactagatgggtctcactgcccccatagttctggaatcctagagaaagtgcacagcccacccccacctttctgtataatgggcttgtttctcagagctgagagtggctgggttgtgctaggaggagtggggtggaaggctgggtgaccagctaggggagcaggaggggcctgggatgtaacactggctggaactgtcaggggctggagcaagagtggttgagggtaaaagggagggaggagaggcagccagcacatggagcgtcgttagctggctggaagagagtggctcagctctgtggatgtccttccatgtgtattatttcctcctggaaaccactggtttagcagacttccttagagtcaggcagccagggctcattcctggctggtggcttgtggcctgccccttcctctctctgctcctcatccgtgaaatgggagtgtaaaaggctctccccaggcaggggctgctgtgagtattgggtgagatcacaggtgagtgccctgcttggccgggggacagccctctatgtgggctggttttattagtgttggttttcagtggctcttcccaaagagagagaggtaatcactctctcttccctcatgaaagcctgagacctcatcttcatctcggtgagggatggtaacgtttcaaccctcagtaccaggataccccggccctcggcctggccagcctcagtgctttgggaagcatttcaaaagagaaacctcttgacccccagataccctgttctccagtgagcagggaggggagaacagctcttaaaaggaaaaatggaaaccagatagaagtctcccacctgcctctctagcggagctgatatctgtcttttgggggccctctgggtgggggtgccaccccctgagtcctatacaatgagggctgggccagcttggccatggggctctgtaacctcaagttattatggggaccagctaggatgccattgctgcttatctattgtattagggttctctagagggacagaagtaatacgatagatagatatatataaaggggagtttactaagggtattaactcacacgatcacaaggtcccacaatagtccttctgcaagctgaggagcagggaagccagtttgagtcccaaagctgtagaacctggagtttgatgttcgaaggcaggaagcatccagtatgggagaaagatggaggctgggagactaagccagtctagtcttttcatgttcttctgcctgctttttattttggctgtgctggcagctgattaggtggtgcccacctggattaagggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaagagaaacatcctgtatatagttgctgagggaggcgaaaccgcagtggggtcacagctcatgggaccggggtgaggcgtctccccaccctgcgtctaggtagaggcgcgttttgggggcccagtgcccccctctgtcacctcttctccatcttttcttcctggaggaggctcagaacccctttggaattgtagaggcctaaagatgaggagagggccgggcgcggtggctcatgcctttaatctcagcactttgagaggccgaggtggatggatcatgaggtcatgagatcgagaccagcctggctaacatggtgaaaccccgtcactactaaaaatacaaaaaaattagccgggcgtggtggcgggcacctgtagtcccagctactcgggaggctgatgcaggagaatcgcttgaacccaggaggtggaggttgcagtgagccgagattgcgccactgcactccagcctgagtgacagagcaagactctgtctcaaaaaaaaaaaaaaaaaaaaaaaaaaaaaaaaaaaaagatgacagtgggcccctcaagcatttttgagtctttttgttttttttgtggcgctgtcacttttgtgtttggttcgggccttgttggaggtttagggaaaagacagtctgttcagttcagttgggagcacatgggcctcaggctgtgtatagcaccctgtggcccgagggcccagaagcctggccccggagcccctgccaccccatgaatgagctttagggtctgatggctggggcagtggctccctaggtaagagccaggtgtcacatgtgaaaagtggacccagctgccactccaggggtgggaggactgtggaatcgcaagaccatgtacaagaggccgatggaattgttctcgttactttgtaggctttatgtgctgtgcttgagaaaatgcaaacaggctattagtcggtgacaggcaattagttccacccccggccttgctgcttctgctgacgcaggttccgaagtctcctggttacccagcctggcaccctcaggcacagcagggtgtctggcccggcacccgcccctgtgggggcagcagcacgccttgtcttcgcttccctgccatgccattcccctccttcagcccccgagagcaccccagggtgctccctcctccagcaaccttcacctgaatgctctccctctagattaccccatggctcactctttcagctctgccagctcttggttcaaatgtcactgatcagggaggccctctctgactccactgccccaaactggcctccactggctctcctccccacccctgccttagttctttctgtactcatgtgacacaccaagcagcactcagctcatggggatggcctggctcctcttccctgtgccagtgtttacacaacgaagcttgcacgtgtctggcagacactggtgccagcaaactttcaggggcacccacagcccctgcctttctcctttcacacatggctccttgacccagaggtgctctgtgggctggagctgacctttcctcggggtgcaccccaccccctgccaaagcagccagccctggccacagtctgcacgcagctgggggcagatgttttaggagcttctggaaggccgggcagaccctccttggctaatgtgctgggctttgccaggagtggtcttctgggcctcagtttccccacgagtaccctgagccagggagggatggggactccattctgcccactccccatcattccggggagggaggtggctccacaggtcctcgctgcctcctgacagcatcactgtcctggatgaggtgggtgaggaggcttctctccacggaaacaagtctcaggggttccagggaggttgcagcctggtctccatggcaatgggtgagctggtgcggcttctccgcgggcggcccttccccctcctgggcctgccctgggctggaggctctttctgaggcagaggggaaagaagggggatgtgccttcctcactctcttccccctcattgtaactcctagtaattccccttcacgtctctcccatttctgccaacagggcttgttccaaaacctctggctccatcccatcacccgtggctcctgactgtgccctccataactcccacgttgcaggccacagcccctgttaacccctctcacagtccacccggctcttgaacctgcgctgggctttctggcatctctctctccttgtgcctgctggtccctcggtggagcgcctttcctcctcctcttgccccagcaagcctggcttgaaccccaggactgctttgtgaagccttcctcaggtccccccagcccttggttcatgggtcccagactcaggtgtctccagggaccaggctgataatataaaagaggagagtgtctagattatgcaatgataatgtcatctgccccttcaccccagggctgggtggcagtggggagtggtggggtctggcgcaagctggagagtccacacccccatccccaggggcagcttattgctgccaggtgggagtgcaggctcactgttgccacagcctccagttcttcaagagaagccagaagttaagaacttttggacaaactttccaatttaagaactgttcgctctcgccgggtaccgtggctcacacctgtagtcccagcactttgggaggctgaggcgggtggattacttgaggtcaggagttcaagaccagccttaccaacatggcgaaaccccgtctctactaaaaatacaaaaattagccaggtgtggtggtgcatgcctgtagtcccagctattcaggaggttgaggcagaattgcttgaacccgggaggcagatgttgcagtgagctgagatcatgccactgcactccagcctgggtgacagagtgagactctgtctcaaaaagcctaaagaccaaaacaaaacaaaagaaaacaaaacaaatgaaaactgttgactcaaatcaaaacattacagcgaccaagctgagcattcctgcagattgagcttgggcagccctggcatatggtcaggtcggttggccccccgtctggcttcgtcttttctgacactaacagggttgcactatcatagtttactccctctccaggccctcccccaagtctgtgcctcttccaagagaggagtccctccttgtttatctctgtgatgtccccagagcctgcggaggctctgggggacaggacgagcgggagctgtaaggactgaggaccgacaatgctcctgccaggctccatgctcctgcctctactcactgccccacttagttccacaccaagagcgaggcaggggctgtgagaatgctgcctttatggaggaagaaagggggtcggagagggaaggatttgcccagtcatggggtgtgaagtggggcagctagaacaaaataggatctattttcgttcccaaggccaagcacatcacaggggtgcagtatgctctctctgtctctctctctcccctaggtcagggtggtccctggggaggcccctgggttaccccaagacaggtgggaggagcttcctacccgaccctcttcctgtcaacctgggctctgcggctcccagggctgctccttgtattggggccccagcctggctggtaacagagggtccctccactgggctcagtcttctgagcatgctctgcccccaggaacctggaggatggaagttgggggccctgggtcccttccaaatgcccttgggtcctgtgcctggtccccagtgcccattttcagagcccctggcccctccctgccttgtggactgtgtgacgtgatgccagtcccctgggtccaggggcatggcagccggcggagaggcctctgcggccccgatgtctccttgagtggcttgactctgccagcccagcggtggcccagctaaatataccctggctgacgtcaagcactcttctgctcctggggtttttcttaagctgcatttatagtttgcgtattgctttgtaaagatgtaaaaatttcactttttttttttgttttgccccttagcagactgtcttattgagtgtagtcttagatgattatgaaaatcatttacagctgccgcattaggaagctggcgtgtgtgcagaggcagggcattttggtcaatgttggtctttaggtgaagaaaacttccctcccttcccccagtcacgcacatgctcacacacgcacacatgcgctcacacaggcacacacacgctcacacgtgctcacacatgcacacacgtgctcacacgtgtacacacgctcacaccgcacacacgcacacccgtgctcacacgcacacatgctcacacatggacacacgctcacacacgcgctcacacgtacacacgctcacagcacacacacatgttcacacacaacctcacacgcacacacgtgctcacacacgcacacatgtgctcacgtgcacacaggtgctcacacacacacatgcacacacgtgctcgcacacgcacacatgctcacacacgcaaacacgtgcccacaatgcacacacatgctcacacgcgcacacacacgtacacatacactttccttctctcctttcctctttgtttctcaccacctccacaaggccacggaaggggctacttgggctgggctgggcaggggggtgtgagctgcctcctggggcccagcctgggaggaagggtcagcatgcttcctctgggaggaggcttggccaacttctctccgtaggtctctggcttacctgggcctaatcccttctttctttttctgggctctctttgtctctctcctaggccagggcggtccctgaggaggctcccctaggccacccactagacgggtgggaggagcttcctaccccactctctccctgtcaagctgggctccgcagctcccagggctgctccttgggttggggccccagcctggctggtaaaagagggtctctctgctgggcttggtcctctgaacatgctctgcctccaggaacctggaggatggaagttggggggccctgggccccttccaaatgccctcctccctgtcttttctgccctggcagtgatgccccacagctctgtgtctacctggagacctcagccctctgcttggggtccaagtctctgttccatatgcccctatggaactcccccctccatggcagcaggagcaaaggctctgaggcaagtgtgcaccagtgtcagcaggagcagctgggaggccggttggtggagtgaagtcagggagggtgcatgtaggaggataacgctgagtctgagtgtcccatggcacgtgggagagaggatggattttatctgagtgtcccatggctcgcaggagagaagatagattttattctaagcatgataagaagcagttggagggttttagttgtggtgggagtggaggggggaaacaaatgatcctgtttgcacttggaagggctcactctgcctgctggggagaagggctcaggggccaggagtggagtaggaggctgcagctgctcccaggcgaggggcagtgaggcgtgagcaggacatggccaccgtcgcgggggaagtggttggattcacaggtgacatttgccagtagacaaggagtgtgggaacagggagaattcaggacgcctcaagtcctaggacgtggcaggtgcagatgccagatgccatctatgtgtttcatatgagaaggtaaaaagcaggtggaagggaccctctgcagcctctagtccacgctgttctggttgttcccaagcgctcttgctcgccttggtttggccgggactgatcatcagggtcagccctttcattctggtaggaattggaaggattctaggcaggtgtgggagttgaggctgaacctcctgagggatcagaagctggcagggccctggattagggcagcaccacgggtttccataaacgctccttcgtgtctctctttgcatgtcctcagagcgggatgccttcgacacgctgttcgaccacgccccggataagctcagcgtggtgaagaaggtgagctattggtgggatgttggatgtgctctcccctggctcgcggctttttgacagcacaaacgccccgctgggaagaaggtgggaaaatgtttggaatctcagaaatgtttgccacatggattgaaatgtaattacagtcaaaaacctaaccacagtgcataaaatcagcgccttttaactcaacctcgctgctccctgggtgtcttcctgcccgcccgctccgcttctgttaagtgaattacccagcccccatttctttctgactcgagaccttttttcaatgtggaaatgtttttaagcatgtcagcctgctgctctcgctggcctcatttaccatctacagcctgcccagtaaacacgcaggcctgtgcggctgagctgtgccatacatggatttggcccgtttccctccagacagagaatgggccctcactagcccaggcagcctgctggtcaatctgtggatggaaaaatctccgaggctctggagttgggggctgggtgtgatcagcttctgggggatctgccagggaggcttgttcccgtcaaaaggaactggagcccactggctgctcattaacttatccgagtgcctgcaggcatcccattcaggaggctgctgcatccctccttcccataacatcggaggagcgctcatttcaacccatggtgcaggcaagagagttctcctttgtctaggacagcttacccaaacagctttcttagtgcaagacttgtcagaacctttaataggctgacctatactgtacttctccaagagggagcttggtaggaagcatttttcaaacttgtttgtttatagtgggatttatttatctatcaattttggggtaagacgcattgtattttagtggaacccacttttggaaaatgttggcctgggtttggacgatgagatcattcatttttggaagcattttgcaaaaggctgttggaaccgtgctaatggtccttctgggacaaagccttcctagcactcttgggtggtgagggatatacttggagcatcagagtcccccacctccacctcgtcacatgtggcccccagggaccctgacagaaccggttcagggaatgaatcaaatccagcttccccacttatcagctgtgtgacttctggcgaagggcgagattataccccccagcctcagtttccccatctgtcaagtggggacagagatgttacccacctctcagggcactgtgaggataaactgggattctctctgtgcatgggcttagccggcagcgtatagtcactggtagcattgagaatggtgtggcctgagattgctttcatctctcggtagataccatgttaattcattctgcgaaagacacattttcggcactggagccaccagcaaggaagaagacagaatcctttgatttgcctggtagcttcccactccagcctgtcccttcctcacctccacattgcaagtttaggtgtctgtagctctctgtgccccagaatgaagtcaggggcccctgcccacctctgcaggtttctccctgggtcgtcccctcctactccttcccatcccacccacatccagccacagcctgaagaccccaaagggtttgcagatgtgtctgggtgcccactcggctcactctcaccttgcactggcccaccctcaggcccagctccaatgctccctctccatggtcttaacgggggtccgcacacccattaatggctcatgaaatctcccttgcattgcgtgtttccctgtagtgccctatctcttgacttctccgtcccaccactacacgcatatggagaattacatcacaggccctttggcgggggccaggggtggagctctctgtgtttgtgtccttagcaccaagcagcatgcctggcacatagtagctgctcagtaaatttgagcagaatgggtaagaaatcatatcatgggcaggctgggcgcggtggctcacgcctgtaatcctagcactttggaaggccgaggtgggtggatcacaaggtcaggagatcgagaccatcctggctaacatggcaaaaacccgtctctactaaaaaatacaaaaaaattaggtgggcatggtggtgggcacccttagtcccagctactcgggaggctgaggcaggagaatggcgtgaacccgggaggtggagcttgcagtgagccgagattgcgccactgcactccagcctgggcaacagagcgagactccatctcaaaacaaaacgaaacaaaacaaaacaaaacaaaacaaaacaaagaaatcatgtcatgggcagtggtggatgatattgagtttctatcaaagttggctttggtcactgaggaattacaggtgacaggttttaagcttgtgccggagagaagccagtgccccttggtacttacataatagggctcagagagatcaccctgggtggatctccccatgtattgcaaatcgataggcaggctgggcgctgtggctcacacctgtaatttcagcactttgggaggccaaagtgggtggatcacctgaggtctggagttcgagaccagcctgatcagcatggggaaactccatttctactaaaaatacaaaattagccgggcttggtgacgggtgcttgtaatcccaactactcgggaggctgaggcaggagaatcgcttgaacctgggaggtggaggttgcagtgagctgggatcatgccattgcactctagccggggcaccaaaagctcggatgatcctcagtggtctggggtgcaggcttcaaacctgtagctgtctagtgacagagtggttcaattccacctttgtaggcccggcgcagtggctcacgcctataatcccagcactttgggaggccaaggcgggtggatcacgaggtcaggagatcgagaccatcctggctaacacagtgaaaccccatctctactaaaaatacaaaaaaattagctgggcgtggtggcaggcgcctgtagtcccagctactcgggaggctgaggcaggagaatgatgtgaacccggtgaacccgggaggcggagcttgcaatgagccgagatcacgccactgcactccagcctgggcgacagagtgagactgtctcaaaaaaaaaaaaaaaaaaaaaaaaaaaattcagtaggtgtggctcaaggcagcactttcctcagtcttctgagtatgccgtttattgttccaggtcacacctaagatacatttgcaaatgtaatgatcctcccctggcagtttcatctttcttaagagcacagggtgctctccagtatgattgttaaatatgtcatgcgtgcacggattggcatatgtgtgcatgggttggtgagcagagacgtgtagccaggatagatgtgggcattatgccatgaaaactaggggctactgtcaggatattgagtttgaaacatgggctttttattttagcaaacaggagatgatgaaagcgtttcacagagctggggctggcaaatgtcaagcctgcccctccagatgggacctgcatgcgggccattcatggctcctgtgtctcttttattcttggcagtctctcatcacttttgtgaacaagcacctgaacaagctgaatttggaggtgacggaactggagacccaggtatgtgctgctttggcttgaaggatcctttgtccaccgccattttcagtcagtgttttgatcccaggtggggcgcgtgaacaaagctggcgccattttgttcatctcacaaggaactcccgtggtgcaggcagaaataaccaccgtggccttctcagcccctctgtcttcctttcctggggctgctgccacaaagcaccacaaacctagtggctgaaacaacagacctttgtgtcctcgaagtgctggaggcctgaagtccaaaatcaagatggggcctgggtgggttccctccaaggctgtgagggaggagctgttcctggcctccctcccagcttctgtggttttgccaggatctttagcattccttggcttgtacacacatcactcccttctttgccttcatcttcatgtggtgtcgtccttgtgtgtgtgtctctgtgtccaaatgtcccccttttatcaggacgtggtcatgttggattagagcccacccatggcttcatcccaacctgactgcatctatgtaaaccctgtttccagatacggtcacattcagaggtcctggtgattagggttccactgtatcctttttctttctttttttttttttttaaagacagagtctcgctctgtcacccaggctggagtgcagtggtgtgatctcggctcactgcaacctccacctcccgggttccaaccattctcctgcctcagcctcccgagtagctgggactacaggtacatcccaccatgcccagctaatttttgtatttttagtaaagacggggtttcaccgtgttggccaggatggtctcgatctcctggcctcatgatctgcctgcctcagcctcccaaccactgtatctttttttgggagacacaaaaccccaaaacacctgagtggtgttattcaacccataacacactccagggctccaccccagcccaacacagggcctttgcacacgcagttcctctgtctagaacgtgctggccccttcagcctctgctcagtgctgctgtcacactgtggccaggacctagcaaatgtccccctggtaggtatgtacaacacatttcttctgcaataagtatatcaagtctacttccccagccccgacccctactcaaagctaaaggagcatccttaaattatatttttgggcactccgagagcattaaagacaaaatatgattttcccaggattagcagggtgcttgaatgcggaggtttttgagctcttggtacagacatccctaatgcacagctgatccttcttaaaccccaaggtgaatgcattcattcccttctctttctttaactttcctcatttgcttttctaattaaaaaactaattcaggttcattgtagaaatgtctgaaaatgcagataagcaaaacaaataaaaatcacccataatcccgtcacccggagatgaatgcacagagggttttgttcaggccttttctctacacatatagcgagtcatggacagtgtgggtctgtatataaaagcatcacggtctgtttttaatgtatatatttatttgtgtatcgttggccaacacatttcttattttccgcagtttacaaatgttgcacatttagcctcagattattttctgtttgagacgttagcaccccagaagccactgaggtgaaaagtaaaaatcttcctttctctttttctggagacctcccccttcagactctccaggggcagctaactgcagttcatggttggatgtgtatttttctagatattttctttttctttctttctttttttttgagacagagtctcattctgtcccccaggctggagtgcagtgacacaatctcagctcactgcaacctccacctcctgggttcaagcaattctcctccctcagcctcctgagtagctgggactacaggtgcgcctcaccatgcctggctaatttttttgtatttttagtagagatggggtttcaccatgttggtcaggctggtctcgaactcctgaccttgtgatccacctgcctcagcctcccaaagtgttgggattacaggtgtgagccacattttctatgcacaaaggtatttttctaaataacagtggatcttaccgcccactgttttgtaatgtgttttgtgtcactaaatacactgtgggcatcttttggtgtaagagaaagtgtgtgtgtgtgtttctatctgatcctttttcccttgctcgatctatcggtctgtctatattttgtcacttttaatgggaagtgtatctcatcagcgggaaggctgcactgcacctcattaaaccagtgcctcacgactggatgtttttctgctcctgtaaacagcagtgcagagagcagctttgtgcacggctgtctgtgctcgtgcctgcttcctcggaataaaagcctagaagtggagtcattagagcgaagcctgcaccgcacactttgaaggctcaggaagatttgctgtgtgggggcccctggtactgtcatggggcgtgtgaggggcactgctcccccacatccataccagctgtccccacagcccttctcagaggtgtctgcacatcagtattagcagctgagcctcttacattgagactctaaaattaaatttgcatttgtttttatttactcaatatcttcatttttttccccccgattaatcgtactatatagagtcttaaaagtacatttaaccactggtcccccagaaaaggtcgctggttacagaaatgcagggatttttgttttgttttgttgcaaaggaatttgggtatttttataaataccatatatcatttatgaagactgtaaatcattaacgtcttgatgccctaggagtcggagaggccctggtttaatttcttcaatttctatttgtgtgtgggtgagtgtggtttatgtagtctggtatgtgtggtttatgcagtctgttgggggtgtgtgtgtgtgtgtggtttatgtagtctggtgggtgtgtgtgtgtgtgtgtgtgtggtttatgtagtctggtgtgtgtgtgtgtggtttatgtagtctggtgtgtgtgtgtggtttatgtagtctgtgtggtgtgtgtgtgtatttgtggtttacgtagtctgtgtggtgtgtggtgtgtgtggttttcgttgtctgtgtggtgtgtgtgtgtggttaagtagtctgtgtggtgtgtgtgtggtttatgcagtctgtgtggtgtgtgtgtggtttatgtagtctgtgtggtgtgatgtgtgtgtgtagtttttgtagtctgtgtggtgtgtgttgtgtgtgtggtttatgcagtctgtggtgggggtgtgtgtgtgtggtttttgtagtctgtgtagtgtgtggtgtgtgtgtggtttatgcagtctgtgtggtgtgatgtgtgtgtgtgtgtgtggtttttgtagtctgtgtggtgtgtgtgtggtttttgtagtctgtgtggtgtgtgtgtgtggtttttgtagtctgtgtggtgtgtgtgtgtgtgtgtgtgtggtttttgtagtctgtgtggtgtgtgtgtggtgtaggtgtgtgttttccctccttttccaaaccattcttacattgcggacagcgtcccagctctgtgatggtgagtgaactcctcagcctccctgagcttctgtccacagaattaaactggaggcgatgggcagtgtgaggactgggtgagatggcgcactgagatcaagtgggcagggctcggcaggggttagcactgcggatgaggaggcggtggtggggcctctgggcctccgtggggattctgctccctgctgagctagacagcaggttgtggagagagggcaccacgctgggtgcttgtgaaagtggagggtcacccgctcgcagctgggccccccagccctgccctctccttgtggccgtccctccctccttcctgtgagcccgtgtgctgggacagtgaggagacaccacggaaggaagaaaagactcagcaggctcagggcctgcgggagcagcggcgtggccaccccagacctcctggggagaggtgtgggttggtgccttcattcacgtggcagcttccattccctggaagttagtccatggagacgtgggcatggcagctcaatgttgttctgctgggaaggtgccagcacgcttaaccagggtgctgtgggcatgaagcttccatgtggagacacacttaaaagaattcttcaaacccgtctgatctccttaatgataggagtggctggctgctttgtggtgtggaaggctgagggcatgtgacatggaggccaagtgccatttgcccatcaactgacagcgtgttgaatttccaggcgcagtggctcatgcctgcaatcctagcactttgggtggccgaggtgggtggatcatgaggtcaggagttcaagaccagcctgaccaacatggtgaaaccccatctctactaaaaatacaaaaattggcgggtatggtggcacgcgcctgtaatcccagctactcaggaggcggaggcagaagaattgcttgaacccaggaggcagaggttgctgtgagccgaggttgcagtgagccgagatcgcaccactgcactccagcagggcccagaccctgtcctgagtcccttaagggactgttgcccactggcactagctttatgctttacagctctagctgcagctctccctgctaaaggtcagggcttctgatattggatgtttgtgattttgacttttcatctttttttttttttttttttgagacagtttcactcctgttacccaggccggagtacagtggcgcgatcgcggctcactgcaacctctgccttccgggttaaagcgattctcctgcctcaacctcccgagtagctgggattacaggcatgcaccaccacacccgctaatttttgtatttttactagagacggggtttcaccctgttggtcaggctggtcttgaactcctgaccttgtgatccacccaccttggccacccaaagtgctaggattacaggcgtgagccactgcgcctagaagtttttacttttaatttttttaaaaattcaaatttaagaattctggagattgtttgtacaataacgtgaatgcacctaacatgattgaactggacagttaaaagtagttaagatggtaaatgttatggtatattttatggtatattttaccacaatttaaattaattaaagagaaaggttagcataagcgagacacaaaagataaatggatatgcgattccacttacgtgagatacccagaggagtcaaattcatagagacagagagcagaatgattggtggttctcaggggctggggggaaggtagaatagagaattgggggacagagtgtcactttggtaacatgaagaagttctggagatgggtggtggtgagggtgacccaacaatgaggatgtacttaatgctactggcctgtgcgcttacacacggttaagatggtacatttcagcttatgtatattttatcacaataaaaaataagttagcaacattcaaacaaaaacattttaatttaaatagctgcatgtggccattggctaccatgttgaatagcagctccagaggccccctggagaatggggccacagtcactgtggtctctgctgcaagacagagtggtgagggccaccaggtcccagctctgcaccctgcagatttgaatgaatccttccagcagctgatgctgatggagcactcacgtgtgccaggtgctccctcccagccgtctcgctgtgtcttcacgacagccctgaatgatgggagtcactactatccctggggtcaggagtgggggacagttccagaggcacggtcctagccaggcagctgcactcagctccaaacactcatcatatttggtctttgcagagccccatgtgttagagccccctccccttttgcttttttctaggttaggagccaggtctcaaaagacttcacattcaggccttcacttgattccagattctcctgcctaaagtgagaggagggatggattgctttactttaaaatatttccagctgggtacagtggctcccacccgtaatcccagcactttgggaggctgaggcaagtagatcacttgagcccaggaatttgagaccagcctgggcaacatggtgaaaccctgtctctacaaaaaatacaaaaattagccgggcatggtggtgcgtgcctgtagtcccagctacttgggaggctgaggtgggagaatcgcctcagggaggatcacctgagcctgggaggccgagctgcagtgagccttgattgcatcagtgcactccagcctgggtgacagagtgagaccctgtctcagaagaaaaaatatgccccccttaagtttgtgcaaagcatttgccaactccttaccctgcccggaaacatcacaagtctttctctgcagtttgcagatggcgtgtacctggttctgctcatgggccttctggaagactactttgttcctctccaccacttctacctgactccggaaagcttcgatcagaaggtatgtgcatggtctccatccttggtaggggctcaagaaatgctcattgaaatgcagagcatagactatcccggcagctcttcctgcagcctggctgcattcttcagaaagtaaaaaatgcacaagtgatattgcaattagatgtaactctcagcaaaagaaataagaagcccatcagccgtccacaacgcatccgagttttgtttgccacattttctttgcggtcttttccatgggaccgtgtagtttttaataattgtgatcacatctcggtagagttgtaaacccttcccccattctgctgcagctccaccacctgtggttttccctgctgcttcccaagctttccaaataccatctccagtggtggcacgaagtcccaaggatggctctgttaccagcgtctttccattccccattcttgggcagtcaacttgaacatgtttctattgtttttccctactgaaacaacagagcatctttttgatacagattttttttttcattcctgtggattgttttcttaggaaaatttctcaaatagggtcaaatttggggcattcctttcaatctgggctggcccacgccacccggtcccgctgtcactgccctcgtgcgtgggcctctccctgctgtctgccctctgtccagggcttcccgcagccaagcctctcacagcagtatttagcacattgcctttaaaaacttggccatggatggtctatgttgctttggattcatgggcatctgtcattttattttcccaaagtgttagacccatgagtcagggaggcagacaatgtaagctggtggcgacagccagagaaatagcagaaatggggccagtgtttatcaatctgcccacttctggcacgttgcagtctgtttgcttgtggccaaatgttgttcctatcttgcctgctgagatggaatcaggacagattagagaggtcttggcacatggagtccatgttgaatcgagagagagagagcgagcgagcgagcaagagggagtgcagagggaatgagcagaattgtgcagaactcaccaggaaactcaccaggtgcctgtgctgtcatcctggaaatgaaaggtcagaccatccagcgaagaagcgcatgcatttccaggccccgatatggctggttgcagacacattgttttggagagatcttttctttcttcaaactagtaagaatgctggcgagaacagtgagtttagccaggagacctagggctggtttctttccaagacaaggctttgtacaaatgtcagaggcatcatctcctgggccctggccttcttccctttgaaactgggatgaaagtctttgacaattgctgccctggcctgcgaggcttgaggaggcttgagtcatctgccttcccctctgaatcggagcgaggaagggaaggctattttcaggtatagcatgcagcacaccattcatcctgttcactcaggagaaagggagcctggggtggcggtgtggctctgcgggtggctggaacactctccttcggaggatgggaggctgtcagtagttcctcctccagcccctgccttttttccctttctcctcatggcagctgctggcaaggtcttcatgagcccatagtatttattatctaccttgtagtcttcgtgaatcctggacaggtgggtggtccctgctgtggaggactcacccacttcaggctgggcccaacacccgtgtactcaaaactgcttgcggatgggatgttgatggcatcccttgctaatgtctcctgtgggctgagaccccgaggtgcgtttgctctggccctgggaatcctgacagctgctccacatttttgggaggagggactgaggttcagtgagcaaaaccagagatgcgtcatgagctgctgtccccgagggtagtaatgacttatggtttaaaacaattgcattggatttaaaaaatatcacactggacagctcagagcctgtaggctcgtgccccatgagctatctcagaggcatgagtgtggccttcagtttttttgttgcaaagccactgtttgagccttaccctgcactggccacgtgctgagcaccttgcacccattggtcatcattttgggagactctgcaggctccctctctctgtcgagtggggtgcatcctggagacgtggagatctttcctagaagaagacacgagttgcttccccctcagcattactggatgaggacagggaatctcaggaaggcttagagaccagcccagggttgcacggccagcaagggcagagccaggagggtcgactcctattccagaaccctctattctttcctcacctggccaagttgattaaaaccttttgaattgcagagagaaaggatttctgcccatgtggctggctcgaagcaggtgtgtatatggcctggtctctgctgggccttggggcctcctactgcagtcacagctggggtgagcggtccccaggcctctccgggatccatgtgctgggtatccagggatctaggctcaggggacacttctctgcctggcatgaaagagggctgggggaggaggcatggccttgagagataacaggcatgggagggtggcaatttcctgcctggcatttcctcagcctgagaagaaagcagaaggaaaatctcacttcaaaaccacttactgtggggccgagcggctgcagagcaatgaggcttggaaggggctttgctctccccttaaactgttctctcatggtgtaggggtgaccacctcgtcacccgatcacactctccagccgtctctgagtgtctccacgtgtcatgcatctcatccccagcccctcctgagcatccactccctcagcgtggaagaggattcctcaggcttaagaggtgcacgggagaggcacgtgaaaagaccggtccaaattggtgctgacttttacaatggagaagaatcttttcttaaaagaaaaatcttttctcgctattccctctctttgctatcctgtctccatctcgatttggggtcaagcctgttgtgtgtgtgtgtgtgtgcacgtgtgcatgtgcatacgtgtgtgtgagctcatttgatgatatggacggtggtcagctaaagggacctgtgttgctaggggagtggaggtgggaggctcttggaggagaacgggcacagattctacgtttcagtcctggttccatgcctgtgagccccgtgccttgtttttcttttcttttttttttttttttggaggcggggaaggaatctcactctctcacccaggctggagtgcagtggcacgatctcggctcactgcaacccccgcctcctgggttcaagcgattcttctgcctcagcctccttagtagctgggattacaggcacatgccaccatgcctggctaatttttgtatttttagtagagacggggttttaccatgttggccaggctggtcttgaactccagacctcatgatccacccgcctcagcctcccaaagtgctgggattacaggcgtgagccactacatccagctgccccatgcctttttagggcaccgatgtcctagcccatctcagcccagcaccaccctcctttgtgaaggaagatgatattcacctcgtacagggctgggaggggaaagggaacctgtatggaatacactgaccccatggtggatgcacagcacccgcaggtcgctccctgctctctccttaggggaactgcgttctgcaccctccgcacgggccgtcctcactcctcccccattgccagtgtttggccatcctcaggcccagccctggtgcagcactcccgcatctccaggcaggctgtcctgcagggttggggtgtctgccatgtggcccagtgttcccattggcagtttctgagttggcctctggagcagggtctccgtctgctgcacccccgcccctgggtggacatggcctgccctcctgccgggctgtgtcttccccactgaccctatgactagccagaccctcttgcggttggtgctggcaggtcattcgcccctttgcttctccgagcacaggccgtgtgcactgtggaagcttttccaaagcaccccacactgttttccagtgttgttcgtttgattaactcagggaagcctctttttcctggttaattattaaattacattgcaagtaaaattgttcttgtttctgattcattggcctcaaaatcatgaaaatatgatcgttgaaaggattttttgtttgtttgtttgcttgtttttttgagacagagtgttgctctgtcacccaggctggagtgcagtggcacaatctcagctcactgcaacctccgcctcctgggttcaagcgattctcatgcctcagccacccaaatagctgggattacaggtgtgcaccaccatgcccggctaatttttgtatttttagtagagatggggtttcacccattggtcaggctggtctcgaatgcctgacttcaactgatccacctgcctcggcctcacaaagtgctgggattacaggtgtgagctaccacgcccagccaggatgtttgattactaagagccctgaagtcccttgcactgtgacatctgtgcttgtttgctgtttgtttgtttgatgtcccctcctcccatcagccttggcttgcggcaggtgggtggctggatgtaatctggttcattgccggcatccctctgagtggtctttaaacacagcccagaaggcttttattttaaacctgttcagccatcattagcaggataaaagcttcaggtacatttgggggctgaggagtaatagaccctttaatttcaggggaagtcacggtagggcggaggtggccacgtttctgtagcatctaacaggaccaaggtcctgcaggctgacgcttgcagccaccatcgatctgacttccgttctgactggtccactgtccctactcagtgctaaggccctccctcccctgagggcaccccatcctgcagagacacagcctcacgtgcaggtctttacagcccttcctggggcagtgccaggcctgcgtgcctctgcacgggactcatcctttctgggcctcagtttccctgtctgtgaaatggggtcactgtgggccaggcgcagcggctcacgcctgtaattccagcactttgggaggctgaggcgggtggatcatttgagcccaagagttagagactagcctgaccaacatggcaaaacccgtctctaaaaaaaataataataatacaaaaattagccgggcacagtgatgcgtgcctgtagtcccaactactggggaagctgaggcaggaagatggcttgagcctgggaggtggaggttgcagtgagctgagatctcgccactgtgcactagcctgcgctctagaccctgtctcaaaaaacgtaaataaataaataaacaaagaaataataaataaaatggggcccctgtgacttctcatcaggtggctggcatctggggcagagcaggctcttggtggccgtgagccctcgagagcaggccgggcacctcatccttccatctctcagcccagatcactggtgtgaggggtgagaaccacctagtaagcgcacatggccctccgcagacttcctcacccgtgtctgcccaccctgtggcccgccccgggctcactgggtccttgtggacgtcagcgttgcagaggctcggtcctgtccatgccggctgtcctccagcagtgggccgtgtgtgggaacgactgttggaccctaacgctgacccaccccccttccttggcaggtccacaatgtgtccttcgcctttgagctgatgctggacggaggcctcaagaaacccaaggctcgtcctgaaggtaatgcccctggctcaggttcccccgggagaggtgcgcacggaggggaagaaaaacgggtcctagaagtggctggaaggctggcatgttgttccccagatgggccccacgtctctggctctggggcaagggtctgccaaccccagctcctcagtctcctcattttgggaaccaggaggacttcgctggtggagctggcagtgccggttctttaataaccacttgactttgaaggacgtggcctctgcccacagacctcaggattaagtgcgtctctagctggccactcaggctggaaatgcagcttcgtgccctgagaagaaattaaaggcttactcaactgtaatgactgttgggctggaggtcccctgatgctcagccaaaggcagtacttggtagcagggacttggcatgctctgcgtgggtcggagctggaggcaggaggccagcagagctggggcgggcggttgcttccctgtcccccccccggctcctgtgccaagttacctataggaggactctctaacctgagtgagcatcacagttccccaaacacacttcctaggtgtttggggacagccaggctcagcagaacatgggtggcactgcctgtgaaccctgctggaaagttacagggcagagctgaacattaaaggctttgacaagtcctatatgaagacatctgtttgcctccatcaaaacctttgccatgcaggaggagcccacagaactcagacactgtggtttagtgccctgggcccccactttgaccgtggccccctacctagccctgctccctctcctgagtcccccatggtgctatatgagttgggagcccatgatgcttcctacacctgttgccagcatccgctcaacggcgggctttgtagagtctccaaaatagctagaaaatggatcctgtcccttccatctacccactgcagccaccgcttcctgccagtccacgcggaaggttcctggccggtcccttcctgcctgttcatcctcctcttggggtttcacaggacaatttcacaccctcctgtctcgtgtgtatggctgtttattcttttttgttttgagacagggtctcactctgttgcccaggctggagtgcagtggtatgatcacagctcactgcaacctcttcctcttgggttcacagcatcctcccacctcagtctgtcgagtaactgggactaaggcgcataccaccatgcccggctaatgttttaacttttcttttttgtagagacaaggtctcactatgttgcccagactggtctcgaacttctgggctcaagcgattcgcccattacaggcacgagcccccatgcctggccttgtttattttttattgtccctccctccccactagaacagaagcctcaagggagcagggctttgtcccctgcatgccggtgctgagaatggtgcctggcctggaaactgctcgacagcacggatcaaagcacatgtccagcagggagtgtggcgagctgctgcctgtagataccggcccggcctgggtctctgggacccctcgttgctgctgccctgcagcccttttgttgctgtgaggcagggccatgagggagtggctagaggcccgagggatgctgctttgcctctccccagctgtgcatccttgaacaggttactttgcctttctgtgccagggcctcctcctctgttgaggggagtgatgatggcacctgcctccacgcgtcatggggtcgctggatggggggcggatgttcatcacacaggacttgtcagagccttcactgttcaactctgccctgtaactttccagcagggcccacgggcagtgccaccacgtgctgctgagcctgactgctcctgagcacctattacgctcaagtgagctgctcccatgagcactggaagagggtcctgcccacagaacacaccaggtccctgctgatggtggctgctagctcggcgttagtgtctggtgggtcgcacactgtcagggaggagaaatccttgctcatgtccactgtgggcttggctggggcttcctttagtttcctgtagcccaaagcctgggccctatctgcagcatggggtgcttcccccgtaccctcagaagagcccctggtggccctttgcctctgagctgctgagggagccctgcttctttgtcctcccgaacccacgactttttttttctgagacagagtcttactttgtcacccaggctggagtgcagtggcgcgatcccagctcactgcaatctccgcctcctaggttcaagcaactctcttgcctcagcctcacaagtagctgggattacaggcacccgccaccatgcctggctaatttttctatttttagtagagatggggtttcaccatgttggccaggctggtcttgaactcctgacctcaggtgatccacctgccttgccctcccaaagagctggggttacaggtgtgagccaccacacctggccctttgtcccgtttttgaggagtgaggcaggagcctgtccagaggccaggatatcctctgacaggccggcctcctaggagggtgtttgcccctgagcccggatgtgtttcctactcatctgccgctggacggcacgttagggaacccaccacggacgtgtggaaaccaggccagaggcagaggcactggtccagggcaaatagcaagttctgcagcctcccaggcagggtcccttgggtgtcccagggcctctgtccagcccaggcagggggcagagctggtctgcagtgctcattagcaccttcgctgggccagcactgggcaggggccaagccgcagagatttatgagatggggtccctgctgggcctctttattttgtggctgatgcaatgaatgagagacttttccttcttcattcaaaatcagctggggagcaagaatcaggaggtaacagagataagaatgacacggagaatggggtgcagtggctgcggtctccctgacaccctcctctgagctaggcagacttacccgggtacccagggctggtggggagggaggcagtggctgtggcctcccctgcaggcctgagactgccctgttggtccccacccggaggaagcagagcagtctcacaccccctgcacgtgggcgggtctgaagagccaggcctgcacctggttccctaggcccccagcaatgatgggcatcctggccccctgcccccttgtggggacctggcggagactccagtggggtccccgaccctgctcttaaggaggccccttgcctgggagaaaggcttgtggctcgctccaaattcacagagccgagtgcggagctcgatggtggggtgggtgtttggggagcacagagggactgaggttcatgggtcacagaaggtgattcctatccctgggcgcaggtgctaaggggtggctgtggttagcaggtctggcaggggtgtgagggttaagttctgtttgtccagcgaggctgtctggaagttctcagagctcagacctgggggctgctgcgtgggggcatcggtgtcaggctgctgctctggtctccctgtgagtccaccatgggagtggagtcagagggggccaggaggtgatggcccccacccctgggagctcctctgtccttgctgcccccctcgccttggccacctccaactccatggccgccattctccctcccctgcctccactgggctgttgggagctggggtggactcttcaggtcagggggagaccctgggatccctgacagagccccgggtgtgtccccaagcccgccgagccgagttccccgacagagccccgggtgtgtccccaagcccaccgagctgagttcagccctgcttttgctctgacagcacactcgtgggcaggtcatttctccatgtgagtcttggtcctctttgtaaaacgagagggaaggaaaggaggctgtgcaggctctgatgagggtgtgtgagtcgagaaactccatgcccagtgacaaggacagttgctgattcttagcatccaccccacctgctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaa

SEQ ID NO: 2138 - DNA, 142930 bp, Homo sapiens
tgctgaatagaacgggcgtggaggcaggaggaggagcaggacgccgggcactgctgatgctgctttcgctgggggtgagctgggcgccctgcctcggttctcagggttggggtgcctggcaaacagagggccacaaaccctccttggatctaggcacaggaattgagggacaggctggattgggaagggtttagcggcttctgtgtggtctcctgggaagtggaagagtcaggaagactggataatgagggcttgaataattgagagtcgctggtatttccgcaagcccatttgccttggcaacatgcgcttctgccactccagggtggagcagcccctggccctgactttgggccgtcagagctatgctcggttgcctaccagggagtgacagggcgcttgggaggtttccacgaccctgcctgctgcaccgtcggcttcatttcctcctttgttagaaagttgagggtggatttgggagaacggatgtggctccgacatgttcctgagttgaggactctaagggaggagggggaagctgggggaaggggcgggctcatcggtgaggttccagattcaggcaggggtgtgacaaggcacggagggacttttgggagggatggttgggatgagtgacgtggcctgttccagaggagaggggttaggaaatgtggggccctggggtttggaggaagcagtgcaggaagtgtctgagaatgagcttcacggtgggcgtgattaaggctgatgtgctacgggaggcgtgtcacgtggtggcctgggtcagaaaagggaactgtgaccaactgtgggcattcagaaaatggaaaggaacgccggaaacccccagggctccccacagaagctctggggacgtgaaaggacagcgtgtttcaaacttgggttcagctttactggggcttggaggagcccgtgtgcagagaagaccaacaacacacagggttccccactgtgaccatgtgatgagaggccctgtaggtccagtgggccaggatggaggtcggggacagcccagctgctgctggaagtcctcagaggcggatggccggccctggccagtgtggaagaggtcgggtggagtgctccacacatttgccacaagaggcctgttctgtgctgcaccaggcactggacctcaggcgccactgcccagtggccagggtcaggtttctcagagacagctgaaggcagcggggcgagagcagccagtctggaggttctgtccctcttttctgagcaacacattcaggaagtttctatcccctgattaccttaaaaaatatgtatgtgtgggccaggtgaggtggctcacgcctgtaatcccagcactctgggaggccgaggtgggtggatcacctgaggtcgggaattcgagaccagcctggtcaacatggtgaaaccccatctccagtaaaaacgcaaaaattagccgggcatggtggcgtgtgcctgtaatcccagctacttgggaagctgaggcaggagaatcgcttgaacctgggaggtggaggttgcagtgagctgagattgcctcactgcgctgcaggctggtcaacagagtgagactccatatcaaatagaaaaaaaaaccatatatatatatatatatatatatattcatgtgtgtgtatatatattcacatatatatattgacgtatatttttaaagcagttttaggtttacagcgaaatctagcaaagaatacaaagtgtccccacctatcccttctcacctccatcagtgccccccggctgtgtggtagagtcgtgagccaacgctgagacatcattatctccgcaagctcatagtttacattaggggttgctcttgccgttggacattctgtggctctggatggatgtagagtgacatggacccaccattacagtcacctctggagcagcgtcactgaccccagaatcctctttctgctgcctatgcatccctccgtttccccaaatccctggcaaccacggatcatttttttgttttgtttttttggtttttgtttttgttttttttactgtatctgtgtttttgccttttccagactatcatctagttgtgatcataaagtgtacagtagcgttttcagattggcttcttccactcaatgatatacattgaaggcccttccatgtcttctcagggcttggtagctcattccttttttgactgaataatattccgttgtctggatgtgccagtttgttgatccattcacctgctgaaggacatcttggttgcttccaagttttggcagttatgaataaagctgctgtgtacatctacgtgtaggtttttgtgtggagataaggttttaattcatttgagctcaattgctggatcgtatggtaagagtgtgtctcgttttggaagaaactgccaaactctcttccaaagtggctgtgccacatttattcaccggtggcgaacgagagtcctggctgctctgcatcctcaccagtatttggtggtgtcagtgttctggattttggaattctgttaggtgtattgtggtgtcttgttgctgtttcaattcgcatttccctgatgaggtatgaagtggagcatctcttcagatgcttatttgccatctgtgtatcttcttcagtgaagtgtctattaaggtcattggctcatttgtattttatttatttttatttttattttatttttgagatagggtctcactgtagcccaggctggagtgcagtggcacgatcctggctcactgcagcctcaatctcctggggctcaagtgatcctcatgcctcagcttctggagtagttgggactacaggcacataccaccatgcccagctaatttttctattttttgtagagatggggtctcgctatgttacccaggctgctctcaaactcctggactcaggagatccacctgccttggcctcccaaagtgctaggattacatgcgtgagccacagtgcccggccttggcctatttttaaatctgcttgtttgtttccttactgttgagttggaagtgttcttcatatattttggatacaagtcatgtgttttgcaaatattttctcccagccagcggcttgtcttccctgtctcttgatcctgatatctcctaagcatttgatgtagagttaatgattaatgagcaagatattgagacctcatcaactagatctaaagaaatcactaggccagacacataatcccagcactttgggaggctgaggcaggtggatcacctaaggccaggagtttgagaccagcctggccaacgtggggaaacccggtctctactaaaaatagaaaaattagccaggcgtggtggctcacgcctgtaatcccagcactttgggaggctgaagcggcagatcacctgaggtcaggagtttgagaccagcctggccaacgtggtgaaaccccatctctactaaaaatacaaaaattagccgggcgtggtggcacacacctgtaatcccagctactcaggaggctgaggcaggagaatcactcgaacccgggaagcagaggttgcagtgagctgagatcgcgccactgcactccagcctgggagacaaagcgagactctgcctcaaaaaaaaaaaagaaaagaaaagaaatcactaggtagctgcgacattgaactgaaggttgaaagtattaagtttctttgtggactttaaataaccttcaggagagaaatctcaaagctctaaaccagcaaccgagaatttccttcagggcatccatcttttacacggagccatcagttgtgtagatgatgggttgccccaaaacactaagacgcaccagtgaagggaggggagctgtggcaggggggcctgcactgcccccgcctttccccccagcaacgcctgggctgggagctgggggtgggtgagaccctggctcaggccccactcaggacagtttgagggacaggcagatggggggactgagccatgggggtctcaccacccagacttggggttttgggcctccctggaggaagtggtcctggctgaatgtctaggatggatgtaaattagcccagggagggggagggggctcctgaggagacccccaggcaggctcccagtggctgagcaacggtgcagcctgtgggctgtggccagccctggtcgggggctggagaggtgagcagccctggcgtcccacaaacacaggagcttggaacccttgctggggcttggcaggggtggccgatttcagtggtgctttggggagtggggaatggacggaatgggggaacggcggggaggcaggctggcaggaatgtggcacggggcacaggcagtgccccgaggaggtggcgtgggtgggcgcaggcgtggctgtgatttccacgctgttttctagcgggctgcagcccctctgatgctgaaatgaaaaaggacccagatccttgtttgtgggaggggtgggaaaggatttgcaaggagtgtggtctcttttggacgatttttcagacttcttctcgtttccaggccctctgtgctcacgtgacccctctgatagcgtcagggcccgtagaaaagtggctgtggcatgttgggaaggccagcgggcctcctagccaacgaaaagggggagtggctggtccgaagttgggggatatagacaggtgagggaccagggccatagtcactgtggtttctatggggaagaggggatggtggaggtcctatttggagctgttgtgttgtgaggctctttacagaccctgccaacaaagagaaagacaattccacactgttatctctaaacccaaacctccttcgagcagaggccgtctccgtttggggatggacagctgttggtccaagaaggaaaggcacagtgaggtcactgcgacgctgcccagcaccttcatgggaaacgctcctcagggtggtgagtggaactccctggagaccattttccagtgagggcctatctctttcctcttgggctgagaggaagtgggtggctcagctacatttcctttgattattattctgactataatcttcaaaccctacatttctcattgtgtgttccgcccatgcgttctgttgtccggggcagcaaagtcgacctgcaccacgtgggtgtttttgttttcttttgttttgttttgttttcttgaaggcctactaagagctgtcggaaactctgcttctgtagaaaaggtaaaggcactgcttggccacaagtgatgactcttccctgcctttcggggcttggggaggaagggcaggttctcggtggttctcctagcaccttggttacaaacctcccagcagagtcagatcaccttggcaaccccacactcatcaaagggactctgccttgattccctccccaccgctgtggaattaatatcgattgcacatcctgaaattgcttaccctcgcgctccctgtccagtcgtcagaataattaaggggtgtttattggatgtaagtgggttcatccctgctgcgagtatggattttaagtgctccgttggattgattcctccctgctgtggttggcacagggcaggtacctttaccgagctgttttcttcttttcgaacatgcggttccatcacataaaagacataccctatgaaaatgtctctgccttagctgtacatgttacactttaggtttcaggtgaaaaattggtttatctcctaatatgtctgctatttgttacatcacatagaggctgcaaaacagattaataagctttggaggatattataagcatacgttggcccaatggtattaatttgcttatccatactaattgctgtcttggtaaaagaaggcggacacaatgcaatcaatcctagaagtgttctgtggctttgcaactttgagatacctcaggctgacatattcaaatgagagccttctctctggttacaagaaaaaaatggaatgagcagcagttttggcctcgtccagtctctagggctcccagcatctgggtagtaacatgatcagccctgggaaaccagcggagtcttttacctcctctgatgttctgactaagagtgtctgggccgtggggactgaacgcaccctttgaggctatgtgtgttaaagtttgggggcccatttcttcatttctaatatggggcagtgtgggcagatcccagctctgcgtttctgagctgctgagtttgccctggttctgagaatgcccgtcgcggtggtgcagtccgcctccttgcactggatctgttgcttcttctctctaagcctctgttcctgatggtcccttgtggagcaaagcagcacttgtggtgtaaggaaggaaagcctcatcagcaattgagtgagcgctcaatcagaattcgttatggatgaatgtggatgactggaggcattgacgcagacaccagagtccagagctggtacgtggtacagcagaagtggcaagtcagctcagtttaggacaagtacctaaccctgtgttgagaaggattctgtggctgagtctgggcttagggaaaaagaatgctgggaccagtcagccacactaccagtgtgtatggagggttagttgctgagtggctgtcacccccagaacaggagccttttccagctctagtgctgtgtcatttcagcagcactggctgctttattcccattgagtgccgtgcaacagctagttggctgttggtaacaaaagttgtgtgaatcgtttaagatattgcagtgagaatgttggtatcttaactcttcccctagctgtctgtggctaggaagcatctccagtgctattgtttttttcttgagacagagtcctgctctgttgcctaggctggactgcagtggcatgatctcggctcactgcagcctctgcctcctgggttcaagcgagcacatccagctaattttttatatttttagtaaagacaggatttcatcatgttggccaggctgatctcaaactcctgacctcaactgatccgcccacctcggcctcccaaagtgctgggattacaggagtgagccaccactcccggcccccaatacttttttgaggtatacttggctgagtaactgtttagcgtgtgcagagaagcaggtgtttctgagctggaattccttgtacccagaaatgtgagggcaactcacatgggcaccaggaggcatttttgccttcctcaccagcctacggcatcagagaacatttggcagtctctgagtgggagttctttacgcttgcctgatagtagttggaggcctgctcctttaagctttgccacttgaagtgatgagcttggttttggcctttgaacctttacctgccagccacccacaatcagtcggtaatgttggtttccccaagcaacgccatcttaggaatttctttgcttgttctcttacaaagtcatgcattattatacgtgttttcatttgaaaaattacagttccacaggatctagacttgaatgttaagctattaaaaagttaaagagggagtgaaaatgttagcactcctagggcctgcgtacgttgcttgctcaaatccagacgctcctggaagcagctgtctcagcggagccctgtctgcccttgttgttttctgcttctcaagttactccagactccagggaactagaactgaccaggccccactttaaacatgtggatggagtgcccctgacaaggctggagaaagggggaggtccggggcggggcctcatgcgcatatggtattcagagtttatttttgctataaatggaatttgaagaatatatatatatatatgaacatacaaataaaaatatataaagaatatatgtataaagaatataaagaataattttggaattcattgcattgtgtctgcattcttttactgcaacagcaattataattataattatattataaagaatatatattctttatacatatatatttgagatgggtgtctttatacatatatatgtttgagatgggtgtctttatacatatatatgtttgagatgggtgtctttatacatatatatgtttgagatgggggtctttatacatatatatttgagatgggggtctttatacatatatatatgtttgagatgggggtcttgctgtgttgcccaggctggagtgcagtggctgttcacaggccagatcatcagacactgtagccttgaactcctggcctcaagggatcctcctgccttagcctcctgagtagctgaaacaataggtgcacaccaccatgcccagctcttgagaagcatctggcccatagcttaatttgaagtgtcttcatccctgtcttttttctttttgttttaaaattaatagaattgacccttgaacagcacagggggaaagaggcactgacccccatgcagtcagaaatccacgtgtaacttttttttttttttttttttttgagacggagtttcgctcttgtcactaggctggagtgcagtggtgcaatcttggctcactgcaacccctgcctcccaggttcaagtgattctcctgcctcagcttcccgagtagctgggattacaggcgtgcaccaccacacccagctaatttttgtattattagtagagacagagtttcaccatgttggccaggctggtctcaaactcctggcctcagttgatccgctcacctcagccttccaaagtactggtattacaggcatgaacaactgcacccggccaccatgtgtaacttttgactcccacaaaacttaactagtgatagcctgctgttgactggaagcctcactgataacataaacaattaacaatattttgtatgttctatgcattatgtgctgtattcttactacaaagtgagcctgaggaaagaaaatgttattaggaaaatcataaggaagagaatatgcatttatagtactgtgctgtgtttattgatgctgcacgtttacaacatgcgtttacaagatgaatgctctgaagtggccggcaactgcagctgcagacctcaccctaccatacaacatctcaagctattcagcttcttggaatgtcacgcttttcttcttttctttttccttttttttttttttttttttgagacggagtctcgctctgttgcccaggctggagtgcaatggtgcgatctcggctcactgcagcctccgcctcctgggttcaagcgattctcctgcctcagcctcccaagtagctgggattacaggcatgtgccaccgtgcccggctgatttttttgtatttttagtagaaatggggtttcaccgtggtggccaggatggtctcgatctcctgaccttgtgatccgcctgcctcagcctcccaaagtgctgggattacgggtgtgagccaccgcgcccgtccgtcaaggcttcttgggagcacttacagcaacacaagtggtgctttgtatgagtcccatagtgttattcagggtttacggtattgcactaaacatgatgaaaaatacgtgggaacccaaacagatcacttttttttttttttactatgatatggaatttactggagcggtgaactgctcaagtggagataattaacatcaaataatgttctaagcaatgcaatagcaacaggaggcggctactattacagtggtgcagtatggactgcagttaattttatgcagttattattgaatactgcatcttggctgggtgcagtggctcacgcctgtaatcccagcactttgggaggccgaggcgggcggatcacttaaggtcaggagttcgacaccagcctggccaaatggtgaaaccttgtctctactaaaaagataaaaattaaccaggcgtggtggtgggcacctgtaatcccagctactcaggaagctgaggcaggagaatcacttgaacccaggaggcagacattgcagtgagccaaaatcatgccactgcactccagcctgggtgacagaatgagactgtctcaaaaaaataaaataaatacaataaaataaataaatacataagtactgcatctttacatttgtttacatttctctcaactgtgaacacagtctgtgtgtgtgtgtaagttttgatacattttaactttttatagtagatttgtatgtattttatggtggtaaatgataaaacagatgagtatctacatatattttatgcatttgtcgcatatctaactttttcttaatttttaaaaatatttctgggctacgtggtttgcagttttttcaaattgtcacaaatctccaaaaaattttccaatatgtttattggaaaaaatctgcatgtaagtggactcatataattcaaacctgtgtttttcaagagtcaactgtaatgtctttcaaagtaaaatctaaatgagtttatacttgatatatataagtttaatagaaggagtgcgttggctcatgcctgtaatcccatttctctgcgaggctgagatgggcggatcacttgagctcaggagttcaagaccagcctgggcaacatagagagaacccctttttattaaaaattaaaaaaaaaatcaatcaggcgtggtggtgcacgtctgtggtcccagctacttgggaggctcaggtgggaggctcaggtgggaggctggcttgagcccaggagatcagggctgcagtgaaccatgattgcgccactgcactgcagctgtgtgacagagtgaggccctgcatcaaaataataatcataataaagataatctgagaagtgagggtaaaagttaaaggaagattaaaaacaaaaaaaaaatgcttataatcccagtactttgggaggccaaggcaggaggatcgcttgagcccaggagtttgagactagcctgggcaatatagtgagacctcgtctctgcaaaagaaaacaaaacaacaacaaaaaaagaaaaaacagctgagcatggtggcacatgcctgtagtcccagcctggccaacatggtgaaaccttgtctctaccaaaaatacaaaaattagccaggcatggtggcttttgcttgtagtcccagctactcgggaggctgaggtgggaggatcgcttgagcctgggaggtggaggttgcggtgagctgagatcgtgccactttgctccagcctggatgacagactgagaccctgtctcaaaaaaacaaaaacaaaaacaaatcagaatggagcttataataatcacaccgtagctaagacttgggcactgctgatgtcccaggtgctgtgctagatgcttcctgcattattaccttgtttactcctcacaccaagctgggaagtcggtgttatgtggttattcccattttgcagatgggcaaacacaggcttagagaggatcgaggtcatcctgccagcaggtgagatttaactccaggcagtgtggctcttcattgccgctgaccctgcttaaactggaagaatgattcagatgggagtcatcttcccagctggctcctagtaagctgatgtcattcctggcatttaagctgcacccagccccagtgttaggaagacgcgctagaggagacacattagatcctttttgtgctgaatgaacttgttggtgtttataagaagaagacagaaccctagtggcttcatgctactccaggaccaagtccagattctcgccagccacccagcgcctgtccagcccagcccagcccagctccagctccagctcccaggtcttctcccttggcctggccatggggtcttcgtttgctttctgtgggtcccatgatcttccttggctgaaagccctcacgtcccctgttctctctgatctgacaactctctgccctgttgacttaaatgttgcacctccagcagggtgggggcccctctttgcccattggcaccatcatgtccctgcattcctgtttcaggttgttggcacagttcctgtcttcctggggtgtggtgcattcccatttcactgggagataatgatgaccatttacagtgatctttgtgtatttgcccagcaagcaagaggcagtctagtgtagtggttagggtgactgctcttgaggccagactgcatgggcttgaactgatctttctgggccctggagctgtgaccctggggaaggtacttccccacgctgtgcctcagtttcttcttctgtaaagcctacttaactcatagggtcattagagaattgagtgagttattaaatgaaatgatgtacttaaaactggacctggggccgggcgtggtggctcacacctgtaatcccagcactttggaaggctgaggtgggcggatcacttgaagtcaggagttcaagaccagcttggccaacatggcaaaaccccatctctactaaaaaatacaaaaattagctgggcgtgatggtgtacgcctgtaatcccagctactcgggaggctgaggcaggagaatagcttgaacccaggaggtggacgttgcagtgagctgagatcacgccactgcactccagcctgggcgacagagtgagactccatctcaaaaaccaaaaaccaaaaaacaaaaaagctggacctggtcaagccatcgagtgggagaaaatgtttgcaaaacacatgtttgataaaagactggggtccaggagatggagagaacttccgcaactcaagaataaaaacacagtcaacgcagtaaaagaatagatagataaagggtttgaacagacacgtcaccaaagaagattgacagatagccaatatgcatctggaaaagtgctccccgtcaccagccacctgggaaatgcacatgagaagaacagggaatgccccgcagacccatgggaaaggctggaagatgtggtgagaataggacagctgctactcactcaggctggagggatgtgcagtggtgtggcccctcaggaaatcagcttggtagtttcttttaaaatcaagtaaccatccttcctatgacccagcaattccagtaaatcttagatagatttgctcaacagaagtaggaatctgtggctgagcacggtggctcattcctgtaatcccagcactctgggaggctgaggcggacagatcacctgagctcaggagttcaagaccagtctggccaacatgacgaaacctaaaaatataaaaattagctgggcgtggtggtgcatgcctgtaatcccagctacttgggaggctgaggcaggagaatcacttgaacccgggaggtggaggttgcagtggcagtcaatatcgtgccactgcactccagcctaagcaacagagtgatactctgtcaaaaagaaagaaaaaaaaaaagtaggaatctgtaagaagactcttgtacaggaatgttcatagcagcttcattcataagagctggtacttggaaacagcttggggaccatcagtaggtgaatggatacacggacagcagtaattgacaggacggaatgatcctgggcagtgtcaaggaacaaggtgccggtacaggaaatcacccgagactctcaaaaccactatgctgagcaaaccaagacagaccaaaagagtacacactgtgtgatttcatttcatttcatttttttcaaagatgagatctcactctgatgcccaggctgaagtgcagtggtgcagtcatagctcactgcagcctcgaactcctggcctccagtgatccttctgcctcagcctcccaaggagcgaggaccacaggtgtgtaccactacaccccgctaatttcacttttacaatgttctacagcagacagagctaatctgtggtggttgcctctggggctgtgggcaggagttgcttggggaggagcaggagggattttctgttgttatgaaaatattctttacagtgagagtggtttgagatacgcaggtgcagcatttgtcaaaactctgcatgtgtactttaaatttgtgcatttcatggcatgtaccttttaactccaaggaaataaaagaactataaataaatactgaactctaattagtgatgtgtgtgattagagggaaaagtactgatgtctgcaacttactttgaaatgtgttaaaaaaagatgatatggtagactgaatagtagtaccaaaaatgtctatattccaatacctggaaactgagaatatgttctcttatgtggtcaaagggaatttgcaggtgtgattaagttaagaaccttgagatggaattagcctgggttatttgggtgggcccagcgtgattaccagggtccttatgagaaggaggcaggagggtcagagtcagagagaagtgaccatggaggtggaagttgcaatgatgtggggccaggagccaaggaatgtgagcagcctctgaaagctgcaaaagccaggaaattgatttcctcctggagcttctagagggaatgcagccctgctgacaccttgattttagccagtgagacccattttggagtcctggcatccggaaccacaagatagaaatttgtgtcgtatggaggccgggcgcggtggctcacgcctgtaatcccagcactttgggaggccgaggtggacggatcatgaggtcaggagatcgagaccacggtgaaaccccgtctctactaaaaatacaaaaaattagccgggcgtggtggcaggcgcctgtagtcccagctactcgagaggctgaggcaggagaatggtgtgaacccggaaggcagagcttgcagtgagccgagatcacgccactgcactccagcctgggcgacagagcaagactctgtctcaaaaaataaaaaaaaaaagaaagaaatttgtgtcgtatgaagtcccacagtttgtgggaattatttccagctgcaattggaaatgaatgctgatggattgctggatagatagagggatggacggatgtggaataaaacaagtatagacaaaggtgggtggtggactgtaggctgtgggtatacaagtgttcacttcaaactttacttggctgggagtgggggcccatgcctgtaatctcagcactttgggaggccgaggcgggtggatcacttgaggtcaggagttcgagaccagtcttgccaacatggtgaaactccatctctacaaaaatacaaaaaattagctgagcacagtgacatatgcctgtggtctcagccacttgggaggctgaggcaggagaatcgcttgaacccgggaggtggaggttgcagtgaactgaaattgtgccactgcactccggccagggtgacagagcaagactccctctcaaaaaataaaataaaataaagttctttagatgtttctatgtgtttgaaacttttaataatgaaatactggggggaaatgactgggcctgatacataataaaagccctacaggccaggcacagtggttcacgcctgtaatctcagcactttaggaggctaaggcaggaggattgcttgagcccaggagtttgagaccagcctaggctacatagtgagaccccctctctaccaaaaaatagaaaaaaatagccaggcgtggtggcccatgcctgtggtcccagctaccccggaggctgagggggagaatggcttgagcatggaaggctgaggctgcagtgagtcgagattgcaccactacattccagcctgggtgacagagcgagaccctgcctcaaaaataaataaataaataaatacatacatacattcatacataccctacataggtgtcagcctttgttctcattggcatctcatctccattcttattgccaccacggccactcccccactttatccatcaggtggagaagaggcctgggaagagaagagaccaggggctgggttggtggtgagcagacgaaataataaacatacaatgaggccatatgacatattgggagaattgctttcacttaagaaaatctaggctgggcgcggtggctcatgcctgtaatcccagcacttttggaggccgaggcaggtggattgcctgaggtcaggagtttgagaccagcctggccaacaagtgaaaccctgtctctactaaaaatacaaaaattagccaggcctggtggtgggtgcctgtaatcccagctgctcaggaggctgaggtgggagaatcgcttgaacccgggtggcggaggttgcggtgagccgagattgtgccacttcactccagcctgggtgacagagcgagactccgaagtgaaggggctggggctttggaactgtagaggctcatctccccagtaagctgtcacttgtgatgtggttacagctgtaggcatttgcagagatgggacgagaagacacgccaccctgggaactggcccgtgtcttcacacgtcctgcactgctgctgctgagaacgtctgcactttgttaggggaagagagtgttttagttaaatttatctggaaaacatattattagtataatgagattttaatgatttgaaattttgttggagcagcgcagggagaatttcaatcttaactgtgtgtgcagctgggcattgtttctattttattttgtttctttgcttgggcctcattgcaaggacatgtttctacaattattatttagtttttctttcctagagccctgctttgttacagctcttaattttcttgtgtagaagatctgctggagaaaaaagaatatcctttttgtaaatacttagctggcttgatcagaaccagagaatgagcgttgttaccgaaggagacttgtgtttgtttaaggtttactggcgcactctgtggttgccgtggagtggacccaacccagatgtccgttaactgatgagtggataagcaaactatgctccatccatacgatagaatactattcagcaacgaaaaggaatgacatatggatccatgctacaacatgggtgaatctggaaaacaggctcagtgagggaagccatttgcaaaaggataaatactgtgtgattccatttatttgaatatctagaataggcaaattgatagagacagaaagtaagattagtggttcccaaagcctggggaaggtacagtgacccctcatgggtacagggattattttgggggtgacgaaaatgttcttacattgacaatggtgatggttacacagctctgtgaatttactaaaaatcattgaattgtacacttatttatttatttatttatttattttgagacggagtcttgctctgtcgcccatgctggagtgcagtggtgcgatctcagctcactgcaagctccgcctcccgggatcacgccattctcctccttggccacccgagtagctgggactacaggtgcccgccaccacgcctggctaattttttgtatttttcgtagagacagggtttcaccatgttggccaggatggtctcaatctcctgaccccgtgatccgtctgcctcagcctcccaaagtgctgggattacaggcgtaagccactgcgcccagccgaattgtacactttaaaacggcaaattgtatggaatgtgaattctgtctcaataaagctggtaaaaaaaatagcgtggtactgagaggcagcgctcagagcttgtgagatgtttttctccagttggtattcgttgcatgtttccaaggtgagatctttcaccttggggtgagggcgggtggatccgggacagacatggaattttcagtcttcctcctcctcctcatcttcctgttcattgcccctgcagtggtggcagctgtcccatatcaaggtctcacactggccaggggctgggcttggtgctgtacgcagattgtcttattaggactatgaggcttttgagataggtatgataatatgtcctcattgagcaagtgacaataggaaacccccagaaattgtgtgcactgttttgcctgatctcacacactttggacagagactttgatcacattcttaggggcccacaaatggtcaaaaacctctgaactgagacagcagcattttttgtggtttttttttttttttttgagatggagtctcgctctgttgtcaaggctggagtgcaatggcccgatctcggctcactgtaagctctgcctcctgggttcacgccattcttctgcctcagcctcccgagtagctgggactacaggcacccgccacagtgcctggctaattttttgtgtttttagtagagacagggtttcaccgtgttagccaggatggtctcgatctcctgacctcgtgatccgcccgcctaggcctcccaaagtgctgggattacaggcgtgagccaccacgcccggcctgttttgtatttttgagatggaatctcgctctgtcgcccaggctggagtgcagtggcatgatcttggctcactgcaacctctgcctcccgggttcaagtgattttcatgcctcagcctctagagtagcttggactacaggcatgcaccaccacacccagctgatttttgtatttttagtagagacggggttttaccatgttggccaggtgggtctcaaactcctgacctcaagtgatccacctgccttggcctcccaatgtgctgggattacaggcatgagccactgtgcttggcttgggagagcaacttttaaactctctttttattttggatccatggtaagaaatatatttccataaaaaccccagttcaagcatacatttacctatatccatgaataaaagtttcatgaaatgatatcttcctataagcacactgacgtttgctactctactgttctttcatttcattaaagaaacgtgctgtccaggcaatctcagtactttgggaggccgaggcaggaggattgcttgagcccggtggtttgagaccagcctggtcaacatagcaagaccccatctctacaaaaaataaaattagtctggcgttgtgttgtgtgcctgtggtcccagccacaggtgcccctgcaggggcagggggctttcaggtgggaggatcgcttgagcccaggagtttgaggctgcagtgagttatgattgcaccactgcactccagcctgggtgacaaagagagagtctctgtctaaataaataaataaatacatacatacataaaatatgctagtcacagtttcctaaatggattttatgactcattgagtcaaaatgatagttttaaaatgttgctaagagagatgtaaggaggaaaatgtgttggtgagtgttgaggagcccaacttcttttgagaaatcattgttggatctggtgtctcatgtgttaccctggggtttcaactcctgtttgctcattcagttattcattgatcaccctgtcttccaggcatgcagtcattcattcaaggtgattattgagctccccttgagagcaggtatggggctgggggttggagatccagtgagtggtcctgcttgagagactggccctgcccacatggcactagtgggctgggactctcccatcactcttgtctccatcttgttgtgcactgttgatgctccattgaatgatcttggcatctttgctgaaaatcagttgatcatcaatgtatggatttatttctgagctttcaattctattatgttgatcaacaggtctgtctttatgttagtactacactgtctctatcactgtagctttgcagtacgttttgaaattggcaaatatgacacttcccactttgttcttcaaccttgtgttggctatttgggatccctcgagattccgtatgagttttagggcgtgattttctatttctgcaacgagccaccattggaattttgggaggaattgtactgaatttgagaattgctttgggtagtatctttaacaacacgaagtctgccagtccatgaacataggatgtctttccacttccttaagtcttctttaatttcccttcgcaatgttttgtggttttcagggtacgagtctcttgcctctccaggcagatttatccctgggtggcttatgctttcggatgctgttgtcagtgggattgttgtccttgccagtggtcgctgagcccagctgcagccttgtcttgcactgcagggtgtctgtgtcacctacttgcctagttctggccacttttcttgcaggaagtcagaagtgtactgatctggagtaggacccttagcacaacagagctgctccttggtgctaggagatgcgtcctgaggctggccatccatgtcagaggacctggcgcctcaccctcatcatgggatatcactgaccaccagtgggggatgcatctctgctgggcttggcctgcaaggtaggagctgactgcaggagtgggaaagagcccatggcccctgagggggcctacagttggctctcctgtggttacttggcatgtttgatagacgcctgggtctggcacagagaacactgcccgctgacaatcattgagcctcggcaggctggccccgatgacatgttatctccccacacagtccctggacacacttgattaaaggtgcttattactttcatagtgttggctggagtgatgtgataactccacaaaaggttctggcagaatcccagaccttggggtgttcccaccagtgtctctgtgttcaaagttcagcacagtgtggggtggcaggagatgggaacttggagactgaggccagagtctgctgacttgagcctctgctgaggtccttatcagtgccgggagagcagcagcctaatctcaagatggtttagaggatttagcgggggcgtgcatgcagagttgagaactggctcctgggtcggtgtgcggggggtggggatggcccgggggccgtagctacagtttgtcttccttcccccaccggcagaggtgaagagaggtgttttgtcctggagccaccaggcctatccatggaggagcagagcttcacatggagcctgtgccccgtcttagtctatttcgtgttgctataaaggaacactaaggctggctaatgcataaagaaaagaggtttacttggctcctgtttctgcaggctgtacgtggcactggcatctggttctggggaggcctcaggggcttctcctcatagtggaaggtgaagagggagcaagaaagggagaggaaggaggtgccatgctcttttctaagaaaacagaaacacagctgcattattttaagcaaaacacatattggcttaggtcgctgtattcatctcccagggctgtggcaccaaggcaccagacactgggtggctctttgggaggccaaggcaggcagatcacttgaggtcaggagttggaggccaggctggtcaacatggcgaaaccccatctctactgaaaataccaaaattagccgggcatggtggcatgaacctgtaatcccagctatttgggaggctgaggcaggagaatcacttgaacccaggaggcggagtttgcagtgagctgaaattgtactattgcactccagcttgggcaactgagccagactccatctaaaaaaaataaaaaataaaaaacccagcagaagtggattctctcacagttatggaagccacaagcttctaggggttagaattccaacatatctttttttggggaaagaggggcataattccccatagaagagcctgtaatctcagggagccttgacccaggtatttgacgttggtgtaatctacttgtgtatgtgtattggtggacaaaggggatggcctcacatcccttcagcatcttgggggtgggcggtgcctcccctccggctcccctgagtcagccccggggaagaccaattgtggggctggatggtgtgggaacccccagctccgtcctgtctccagccatcagtgaggtgtgcttggccattccccacaggaccagtgggcgggatggggcagctttgcagttggagaggatgggggttcaggcaggcagaacagatgcgcggacacagaagagctgtgcagaatgtggagttgagcttcctggaaggcccataggagaggcgagactgaaatcttcttgatactttttcactggggcctgaaagcctggtgcagaatgaaactgaaagcacttgtctcgttgagcaaatcattcaactttgttatttctgtaattgaaataattcctggcattaattatgtggagagcactcatgaccatgtggacatatcttttgggggcacatgaactgagggtaataatttcgctcgaattttttttttgagatggagtcctgctgtgtcgcccaggctggagtgcagtggcgtgatctcggctcactgcaacctccacctcctgggttccagcaattttcctgctctagcttccccagtagctgggattacaggtgcccaccaccatgcccggataatttttatattttttaattttatttttatttatttattttttgagacggagtcttgctctgtcactcaggctggagtgcagtggcacaatctcagctcactgtaacctccgcctccaggcttcaagcgattctcctgcctcagcctcccaagtagctgggatgacaggagtccgccaccatgcctggctaatctttgtatttttagtagagacagggtttcaccatgttggtcaggctggtctcaaactcctgacctcatgatccgcctgcctcggcctctcaaagtgctgggattacaggcatgagccactgtgcctggcctaatttttgtactttaggtgggatttcatcatgttggccaggctagtctcgagctactgatctcaggtgatctgtccactttggcctcctaaaatgctgggattacaggtgtgaaccactgcgcctggcctatttcactccattttgccgaggagggaacagaagtgtggagtcctcccagccacatggcctcggatccgggctgcaggtccaggctttccggctccagggctggtgccctctgtcctgtgccacttcccctgcaaaatgagatgaaaatgagtctcattttacgatgaggaaactgaggccctgagagagggtgagaaaccaggtctctggctgaatgcacctctcactgaagacatctccgggtggaaatgttctgagagctgctgtgtgtgctggtgtcagaatgaacaatacccatagtgcttggcgtagacaatcagcaaagctagggacccgttttctcctcccagccccctttctcacttcaggccctagacaagaatcggaggtccgtttctcaagtttagctcctgtctgattaaatttgaggttcgtttctcaagtttagctcttgtctgattaaatttggatttgctccactctttttcacgggcataaaaatatctgcggagtgaaaatgtgtgcagaggatgcactgcgtgcaggctgcggctcgaggtcaatcagattcctccagcgataaaaggcctgctgaggaagcggccccactcccagcacagccccattgattggcttttattttcctctgttgctggagtgatccaatttgaagccctgtttctgagcatgttgcaaggaaccctaggggctgccatagccctggagatactggctggaaatcaaattcaaattggtgctttcttcctattaaagcaggagacctctgcccgggaacgggccatttgggggctcagccatctggcacatggagtgagtaggttttattgccaaagccgtcccggccttggcctcagcctctgtgtggctctggtggggagtgtgtctcgatgttgtactgtgaataagccccatgcctacttgagtttggggtttctgttttacctacacttccatattgtgggcatgtggctgcggaaatgtgcctgcacctggactcgctgtcactcactggcttctcgtggtacagcctagggagggttgccccagccgtatttagttcttcctgcctcagatgaacgggcctcctctcccagctcctaatcaggagggcagagtctcgttggcggctctcctgtcctgctgccactgcctttacacttcttcagatatgcggccgtcttaaggtgtaaatgccttcctctgtttcccagtggttatctaaagcaaggattggcaaacagaatccacaccatagatttgaggtatgtttgttgtcctctttccttcttaaactgttagtaaacaagacattcctacaggtgacccctttcggcctttttttttttttaagactgagtttcgctcttgttgcccaggctggagtgcaatggcgccatctcagctcactgcaacctccgcctcccgggttcaagtgattctcctgcctcagcttcccaagtagctgggattacaggtgcctgccaccatgctaattttgtatttttagtagagatggggtttctccatgttggtcaggctggtctcgaactcctgaccccaggtgatcctcccacctcagcctcctaaagtgctgggactacaggtgtgagccactgcgcctggccagtcctgcactcttcaagtttctatgtgttgcagactggtggggtagcaatatcagttagagagacaggactggggtcacttgtcccctgttagctcagtgaccttgagctcagcttagacacattgtctctgaacactgtgctgatggcaacacctctctcacctgtcttgcagtcttatttgaggaattaaatgcaataacctgggagaaagtgcaggtatgaagtcagggcacacagcccgtcaccaggagcttgaaggaggagaagagtgggtggggatgtgagcacagaagctgaggcgggggctgagccgggtgtgtatttctgcctgtgccacagggacacccctttcaggcactgggcgcctagctcctgttgtctcatctcctaagagagtctcgggaggcctgagactccctcactgctgcgggcttcaagagcagcatctgtgctgagtaacagccatgggggcagaagcagagatctcccgtgacagagtagttaggcagccgtaaaaatcctaccaccagctcgtggaaaaggtctcatttgacaggtgccatgccgtcaaagacttgtgctctgcagctgcaaattcccaactgaaaaatatcaacaattcttacgaagagagaaggggagccctgcaaagctgttgtgtcaccccgtctgtttgtaggcgctggggggattgatgatgaggtggggactgttcggctggccacactgccattgtagatagcctgtgactctgtggctggcgcctggctggcctcagtgaagcccttcagtcccagctctgaccatgtctctgtggagagacaagcaggtgatagtgttgggtgggcaaggctgtgctggtggcctgcttagcaacagcaggaaaaggaaggagataaccaccccaacctttcttgctggaaggagcccttcctgttgtcggcgctgtgtgtaaccaatgaggcgaatgccgggaagcgcttggtttgtgtcaatgaggggagaggattgtgcagaagtgcaggaagggaccatgggaggaaattgagtgaaggtctctgttaggggtttgtgttcccctaaaaggtatgtccaggtcctagtctccagcccttgggactgtcaccttatttggaaatagggtctttgcagatgtgcttaagacgaggcctgtctgaagtagggtgggcccctaattcaatgtgactggggcctttatggggagaggaggcaggacacagacagacacgggacacagaggctggacagagattggagagatgctgccacaagccaagatgcaccgaggactgatggccaccaccagaaactgggaagaggccaggacggatcctcgcctggagccctcagtgagagcacggctctgccgacaccttgatctcagacttctggcctccagaactgggagagaatcgacgtctgttgttttaagctgccagtttgaggtactttgttaaggtggccacaggatgcgaatacagtcaccatctggcctttgatcttctaattgcctcggcggttctcctgccagtaagggttgtgagtgaaacttgaaggtcacagttggaaatcaagttaaaagaattaagctggaagtgcaacatgagagtccgtcaccctgagaggcggtgtgaatgccaaacacaggcaggcagggctggacctgcataaattgtggttcgacagcaccgggagaaagaaggcccgggcctgctctcctcacctgattctgggaatgccgaacctacctgtgttcctgatatcaccccagtgctaacttcccaccccttgaaaatgtcaaaacattgtgttatgaatgttcttcattgagcaactgcgatctctttctgtaaagatccagagaatatttcagcctctgtgagccatcctgcctctgtaggaatgaatcaactctgccttggaagcatgaaagcccctatagacagttcataagcatagccgtggctgcgtccccctgaagctacaaaagtaggtggggggctgggtgtggtggctcatgcctgtaatcccagcactttgggaggctgaggcaggcggattgcttgagcccaggagttcaagaccagcctgagcaacatagcaagaccctgtctctacaacaaatacaaaaattagttgggtgtgttggtgctcacctgtagtctcagctacttgggaggctgaggtgggaagatcccttgagctcaggaggttgaggccacagtgaactgtgattgtgccactgcaccccagcctgggagacagagcaaagccctatctcaaaaaacaaaacaaaacaaaacaaaacacccaaaaagacaggtggtgggccagatttgctcactggctgcagtttgccaatctatggtttaaaccaacaatttaaataacacacacacatctttgtatgatgttacacatcttttttttttttttttttgagatggagtcttgctctgtctcccaggctggagtgcattagtgtgatctcggctcactgcaacctctgcctcctgggttcaagcaattccccttcctcagcctcccgagtagctgggattagaggcatacaccacctcgcccagctaatttttgtatttttagtagagacagggtttcaccatgttggccaggatggtctcgaactcctgccctcatgatccgccctccttggcttcccaaagtgctgggattacaggcatgagccaccgcgcccagcctgatgttacattttctagaagttctcagtgatgggcatttaaaggattcggctgctgctccctgtggctttcacagcgctgccctgaatgggtgttagggcaccgtacaggtagcggggatgcctgggaaagcccagactcacagcaacacaacaacagttaacagactccagtgaccaaatgtgtgggtttttcctgcaccaactggcggataccagctggatgtcccctagttcaattcaattcagttctgactccacctacctggagatggcatcagatcccacagggtgagggctcagtctcccaagactctgaacagtggctgtaagtcagggttcccacagccccatctttgggttcaattaatttgctagggtgactcacagaactcggggaaacatttacttatatttcctggtttattataaaggatattacaaaggatacagatgaggagatacatagggtgaggtgtagggaaaggggtgcagagcttccatgccctctctgggcgtgccactttgccaaaaccaagcatccagtctctggaagctccctgaatcctgccttcctgggccttttatggagcctcattggatatgcacgattgacagccatgtagaaataggattggacagcaagggtgtgatctaacactaacagatggactggggaggccctgcaagacctatctgtgcagccttccttcctccaaggtgtgggggcccctctctggagtgagggtctcattacttacaatctgatgagagtcctgccttgggcaggtgaaaggagggcagaaggttagagagattctgttttctgaggctaaagtgccccaacatcttttattattattattatttttgagacagggctggagtacagtgatgcaatcttggctcactgcaacctcacctctcgggctcaagtgatcctcccacctcagcctccctagtagcaggcactacagccgcgcactacaacgcttggctaacttttaaattcttttgtaaacacaaggtcttgctatgttgcccaggctggtctcgaactcctgggctcaagcaatcctcccgccttggcctcccaaagtgctcagattacagcatgagctcctcagctagaagagttaaactcatagagagaggaagtggaatggcagttgccaggggcaggggttgggggctgggcagggaggggacagggagttagtgtttctgccttgcaagaagaaaagagtttggcggataacagcgatggtggcacagcagtgaatgtccttagtgccactgaaccgtacacttaaaaatggttaaagtagccgggtgcggtggctcacacctgtaatcccagcactttgggaagtcgaggtgggcaggtcacctgaggtcaggagtcttgagaccagcctggccaacatggtgaaactccctctctactaaaactacaaaaattagccgggtgtggtggtgggcgcctgtaatcccagctgctcgggaggctgaggcaggagaatcacttgaacccaggaggcagaggttgccgtgagccgagattgcgccattgcactccagcctgggcgacaagagtgaaactccatctcaaaaaaaaaaaaaaaaaaaaaaggttaaagtgagaaattttatgtattttatgttaaatgtaccttactacaattgaaagaatgaaaaaaaaatactgggaaatacattacacatacaaaagagtgtacatatgtatagtttactgactaatattaaggaagtacccacgttcctgctatccagcttaagaaataacattacctgttccccgagccatatgccccgtacctcctgtgcgcctccctccccaccagaggtgaccagtgccgccttgaacgttgcatttagcatgttgtattagttagagttctctggagaaacagaaccaatgggagatatgtagctctctctgtctctttttttttttgagacagagtctcactctgtcgccaggctggaatggtgtgatctcggctcagtgcaacctctgactccctggttcaagcagttctcctgcctcagcctccccagtagctgagattacaggcactggccaccacacccggctaatttttgtatttttagtagacacggggtttcaccatgttggccaggatgatctcgatctcctgacctcgtgatccgcccgcctcggcctcccaaagtgctgggattacaggcgtgagccaccgcgcccagcctgtctctctgtctgtctctatccatctctctctctctctctctctctatatatatatatatttgaagagattgattataagttattggctcatgtggttacgagactgagaaatcccaggatcttcaagctggagacccaggagggccaatggcgtcagcccaagtgcgggaggagacccacgtcccagctgagtgaatccccttaccctgcctttcggtctattcaggtgtcaaatggattggccgaggcctatccgcactggggagggccatctgttgtacccagtctaccgattcgaatgctaacctcatctagaaacaccttcacaggcacgcccagaataatggttagccaagcaccaggccgctccccacccagtccaggcagctagtcagcaggccctgccccacttgcttgtctttccttgcgttttgcacacgcatgcatctctgtccctcactttctttagttttgcccgactttgaccccaatatgacgggagccccaccgtgcgtgctgtcctatgactcgagtttacgcagtagcctagctttggggcacagccccatttacttggggcaccgctgcctctgctgtgtggccgtgtgggatcccacaccaggagcaccgtccctttgtcacctgggaggggtgattctgtgcctgagttgcatgtggatttcctcctgctgagttttaattaagaggcagggagcaggtgggtgaagggcacacacacggatgcagcgttgcccgggttcgaattctgcctgcgccatttcctgcctgctgaaccagatcggacaaattactctacctctctgtgccacagattttttgttgttgttgttgttttgttttcattttgtctcgttttgtttttgtttttgagacaggttctccctctgtcacccaggctggtgtacagtggtgcaatcacggctcactatagcctcgaccctgtgggcttaagcaatcctcccacctcagcctcctgagtagctgggacgacaggcgtgcacagccacacctggctaattttttaattatttgttgagatggggtttcactatgttgcccagggtggcctcgaacccctgggctcaagtgatcctcctgcctcagcttcccaaagtgctgggattaagtgtgagccacctcatctggcctttgtgccccagttttctcaatcaggtaatgatgatagctctcaggtggtgagggtgactgtataaaatgtctggaaatggcacctgctctgtgcccaggggttagaggcttgggaccgagctgggggctgagctgggggtggagctgggggctgagctgggggtggagctgggggctgagctgggggtggagctgggggctgagctgggggtggagctgggggctgagctgggggcgtttttgttccaaggctttcttgctgataagtttctctttctctctctctcttttttttttgtcctgcgtgtctcaacctgacaaaaatgctcagtttagaagcgtgtcgttccatttgtgggaaaattaaacacatttaagagtaaattaaattaggggacttgtgatcattagctaagtaaattattttttaaaaatgtgatgtaccaagcatagcacatgtggcacgctcaataaatatttgttagaatgaatgataattttatgagccagtcgagtcatatataatgggattatttggttctagaactaatgaagtgactgtagagcaataaagcttctaaaaagaatctccgtgctcgcaaaaaatccaaaagtgggggaagaggctcatgctggatttcacccaagagcgaggcccgaggagagctgggacgctgtgtcctgagagctgtccaaggggggcccttgtgacttggcaggggtggttttggagcctgagtttatccgcactctgggtggactgggtctcgggggaggcctgccttaggtcagctcaggagaccagtggatatagcaggaggcccacttgcagttcacggtttgtcttgccagatgtgcagggggcccggtgtctcagcacttggcacctgtgggactgagagaggagtcagtctagcaccagacacccgcttggtgggggaggggagtggaagaggagggagaggagagagagggggctggagccccagtcccacagcttaggtcctgggaagccctgtgggttcatgcttgccttgaggggaggttggacggctcaagcagggaccaggagcctcccagtgtggcatgagctttgctggaagcctgggctctttgagaggggtggggctgagagccgctagacctggcttcatcctcctgcctgctttcctgtctggggtgtaccctgggaagggacataacttccctgaacctcggttgcctcccctgtccagtggaggaaaggaaggcacctgcctaactgggctcttgaaaataataaattgagataatacaaaatctgcattaatttcctaggcctgacataaaagagtaccccacactggctggcttacagagcagaagtttattctctcccagctctgaagaccagaagtccaagatcaaggtgtcagcagggccttgctccatctaaagtctccagggagggatccttcctgactctcttggcttctggggacggtgggcagtcctggcatatcttgatttgtggccatgtcactccagtcagcctccattgtcacaggtgtcccccttcatgcccctctgtgtcttcctatggtcttctctctgcatgtcagcatccaaatttctctctcccatgtggacaccagctgggcccaccgcagtccagtatgacctcatccgaacttgattacatctgcaaagaccctgtttccaaataaggcacattctccagttgtccaattccaggtggacgtggatttttttttttttttttttttttgagatggagtctcactctgtagcccaggctggagtgcaatggcacgatcttggctccctgcaacctcctcctcccgagttcaagcgactctcctgcctcagcctcctgagtagctgggattacaggcacctgccaccacacctggctaatttttgtatttttagtaaaaatggggtttcactctgttgcgcagggtggtcttgaacccctgagctcaggcaatccacctgcctcagcctcccaaagtgctgggattacaggcatgagcctctgcgcccatcggacgtggattttggatgagacaccattcaacccacagtacctggtgctcagttagtgactaaaacccactagttatggtcactcagtcacccttcttgttattactttcatagatgagggtgtgatgggggggggaaacagaagcagagttgattgtatcttcttagttctgcacaccctgtggcttttttttttttttttttttttctgagagggagtcttgctgtgttgcccaggctggagtgcagtggcacgatctcaggtcactacaacctctgcttctcacatttaagcgattcttctgcctcagcctcctgaatagcgggcattacagacatccgccaccacacccagctaatttttgtatgtttagtagagacggggtttcacaatgttggccaggctggtcacgaactcctggcatcaagtgatccacccacctcagcctcccaaagtgctgggattacagacatgagcctctgtgcccagccccgtggctagttattagactgttctaggtcttgatgggaaaggggaggaggacttgttcttctctttggattaataaaacaccgtgaggcttgtgtttgcacagtgcccacagcttgcacactgacaagcccttttaggttgacttctgctgagtcatttcatcctgttccatttgtcagccataaggtaaggagcagtttttctgatgtactccttttgcataaatgctactctccatcagcctcgagaagtagaaggcaccggtatggtatcccaagctcattcacaggggagaagagatgcctgttgccacaaaatgtgaatgttgggtgtacattcaggtgtcacgtacgtggtgttgattgtctcagcttaataaagaaagatgccgtacacattttcctttaaaaagtctcacttggcttgtttgacaggcacagaagatgtgttattaaacacttgcaaagcctgctgtcatttggttttaaacagcactcgtcgtctttggcggggcgtgtttgctcagcatcatggaagggggatgtgaggtacccaggtggcagtttctctaccacgatgctttctctgcttgctatcgggagaaatgttctttcctatgttgtgggaaggcggaaagggcactctgaaatgtaaggtggccttttgtattagaatttcatggctgagaccaggcgtgggggctcatgtctgtcatcctagcactttggaaggccaaggcaggtggatcacctgaggtcaggagtttgagaccagcctggccaacatggtaaaatgccatctctactaaaaatacaaaaaattagctgggtgtggtggcagccacctgtaatcccagctacttgggaggctgaggcaggagaatcacttgaacccaggaggtggaggttgcagtgagctgagattctgccactgcactccagcctgggcaacagagagagactctttctaaaaaaaagaaaagaaaagaatttcatggttgattgtcacaggaccatctttagtcccaagatctgaggcaagggaatcgttttcaataggaaacttttaaatgtttgagcagcagaaagggagattgagccagaagaacttgctggtggaaagatggtggaagctgggagctttgaggttctaaaaatcctggtgtgtcaggtcaggtagtggggcaaccggagcttagggtgagttatacctgatgggacttaactgggtaaatgtcatctagtaacccaactacattcggcattaatatctggacaaaaggtggaatacacccgggttctttgggcacaggcgaaggagaggtctcatagtttgatgttgctcaagaagggaaaacaagcaggatgggaagaggtctaatcagccggctggagtggggtgctgggtttagttcattccttcttaaactcagccagttctcattattcatggtggttttgatctataaagttgccacaaaccccaagttagccaatactgagccatcactcctagggcagtacagcgctcggttcctgcgagcctctggtcacaacattttcagcaacagatccatacataactttttcttatatatgtttctttttaaagatacgttatttaaaatgtattgttgattgattaacattgagctcacggccaacagcagtataagtgctgcctgaatgaagcttctctgacctgtgcgttctctgcaaggcatacctcagccttcttgcacttgggaacactaggagtacccctcgccacgcgtggggacccattttaaacagcaaagttggctgggcacggtgactcatgcctgtaatcccagcactttgggaggccgaggcaggcagatcacctgaggtcaggagttcgagaccagcctagctaacatggggaagcccagtctctactaaaagtacaaaaaaattagctgggcatggtggtgtgcttctgtaatcccacctattcaggaggctgaggctggagaattgcttgaacccaggaggcagaggttgcagtgagccgaagtcacgtcactgtactccagcctgggcatcagagcaagacttcatctcaaaaacaaaacaaaacaaaacaaaacaaaacaaaccaaaacagtgaagtcaccaacaaatagcagaaaaatgtgaaaaacatggcattaaatagaccatgaaatggacacttgtttatgatgtgagacctcagacaagaaggcagagcgccccgtgtttgacctcaggtggggacacatccggcaactcagattcttttttttttgagtggagtctcactgcgtcacccaggctggagtgcagtggtgcaatctcggctcactgcaacctctgcctcctgggttcaagcaattctccagcctcagcctcccgagtagctgagactataggtgcgcactaccacacccagctaatttttgtatctttagtagagacggggtttcaccatattggtcaggctggtctcgaactcctgacctcaggcgatccacccgctttggcctcccgaagtgctgggattacaggtgtgagccaccacacccagtcagattctttgcttctgtgtgcaggtctgtgaatgaatgtaggccaagagtattgattctgagcttacaaattttagccagtagacacatttacacatacagaatccatgaatcaaggcgattgactgtactttgacaattatttgtttagcactgtaggaggaacctgcaaactgttccttccctctgctcacatactgcccagggtaagacttctgacaccagaggtgcagggatgcttcctgccgcacctggcagttctccagcagacaccagctgggtgtcctgcagttcagttcaattctgacaccatcgacctggagagagcctcagaccccacaggtgagggctcagccccacgagactgcaccccaaatcagggtccccacgactgcttcctcggttttgattaatttgctgggactcagaacttggaaatgggccaggcacggtggctcaagcctgtaaccccagcactttgggaggccaaggcaggtggattgcttgaggtcaggagttcgagaccaaccgggccaacatagtgaaaccccatctctactaaaaatacaaaaattggttgggcatggtggtgggcactgtaatcccagctactcgggagactgaggcaggagaattgcttgaacctgggaggtggtgattgcagtgagctgagatcgcaccactgcactccagcctgagcaacaagagcaaaaccctgtctggaaaaaaaaaaaaaagaactcagggaaacactgcatttgtgctccctggtctattataaaggagatgataaagggtgcaggtgagcagaacaggaggaggcacacagggtgaggcctgggagggcccccagcacaggagcttctgttgccctggagttggggtgtgccaccctcctggcacctggatgtgtttacccacccggaagctctctgcaccctgtagttcagggatttttacggaggcttcatcatgtaggcatgtctggttattagttcaatctccagcccctctcccctttctggagggtggggttggggggtgtggagctgaaagctccaggcttctaattgtgtctgggtctttctggtgctcagcccccacccaggagccaccaagagtcacctcattagaataaaacatccttttatctccctggaaattccaagggattaggaactttgtgtcaggaaccagggtcaaagactaaatattagaacaaaagattgtcctggcacctggaaattacaaggttcttaggatctgtgtgccagggactggtggcagagaccaatatgaatatttcttttcttttctttttttttttttgagatggagtctcggtctgtcacccaggctggagtgcagtggtgtgatctcagcttactgcaacctccgcctcccgggttcaagtgattctcctgcctcagcctcctgagtagctgggactacaggtgtgcaccatcatgctgggctaatttttgtatttttattagagacggggtttcactatgttggccaggctggtctcaaactcctgacctcaggtgatccacctgtcttggcctcccaaagtactgggattacaggcgtgagccaccgcgcctggcccaatatgaatatttcttattattttacaagcacttgcggtgtgtcctgtggtctccgtcctcagcgtcgtggtttagagggtgcctgacaggcagggtgtggggttagtggggttggggagtgatttccggggcacagtgatccccagagtatgtgtggttgtccagttcactcactcctcgtggcctgctcggtgctgggggtccacactcacagagggcatggtctgtgccccttgggatcaggcagctgctcctggtacagatgagttgggagatgacttcctccagggcatgtgagaagctctcaatgaccaggccagctcggattcccagttctggccgagccgatgtgctctctgttgccacattccgtgtcacttcccaggcctccccggcttcccattctcggggccaggtgttccgtggatggggtgcggtgcggcctttgataccagaggcctgggatcgctttcctcctcggtttctgtgtggtcagtggcgccttcacctgtctcatgccctgccatgctgccatgcaagggcagagggctggtgttggggtggtgctggggcctggggagtggaatatcctgctctgttaagatgctggggatcgcatgtgtgatgctggccacgtcagccagtcttccttcctgccgagaccaccagccctcggtgcagccagccgtatcacctggttatagtcacgccgaaacccagctgtttggaagcgtggccgtggggccttggatcccttttcctttccacgtgttttgtggagacgaataacacaggcatgcgccgtgcccaggtggaggcaatgttaggaaagcaggaaggagctcagagcaggaaatgtgtgtggactcgcgtttgttgaagggcctggccgagttccccagaggctggggtcagtgttcaagttctgatgcttcacgtccttggaggccaaaggacgtgaccttgaagaaggggcagttctcacctgtgggcctaggagaggtcgttggccttaagacattactccaggtaattatatgtggttcctacctataatcccagcactttgggaggcagaggctggaggatcgcttgagcccaggatttggagaccaccctgggcaacaaagtgagactcctgtctctacaaacaaaaacaaaaacaaaaacaaacagttggctggatatgatggcatgcacctgtagtctcagctactcaggaggctgaggtgggaggatcacttgagcccgggaggtggaggccacagcaagctgtgatggcactaatgcacttcagcctgggtgacagagtgagaccctgtctaacagcaacaacagcagcagaacattaatccggatagttctaggatgagggttctcagagctagatgggcctttgcaagttctttccactgatccccaggtttggttgattgtatgaaaccaagaggaaatgtacagggtttttgtgaagaaaggaaagtgtcatttctttgggttttactttgaatggcattggatgaggtcctcagagcttatgtggggccagcccagcctgccccatgtgccccactgagaccctggaaacttggctttctcccactgctcccccagtgctcactgactagttttggggttttgtggggaccctttgtctatctgcttcgtcttccccagatgaatcaggggacgtggtggtaccatagtggtgctgagggcagcttctgggtgggggttctcagaaggagaagtctgtccaggaagattatattttattaccttctccctcatcttatttattttctgtttttttagaggctgggtctctatgttgcccaagctggtctcgaactcctgggctcaagcgatcctcctgcctcggcctcccaaagtgctgggatgcaggtgtgagccactacgcccagcctcccacctctttcttatttctttattgtttatttcaacaggtttttggggaacaggtgtgtttggtgacatgaataagctctttagtggtgatttgtgagattttggtgcacccatcacccgagcagtgtacactgcacccaatatgtagtctttttatccctcacctacctcccaccctttccccaagtccccaaagtccattgtatcattcttatgcctttacatcctcatagcttagctcctgcttctgagtgagaacatacgatgtttggttttctattcctgagttacttcacttagaataatggtctccagttccatttccatccaggttactgcgaatatcattattttgttcctttttatggctgattagtattccatggtgtgtgtgtgtgtgcatgtgtgtgtgtgtgtgtgtgtatacactgaaatttctttatccactcattgattgatgggcatttgattggttccatatatttgcaattgtgaattgtggtgctataaacgtgtgtgaagtatgttttttgtctgatgacttcttttcccttgggtagatacccagtagtctcctacttctttttaaaggaagccttgctctttcttaaaagctgctaaaaaggaatgagagtggcgctacagcaaacatctattgagcgcctactgtgtaccaggtgggtggctatggtggaatctaccacttcttaaaagtcaccatccaagttaccgtttttctgaaatactttgtctttcaactgagtgctttgtttttagtgatggccagtgaagggcccaattcaaacagaagcagagccgggggatactgaagggcctttctccctgtgagccccttagaactcaggcagaaatattttagcaaaaagtcgaatctgtacttctctggcttttaatgggttatattgaaaaggatatgacctgcctctaaggttgtaacttacgtttggctcagtcttaattatcttaacaaggggtgcctccccacccatcatccccataccttgtatttatgcatgtattgacttttctcccactttgatagcttgaaggcagggctgcagtgtttctcaccttggcaccccaggcttgagtgatgcctggcacacagtaggtgcacggcacacatctgagttgagatcctgatacgcaccctgtataagaccttcaacagcctgtcgaccactcactgcctccgtttcctcatctgttagatagggatgatcataagggttctttcttgcttgccttatggggccttgatgagaatcaaatgaaatgatgacatcagtcccttaattatttctcctcctcctcctcctcctcctcctcctcctcctcctcctcttcctcctccatctcctcctctcttcttcttccttttttttcttctttcttctttctttttcttcttcttaggcagggtctcactctgttgcccaggctagagtgcagtgggatggtcataggctcaagtgatcctcctgcctcagcctcctgaataactggaactacaggtatgtgccattgtatctggctaagtttttgtagagacagggtctcactatgttgcttaggctggtctccaactcctgggctcgagcggtcctcctgccttggcctcccaatgtgctgggagtacaggtgtgaaccactgtgccaggcccctttaatttattctgaaaatggcgtgtcaggagctgggtcttggctgccttgcttgcattgtgaaatccccttgcctggcaggtaggaggcagtcgatgcatacagggtgagtgaatgaaatgttagttagttgcattacattgaagtggtctaaacctgactctaagatgtgactactaggctgctgatccttttatgatttttcaagtgcgtagttattttccttttaaaagctaatcacatttcctttcctgactgatcctctgttatttctgcctcctcccccaaggggctgaccaccagccccaggcatctccttggccagctcagtggatacacacacgtcaggaagaccctcccttgccccagccttccttcgtgggtggcactggacactgggcagatggaaaggccctctccatggagcactgggctggcgagggccttcctgtctgtgccctcatgatgtcctcacttggctgtcgaggcatctcctgggccatgaagtgctgtttgctgtcctggccttggattcctgcatcaagtctcccagcaggaaaactgttaaaccaaaaccagtgttgggaactgcatcagagctggggaccacatcagtgctggggacctggatcagcattggggacctggattagccctggggacctgcattagtgctggggactcgcatcggcattgggtgtctttttgttgcttcctcaagtcctagttttgactctggatgaagcttggtttgtgccgtgggagtggagtgttgggggacaggggtgaccggcgggtgagccctcactgttgatcctggcctcgaatgggagaggggcactagtgcccctgggagtgggccaggcatgtcccagtccactgcctgccccagagccccgcctggagcacctgctgggtcgggacatgggcctcccgtgggcctcaccgcttcctgcttcagcagaactgggattgtcagttaatcgagcaacacctccaggaagccagcctcaggaaagagcttccacagggagttgggggactggtaattggaataaataaaagctaatcgtgcttcctggatgccaggaaccactgaaatttgtggattcccacagcagcacatgaggctggtcattgttaataacccctttttaccgacgaggaacccagaccagacagagagcccgcctgtgtcacctggtagggaggggctgggcctggtgttataaaccaggagagggttcaggccgaggaaagggggagcaagttgccggccaaggtaggtatcatgcgagtcctacttctcccctcattcaaggaccttcctttggggaagtgagtgctcccgagagcagcctgccgcctccgtgtcggggcagcctcagcttcttctttctgtgtccgatatttgatttctgttgtcgtggaaacggggtggcaagtgttccatgtgttagcatttggtcctcctgacgtagtcggcacacgggagatgcagctggggtggcacgtgcccacagtggtgccacctcttgccgggggtcaggcagaggagacccagctccgtgccagcttgcagacccccaatcacttctcctgtctcagggcccagagagcaaaggcagtgggaggccaatgtctgttgttcagtttagctctgagccacgtgcatcttcagtcagcccaggggcctgggcgcgcccttccttccttctttgtgcatgggggttttcctggggagcagttgccctggcccatgaggctgatgggagtcaagacagaaatagtggtctgtggtcagcaaggagctatcgctggaaacaccccggtccttccacagcctgaccctctgtgaccttcctcaaaggctccccaaagaggctttcccttgaagtgcaagtcatagtggcgcccctgccacgtccctatatgaacggggtgtgtgcccgcctgccctccgacgtccgccggctgtgctggtctgcagagctgccgccagctgcaccctcctcgccagtgagttctgttgctttcgtatcattttcagcaggagctaaacccaggccagcccttcttttcttttctgctttatggcagaattttgttttgcaagaatggaccctgggtggctgcttgacttttcccaggaaggtgatggggacgttggtgttaggacgatgggcaagggggtccaggttgtctcactgcggccccagagggatgagggtctgacttgtggagtgaaatttccagcactctgctgggggcgagtagatcattgggcccagaagaatgggatttggaacattctcaggcacatgctgcaattaagattttctttttcataggggtacctgatactgtgggtttctctctctctgtcttttttttttctctctgagatggagtcttgctcttgtcacccaggctggagtgcaatggcgcgatcttggctcactgcaacctctgcctcccaggttcaagtgatcctcctgcctcagcctcccaagtagctgggattacaggctcccgccaccgcgcctggctaatttttgtatttttagtagagacggggtttcatcatgttggccaggctggtcttgaactcctgacctcaggtgatccacccacctcggcctcccaaaatgctgggattacaggcatgagccaccgcgcccggccatgggtttctcgttagtggtcttcggttctgtgtttcccctctaagtagctgatcgtggccggtgcctggctttcccctggtcaccactagatattctgtcttgtctttgggaggcagagtcagtagaaggtgctttgcactgggcatgcctgggagtgagcccagccttgctgttattagcgcccatcgtgacggtcggccaggctgccctatgttcgatttttcctcctgtgaaatgggaacaacagtagagctgatgtgtcctgggctttctgcatcccagggactatcccagctccttaacgtgctttgctcagtgctatcctcctaaaaagttttcttttacagttgagtaagctgaagcccagagaggttaagtaacctgcccaaggtcacaccgcagatcggaatgggagtcaggagtgtacccaacagcctggctccctagtcagtgctctcaacctcagcttgaaggccgcctccctgggccctgctaggggacccagtaagatgacagttattcacattctcctttgtttctgataccaagcaaactcctggtaaatgctccttccccacttttgtggaataaagaatgcacatttttttctgagctctgcctgggtatccttaaggagagggacgctgtgcctgggacgcagatgaacaagataggagctgtttcctggaggagctcccaggctgatttttgcctttgatgttctgcatctttttcacaggctttttgtagatgtgtggggatatttctagaggagaaaccagaggtggaaggaggggcataatgaaattgaatgctgggcatctcttagctcacattatatgaggctcttcagggacaatagaccttgcaataaaaggcaaaaaggtgattgcgcacagagtgcttttcctgcacagtgctgggcgggatggggtggatggggcttggcggctggaggagggtagaccctgcccgcacctcctgggacctgtgcgggactttgctcaccttgctgtttctaaccaaggtaccagattctcttcactcaggtgtgtcagattttaacccttgaggctagaaccttgccaggcttattcgaagtcagtggttcctagtagtcacagggcccctgccctagaccccagaccaggaccccccggcccctgcccgcccgccttggcctggtggggtaggagtcactgtgaaaggggtcctggagcccagtatcactccagcgacatttcccagagagcatcctggggccagtgtggggtgtgggggaacagatactgagcgctctgtcccctccccttggagaatctcacagtacattagcagagtcaagactctgagaagtccggtaggaaaagacacctgcttagcttcccttaacttcacgactcctccacctccttgacctttgcttgattcatgtgtgacctgtgaacgtctaaactgcaggactcactttgggagatactgatggagaccaaataggtgtcctgctcatatatcctccacttcttcagttttgctcaggatccactgggcttcctaaaatgcaaacgaattgaaaagctgtgctgaatgtgtttttctctgtctgaaagtacagccacccacgaaaggaggaggtctgctaagttttcttttagaaaaggggtccccaggctctgaatgcttgaggacctcattgggatcaccccctccattgtgggctacccatcctccacccgctgtggcctattgataacctcccagccaccacctatgctcctagaggccctgactggaatccctgtcctcaccctgagtttgtcacctccttccaaacttcgtgtcctctgttgcagttgaggacctggaagtcatgattgggctgattagtgatgggtgtttattttgaattcttaactaaacaaggaggaatcacatcctagctccgtattttactagttatgggaccttgactttcccaagatctactttccttgtcagtaaaatggcaataatcggggtaacccataccctgattgctgagaacccctgtaggcgtccatgcctggcccaaagccaggacccaggaagggaggcgcagctgggcggcctcttctgcgtctctgccagttgctggcttggattctaacaccctccttccctccctccctcgctctctaccagtgggatctgagaccatgaaaacgtttgaaggtttctcaagcgtctgtgactgccccacgtctgtcgttgggtggaaaggactttgtaattgaacggagtcagttgtaatgtgaatgtcatgtggagctgcttttccttggcaagtccttgctgtgtgagccattgtttccagatctgtagaaccctccctaccctgtccccctttccgggctattgggaggctgagcgagctcatcatgaggcccctgaaagatagtttctgtgccctgtggagctgagtccccgagtctctgtccccacctcacaggccccctctcaccaccctattgggttggtaaatttcaagttgggcatcagataggacaagggaaggggactggagaaggaagagccgacagtttgccctcaggacttcagagtcactcttttttgtttggttggttttttgagatggagtcttgccctgttgcccaggctggagtgcagtggcgtgatctcatctcaccgcaacctccatctcccgggttcaagcgattctcctgccttagcctcccgagtagctgggattacaagtgcatgccatcatgcctagctaatttttgtatttttaatggagacgggggcttcaccatgttggccagacttgtctcgaactcctgacctcaagtcatccacccaccttggcctcccaaagttgctgggattacaggtgtgaaccatcgcgcctggcccagagtcaccctttctttttgtgccttattagacatcttcctgctacaggatagcccagaagaaaggaacaagtttccgtcatgaataagtcccctacctactagggatgtagggataaaggactggaactctctttcttcaccctgcagggcaaactccttcaagactcagctccaggaagcctctctggactactacactccctcctgagcccccagccttctcacatacctcccttatgtgtctcctgggtgctggagccctcagagcagggcctgtatctaagtccccctgtggcccacccagtgccccgtgccaggcctgaccatagtggatgtcactaagcagttgttcaatgagtgaatgaacaaatgcaaactaggcccaatcttatcaaattatactagaataattgtataaaaaaccagacttctttaagtggaggaaatttaaagtcagaagtgggctgggcacaatggctcacacctataatgctagcactttgggaggctgaggcgggcggatcaccggaggtcaggggttcgagaccagccagcctggccaacatagcgaaacccgtctctattaaaaataacaaaatttagctgggcgtggcggtgcatgcttgtaatcccagctactctggaagctgaggcaggagaatcacttgaacccaggaggcagaggttgcggtgagcggaggtcgcgccattacactctagcctgggcgacagagtgagagtcagtctcaaaaaaaagaagtgaatgaatacgaccatacctgcttttccagctcctgactcttaaacgtctcgaataccaatgccaaataaagggaaccgagagatgaaaggtgtcactgtcctgatcttcagatgcagaaatttctgtgtagctgaggaggtggggcccgcttgcccccctttgaattttgggttgtgcttgagcagaagcattcattgcttggagaaagcagaggagaccccagaagcacttccctctgaaagggagaagcaggtaggccaaggcagcggttctgggaccagctctggggccacctgcttttcccacactgggtctgtggtgggctcggcagctggcctgcacacaggagatcctcaaaacagatgagcgagcatgattgccatttttacactccctcatttaatccgcagcactggaggaggtgtgattatggtgtgtattttgtgcagccatttggtggacacctaccgaggacccgccgtggggcaggctgctggctgggctctgaggatgctgacgaggacccttctttgggatcctctgttcgggttgaagacagtttatgaaaacataagataacagaatggccgactctgaggcaggagccaggggtgtgtgagtgggggtcctggaaggggtctctggaaaccagaggaggagtggtcctctgaggctggccaaggctcccagcagagagacgggggcatgggcagaagcctgtcgtgccagtgagccctggcatttctgagcccctgatcggttctgttgcctgcacgacggcctgggtgagcaacactgacaggagacccctgccttagtaccatgtctcctgggctctggctagtggcgcctcctggcagcagctgcccaggccacacaggatgctggctacatgcttggctggtctggccatccctgcatggccccgctgtcactggtatctggagatcacacccagccagagcctagtgccaccctcggatgcttccttggggagggaggatgccctgtttccatggcaaccctaggtgggaggccagggcttcaggcaagctgctgagcttttcacagccctgggagtgaggagcagggcaggctgaccctggcctgtggggcagaattagtagaggaggagccccaccatccctgagaagaggaggggagtggggtggggaacattagacaatgttcactgcccctccctcagcttcccagctgcccacggcagtcccaggccaggccagtgtgggcgtggggggcagttagagcgtggccgtgtggtgtgccagcacgcagtgcaacagccaagacaatggagtcatcccctgcccctgggcccttccctccaccccacctcatgtctgcactaggtgaggaagcagaggacggaggagcccagtgggctctgggagctcctgggactcctgagtcggtggggacggggcttcccagcctcaacactgaggattcttggttgtggagctctcctgagcattgcggggtgttgagcggcatccctggcctctacacacgaggtgtcagttgtgacaacccaaagtgtctccagatgccactacgtaccctcccagtgtgggggtggaggaatcgtccccagttgagatccgctgagctgagaggctccccggaagcaggtggtgaaggaagggaaggccctgggccctggagacatggatgcctgcctgggacacacacaaacacgcacgcacatgcacgcatgcatacactcactcatatgcacacatgttcatgcatgcacccgcagtgaccctgaagggactagactatttttagagcacttttaagttcacagcagaattgagtggaaggtgcagagatttcccgtgactgcacggccccaccacgcacactatcaacatcctccccctctaacaacgtccagaccagagggtgcatctgtggtacctggtggacccacatggccatatcagggtcacccagagtccacagtttccatgaggggcccctcttggtgctggacattgtgtaaggacagggacccccatggtagcagtgacactgccctgagatccccgtgccccacctgctcatccctgtctccctctcactcctggcaacctctgctcctttcactgtctccgtagttttgcctgccccacagggtcgtgcagttgggatcacactgtctgcagccttttcagactggtttttcactcagtgagatgcatttaagtttcctccacgccttttcacagctgacggcgcgtttcttcttggttccaagtggctctttctgcattgtctggacggatccatttgttccctgtttgcctcccagaggatccgctgctcttgctgcagatgtatagcccaggtgctgtggagttgggatggagcagtcgagctgggatcagagcccaggcccctgccctgaggttggagctctctgactgcacctggcctaggcctgtgcattgtctaaactgatggccgtggggcaggggacctggagcgcaaagcaggagaggatgctgaagggggcaggtggggccgggacttgggagtgtctggaaggaggaccgcctgcctcaacccagggctggtctgtggaggccagagcgctcagcccctcaatgctaggcctgttgtgagtttctccatgaggtggccctctcagaaagagtggctccacagcagctgagttgggggccccatggcagctgagtcgtggactccatggccgctgatttgggggatgcctgtccttgtagagactgtcacctctaggaatggtgaaagggcggccacccgcagccctgtgtcctctttctagtcctctgtcttgtaagcccggtccccacagtggccccagtcctcccctgccagaaattcgttctcctcagaaatccgttctcctctctgatctttcaggcctagagacaggctcttccctccggagggtgcagcccaggggttctggtaagatacagagcccagcctcaacatagcaggaagtttttccacaaatacacagttcttcaagaccacatgcagctgtgcgtggggtgtgttttgaagggcaatggcaggagcagtgtatgcctcgtggtgcagggagcacgagttgtttataggcgtgcctgggtcctgggtctctgtgcaccctcctctagattcatggggcatctgcccaccgtgagatagataagccagggtgcctgcccctttctcaggtgagatgctgagggccagaaacatgctgctgtgtcccatggaggaggtggcctgccccaactcccctgcaccctagggagagtgcccacaggctgggggctggggctgggtcctgtgccccctccccagccctcggtatgtggctcgctgaggtgtgcgccggaatgttgggcacatcctgtctgataccagcttggctggaagtcgaattatgatcagaatatcacatgatgtgtggcctgggtccccctttggttgacactcttgagtatgggtcctgtgcctgcccggggccaagcagcaggtgcaaccgggcctgccctggggcagcatggggtgtgctagtgtcctggggccactgtaacaaagcaccacaacctgagtggcttaaacaacagaaacatagtctgtcacagttttggaggctggaagtccaagatcaaggtgtcagctgggctgtgctccctccagggctccgagaggatcccccttggcctcttccaggctgtggtggctctggtgttccctgccgtgggccacatcactccagcctctgtctccctcttcacgtgggcctccttctccgtctgtgtctctgtcctctcctcttcttgtaaggacgcctgtcattggattagggcccaccctaatgaccgaatctgcaacttgattacatctgcaaagaccctgcttccaaataaggccacagtcacaggtgttgggggccagactccagtgtgccttttaggggagatacagtgcaatacacagcacacagtgaggtcttccagatccccagacctatcttcttccagaccgccagacaacaccgataagggtgaagttggcttacgagtcctggccaggatgtgacggggagtcgccaggtgggtgccggggaggtgggaagctctgcaggggattggagaaccacacgtcattgcccacatgtgactttaaaccttagcaatgatattggagggggatagttactctttttttttcttctgagacagtgtctcattctgtcatccaggctggtgtgcaatggttctagcgattctcctgcctcagcctcccgagtagctggtattacaggcacctaccatgacactcggctaatttttgtgtttttagttgagacgggttttcaccatgttggccaggctggtttcgaactcctgacctcaagtgatccgcccacctcagcctcccgaagtgctgggattgtaggcaggggatattactctttacagctagggaaacagttgggcttggtgacatgatagagacaccaggtcccttgaggacagggggccatttgcagagccgtgtggtggaaggagcctgaatttggagccccaagctcacagcgtgggtccttgtcacatgtcctgtgagctctgtttgcatccttagctcaggcaagctactgtgttgaactggctggacacagtgtgtctgtctctccctcttccagagaagtcctcacttaaggttgtgtcactgtttttactgatgttggaattggcacttggagatgtgaactttcccaaggccacacacccagatgagtggttagacccggacctgcctaactccagcatatctttttcagggggacacaattaaatccacagcatggactgagttcccctcttctctgccaccatcctgaccttttcctggccagggttaccatgtcggggcaggcatgggggaagtggtaagggaggtatctggacctagtaaaaggctctggtcctcctgcttcctcttgtaaggaccctgtcaatcacatcgggccccctgaataaccaggctaatctcccaccccaaggtccttacctaatcacatctacaaagtccccctcttgccatgtgaagtcacaggttcctgggacttgatgtgaacatctttgcagggaccatgatccagccttccatagaggcagtgacagatggagtagaatataggtcctttgagtatttatttatttaagatggagtctcactctgtcgcccaggctggagtgcaatggcgagatctcagctcactgcagcctctgactcctgggttcaagcgattctcctgcctcagcctcccaagtaactaggattacaggcgcagaccaccaagtgcagctaatttttttgtatttttaatagagatgaggttttaccatgttggccaggctggtctcaaactcttgacctaaggtgatccacccgcctcggcctcccaaagtgctgggataacaggcgtgagccaccgcgcccggcccctgtgagtttttacaagagacactgcagtagagagaatggtagagtcctcaaaccctgattcagtcgttcatgaattcactgagcactcaacgtttcccgcaatgtgtgtcctcttctttgccagcctgctggtgtgctcctggtgcttggtccaccatagatgggtgtgcttggtccaggaggctgatggtgctgacatctgggctgatattcaccgtttttagtgacttgaatgacgtccatgcagaagagctagtgcaccatccttgtgtttgaaaatgcccgggctccagcctgagaacctggtaggccagtaattggagggacagtagcaggatcgagaagccatctgtgtcacgtgttcttggggacaaagaggagacacaggctcaaggaacagcaaggtttgtgggacacagctgtgtctgaaaacgtcaagcagttagctcatccctggctacttcctgtgaacccattaaatccccaggctgaggaggacagagggtgagggaatctgaccccttactcagccctttagccagcggctgctgtgctaagccattctgagaagccaccggtggagaactgacttcaggtcgtgctgactgtgaggccatccagttgtttttgcacattgaaaacaatacattacactttgggaggccgaggtgggtggatcacttgaggtcaggagttcgagaccagcctggccaacatggtgaaaccccgtctctactaaacatacaaaaattagccgggcatggtggtgggcgcctgtaatcccagctacttgggaggctgaggcaggaggatcgcttgaacccaggatgtggtggttgaagtgagccgagattgtgccactgcactccagcctgggggacagagcaagactccttctcaaaaaaaacattgttccggatttgctaataaggaggcaacctcctcagaccttggtgtcacaggagaatggcccgcggcagccttagggccagttgtgattttatccacagtgttggtcagatgcgtcctctgtgcttgtttaatattcattctgcttgcgtgaacaaagccatgtcagtttcagtaacgcttgtgccagggggcacccggtgtggagcagggctcagtaaaactgctgcaaagaatgttccaggctttttgaaattacgtggagttgctggggctctcttgaggctgttaatttacttagggctgctgtgacaaaataccacaaacccagtggtttaaaccaacacaaatctattattttacagttctggaggtcaggagtcccaacatcaaggtggcagcagggccggttccttccggaggctccaggggagaatcccattccttgccttttccaacttgcagaggcacctgcgttccttagtgcctggcctcttcctctgtcttcaaagccatctcccgatctttctctgtctccttcgccacacctcctctggctctggccctcctgcttcctcttgtaaggaccctgtcaatcacattgggccccctgcataatccaggctaatctcccaccccaaggtccttacctaatcacatctgcaaactccctcttgccatgcaaagtcacagtttcctgggacttgatgtggacatctttgcagggaccaagatccagccttccatagagacagtgacagatggagtagaaagtacatcctttgagtttttacaggagacactgcagtagagagaatggtagagtcccgaaaccctgattcattcattcatgaattcaccgagtgttcacggagcacctgcctcagtccaggcgtcatgttgggagcaggggagacagagcaggccatgcatctgtcctttcagagcactgtagacgcaaatcctgtagcacagatgtgccttagactaatagtgcctcgaaaggagaggaaggggaatggatgcggggagtggggaacctgacctgctttgtggggtcatggagtgactctccacctgccgtcatccctccatcccttgtttggggctgttcctccaaaggtgcagtctccagcaggggtgtggggacccctgtgggccgtgaaggcctttctccttttctgctgtgggcattgcatctgttcctgatgggtagagttgtctgtgcccggtggggcccaaggcagtgccatggtggttctttgagtatctcaggtgggaactgagctgccagcaccagaggccaatggcttccagcactccccaaatccacctgcttttggaaggggcctgtctccgaagcaggccgggtcctcctgttgggggaagctttcatggaggcatctgtgtcacttctgcaggggagacagccgctagagggcactgtccttctggcctttcccacatccccgtttccatggcaggtgcatagtaaagcctttctttttctaacgacttaatgatttaatcttcttattttctcagcagacaacgctttggacttccctggatacattgggacgttaccagtcacattaattaatacgagtttcacaacttgggaaccagcgaacgtgcttctccagacttagcttctgcacggccgtttctgctttcctttatgaagtgcgtttctctaagagcctggcagtctcatggggctcgtctgttgctggaagtgagcagcgggttccattgccccccgcctcggtggggctcattgtgcagcttgctggcaagtggctgggctcggaggggcggtgacggtgacacacgccaggggaaaggttggcatcctcttctgagaattgtttcttttgggtttcacaccctgcccccaccttctgctgcctcgaggctcttttcttcttattattagctaatgacagatttcatgaccagtgactgaaatcatttggaagtaccccctgaaagccagcgtgatgggttggagaaatgtgacagacgcagcctctgaaaatcacagaggcagaggcttgcgtcgaaggacttgctaaggaattaggatgagagtggtcaggaggcagtggctgctgggcactggagctgagggtgaggggccgagaaaacgggaggcaaatggggtagctcttttttggggcgggggaggctggctttggggatgtgtatcccactgtgcaccgcaaggtgggggcactgggcggtaggttcccgtgctccggaagggtggcaattgaagggaggaattaaagaagttggccaggtgcggtggttcgtgcctgtaatcccagcactttgggaggccgaggcaggtggatcacttgaaatcaggagttcgagatccacctggccaacatagtgaaacctcatctgtactaaaaatacaaaaattagctgggtgtggtggtgcacacttgtaatcccagctactcaggaggctgaggcaggagaatcgcttgaatctgggaggtggaggttgcagtgagccaagatcgagccactgcactccagcctgggcgacagagcaagagtccgtctcaaaaacaaaaacaaaaacaaaaaacaaaaaacaaaaactgactcatgtggctttcagtctgagaaaccaatcagatcatcattgtctctaaagaatgtgtcctcctttgtagacaagaagctcaccggcccctccatgccccggtttctcgcccaggtgggttagacggccaacctgacattttaccgtgcacctggaagtctttcttcctgttctccttcccacaaaggattcatttttctgtggttctaacattttcctgatcaccccagggacaaaggggaagaaaagaccgtgtttctgggccaagggaatcatctgtttaacatgggcttcggagctttttttacatttctatgtaagcaacttttcgtattcagaagacccagtttccctgagccagatggactccttccatctcggggtggtctgtatttcagattcctgcagcaggtggctggtcggaatgcacaccccaggaggtgaggctggggggatgttggctcctgggctgcttgtactagcaagtccctaattgcggagcggactccttcctcctgagcccatcagcctctacgtggccacatcagggtaattgggttccttgtgaaacacgactgccaggctaatgtaaaccttaatggaaaccctctttttccacccaattaagtggctggaggtgggatgctgtgtgagagccgtcagttcagttccctgactttctcttgtagaaattatctatgtagctccatttggcctacataagcttagcatttgtgttcattcattcattcattccacagatattcagagagcagttatccatgtgctgggttttatgcaggatgtgaggccatggtcatgaatgggacctggcccctgtgcactccttgcggggtcggggggtgcagggagatgagcacagtccacaatcacatgatcggggaatagggtttgtcattgtcatgtgcacggggagctgtggaaacccagaggaggggcccgaactgcacccagggatagaggatgtgcagagtgtgctttccagacggtgggaaatgggtggagctagctgacctgaagtgaagggcattgcaggttgtggggacagtcgagcagaggggcagagatatgacctacagaagtggcctggaatggcctcatcagacgatgagtgtggaagcatggtaactgcagctgtattgatgagaggaggggtctgctcattaacagtcatcgggtaccactatgaaggttttgcgttttaccctggagctggtgggagccatggggtgcactgcagcagggagtgaccaacgccagctttgtgtattggaaggatttctacatcagacaggactctcttggtttgcaaaggacagaaaacccaactcaaaatggcttaaaagcaaaacagaattcactggtacatttgacagaatggtctgtggggttggatggcctcaggtaaggcttgatccagcacatagaaggtgttgctagatcctagattctgttctccccttccccgagctctttcgatctggtgccttcatctccaggctctgtatagtggtaagatgatgggacggcttcaacctccatcctttctgggtcaaggccagtgggaaggagtgcctgtctcattctctattcctggtaaagtctcagtgcagttcattagctctaactgggccatgcccatccctgactgtgttcctgggaggccagtgtgccagctggctttgtcctgggatgcctgctccaccccagagctgaactacaaggcccgagcatggtggcaggaggggtggctctctctgagggaggctgagtcttgtttgcctgaaaggatcaatggatgctggagaagaaaagcaatggtgtccataacagtcacctccagaaggggagaggctgggctggggtgggaagagtttagggcagggcttgcaggggccaaggtggccatcctggtgagaaagccccactggccaatccaagaatagggcacgagatgtgagcctgccaagggtactcccaggtctggcatcttggttctttccgctgcgttcttggcacagacactcatgccagggcctttgctgtcacccatagtctcagagtcatgttattattctgcagtcatctgtggggatgggaccgtgcaggactttccctccccagcttcctccctccttcagggtagctcactgtgtcccccgaggcagccagtgctgccgggagaggcccgagactccttctgggtctcagagccatttctatggttgaacccagtgtgtgtccttccctgtagaattggctgccactttgtttcctttagggtccccactgcaccctgtacataaccctgccaggacatctgtttattttccattcttgtagctttatttttatttcaaaaggagtacaagaacacagtctggtggcagagcctccctctgtctcctccttaccttcagccactgggccttgcatcagtaatgctgctcttgtcattctggagcatgccctttcatttctttttctgtgaattttgatacgtacacatagaaatacatagtggtgagttttctagttgtattttttacataaatatcatgctgtatttattttaaagtgtctcaccatgttgcccaggctggacttgaacccctgggctcgagtgatcctcccaccccagctccaagtagctgggacaacagatgtacaccaccacacccagcctttgctgtattgttctgcaacatggttttctttttctttttctttttctttttaattttttgagacaagatctggctctgtcacccaggctggagtgcagtggcgtgatcttggctcactgcaacctccgcttctcggcttcaaactttcttcccagcctcctgggtagctgggactacagattcacaccaccattcctggctaatttttgtattttgtgtagagatggggttttgccttgttgccccgctggtctcgaactcctgagctcaagccatccacctacctcagcctcccaaagttctgggattataggtgtgagccactgcagctggcccaacctgcttttgcttttttaaaaaatctcaacaccatgctatgtattgcacttaattaattgtgcatcgaatccttcacgagccttctgtgccaggtgcgaggtcggctgctgggtggaagtgaccaggatacgtcttccctcggctacacgcagactctccacggtgcaagggcagggcctgcccagccccatgcccagccctttggcatccatccaccagtgttagttagatcagcaggctgtcatgcccaaggcttgctgccatctgaataggacagggtttcagcagtgagctcttgatgtggagtctgcgccacctgttgaccttctttggatttaccttattgaaatgttcacacatttcttttagcttctcaacttatttcatcttgagaaatgggctggaacctcatgccccagcacaacaagccccataaatcagatgttcaagctgagcgatccttccggtttgggccacagtcacggggctttcttactcctctagtcatgtcagcaccgttcagaaactcatccttggcttagagatgatagtgagttacatgtacataaatacaccgagctcattaccctgggccggcatcctgcatgacaagggcccacatccatttctcggcaaaaacaaactacatctgccacttgaaacgtcaagaagcgctttcttgtatgttgtgctccatggatcactggaagtcctttccctcttttcccatgtccgggccaggaggagcagctgctctctggcactgttagcctttgctgccttttatcctaggcaagacactttgttattcctccgatttgtaatcccaagaaccttggagattggacttggagttcgtaacctcctggggagggccaggcctcacatttcaaggcctttgcacgcgtgatgtgccagcaacagctcagccctttgaattatgatccgcgactccctccaatcaccttccttctggatgtcagaaaagactgcccaacagcatctcctcccagctgccgaggctgatgatgtttttattctgatttagatctcacttaggtcttattttaactccactgagctgcaagatcttcactgaagtacaactggacttatttttagaaaaactgctctgttaagaagaccttcgtgcctgatgaagttagttattctgataaattacagcttctacgaagaaaccacacccctctgagtacggatggaagttggaaaattcatagaaagctgtcatttcctggcagaggcctggaaaacctcatttaacagagatgtctttgggttcctgcttaagcccaagcgaaggatcccgatgccccctccccagctgggaagaggagctggtggcgtgagttggcacagagccgcacctttctttctcctcctgtatcctcccgcaagctctgaagaccactctgtttctttgagcaggatcagttgtaactagaagtgggtaggatttgaaaagggctggttaagtgtttaaaactggggcagctttcctgccattttccagttcttttagatgtgcagggatggagaatggctgtttttgttggggttttctctttgatcctggttcagacggggccctctgaaatttctcgccctgatcttttgttctctatgaaaaccaggaattgcacggatggtgtagaaagtccccgtaggtggcaaagcatctctgctgtgttgaaatgacacacttagaaaagtgtcagaaaatggagttgccattgctctggccccccaggacctgtggctcagcctccattgggcctttgtgtctgggccagaccctccaggcaagcccccagtgaggctcttgggcccgtgattgcaggggcgccttgccatcccccgtgtcctgccctggttctgctagtggagcaagaagctgatcagcctttgtgttttcagatttcttctctccgttaaggtaaccttgttctttaaaccagcttgctttcaaagttgttttcctaataatatcaaaagggggaaaaaaagctgcctgaaaatccttttttgggaaagagcctgggcataaataaataaatacaaccatacaaagaagaagattaaaaaaaaaaaaatcaaagatggaactttcgcatttggcctgaggtataaatggcaggcttctgatgacatgcttttagtttttgattctctttctttccttttatgttcttgtaattccaaatcaggaacgatggtgtttttttttttttttttcttttttcttttttttaaaccttgcccaatctttgggtggaggctttggaagccgcacatattccaccattatagttactcaaagctgacgcttcccgaggggtggctgcatgctggcgactgtgccgagggtgtgtgtccctgaatctttgtgatctctctgaggtgtgttaggccccactttacagatggaaactgagacacacagagccgtcaagcagcttgcccaaggtcacacaccttgtcagtggtcaagctgggatccaaaaccagcagcctggctctgggattctaagctctctgttgtgctgctccttgaatatattaaaaggcctactatgtgcaggaactgggttggcactggcaggaaggcaagttcgggaaggagatagttacatggctgtgtggcttcagctggggagaggggaacacccaggagggcttcttggaggaggcggccagtaagatgaggttgaagataggtaggatttagtagggcacagtgaggtgcaagatcaggtagaactggctttagtcctgactctggggcttcacatctaacagcacaggaccagccactccctcacagacttgtttatttattattattgttattatttttgagacagacggagtctcgctgtgttgcccaggctggagtgaagtggcacaaccttagctcactgcaacctccacctcccaggttcaagcaattctcatgcctcagccgcccaagtagctgggattgcaggcgcccactgccacgcctgactaatgtttgtatttttagtagagacagggtttcatcatgttggtcaggctggtctcgaagtcctgacctcaggtgatttgcccaccttggcctcccagagtgctggaattacaggtttgagccaccgtgcccggcctccctcagacttgttaggagacaaggtgaatggctggcatggaagatgccctgcacatagtaggtgctcaggaaacgttagtggtgctctccccctttccaatggacagtcagcaatatgggttggacaagtatgttctgtaatccgaggttgtgtgccctctggctggcccacaaaatttgaattaatggctcgtatttataaatggggagattccacaccaaaccccacatttccagcttttcttgaaaactcagatctggtgactgcagcctgcacttcccactctgccatcccgggctgagcgaggagtgcccgtctccagagacagtgtgccaaggggccctcctcctatcaaatgccctcctgtctctctcttcctacctggccccccgtgcaggccacagagcgtggtgctgcaggtgaactctgctgcggtgggaacgagttggcatcgactccctcgtggctggctgctgggtttcgtgtggacagagacattcatcttagaacaatgcagacacttaggaaaacaagcacaaggcggtctttttcccttaatcacccatctcatgaaatcaagccccagtcccttggaagctcacaccctccacaccctccagacactgagagaatgcatgccagcatgcctgtgccagcgcgcctgtgccagcacacccgggccagcacacccgggccagcagatctttctctgtgactgaagacagccggcacttcacatctttgaagggtttgtctttctggcaagtagaccggtactttaaaaaccaaaacattcctgggattcactgaaagccagtaaactggcaccgttcaggtggcgggggggtcgggggaggggggaagccaagggtgtgagaggagcccctccttccaaaaatcacaccgatcctctgaaggtgacgatcagatccaggctgcaagttcttctgcaaaggagctgtgtccataagggaacccaggctgcaaaatatagcaaggcccagaagggcatccctcaaaccttcatggggttcagctttggacatgctggctgtggtttgtctccactgcactctgcaaagagccccgaaggccctttccttagcctggccatatttcaaggccagttcaattgctgcctcctccaggaagccctccatgcttctctgtggaataggggacctcgcctgccttgtggtcactcttcctccagtctgtgtctctcttggagcctaatcacagagaccctgtacatccacagctgcctctcccacttgcagggagtagtttgtgggccatgtgtgggtgctcacggttccccttattcctcaggaaatgtgaggaagttcctgtgaggccggtattcccaccaccccatgttacagatggggaaactgaggcttagtgcggtgaggggacttccccgaagccacacaccaacaagtggcaatgcgagatttggactggggctctgtggccacaggcctgggctcctcctgccaaccgaggggtctgccagcctgtgcccccctcctcctggtccccgaagcctttgcttccctcaggccatcgtgcataaccagccccttcagaatgcgctgctgagcagtccctgggcggtgttcgtgagcacgtttctcatttattaaggtcacaaaatccctggccctgtttagtgtcatctttgatgttcaagggcggtgtggaaatctctgttttgatatgacccaatttctaggctttcaaaatgtggcttctctcctcctccctctctgtgtttttgaaatcaggtgagcagggctgcctcgaagcgttgaccacttgccccgaggtctccctccccacccctcaggcccaggcacatgggtgcagtgccagctctcgggccttgccaagaggactctcgggcgtagcccacctgtgtaatcctccacacatagggaaactgggtcttttgttcttcctctgccatcagcgtgagcactgcaggcagctgtgctggacgggacctccctgcccctgttgtgtcctcctatgatgccagccaggacatggaacttccaccccgaccccctgtgctccagggctatcatattcccaaggatttctgtgaaaaatcacttttccctgtttcctttctgccttttaagactctctgctggttacaactctctttgtaactcgtcatgtggtacaaatacttgctgaaatttggtccctgttttctcagctgatctgggtgacctgtgggggttcttctggattatttttagagaggtggggcagagggagtctcaaaactctatgtctgtatcatttccctgtgaaggtatttaacatttgtccactgctggtgtagcgttatgctaaggattttggaaattcaaggatgagtggtgcctggatcttcccttaggatgctggctgtgggtggaggacagtgtgtgcggcagccaggctggctcgcggctggaatgtgggttacctggagagggcctgctttttttttttttttttttttgctatttaaaaaaattgttgtaaaataggcataacgtaaactttaccatcttagccattttcaagagcagagttcactggtattaagtacgttctcattgtgcagccatcaccaccacccacccacagaactctttcatctttccaaaccgaaactctgccatcattcaacactacctctctatttgctacttcccccgcccctggcatccaccagactgctttctcctctatgcattcgcctactcgagggacctcctactggtggaattgtacagtgtttgactttctgtgtctggcttatttcactgagcagaacattctcaaggttcacccatgcggtagcctggtccgaatgtccttcctttttagggctagataatattccgttgtatacgtggactaccttttgcttactcattcatctggtgttctcaaatgccaagactcagtgactgcagcagtgcccgaaggttccctcgaatcaaagaacttcctaaccccaacctgtacctaggctctgatactcctgcatcaggcagtcctctaggataaggtgcctgtttaaaatgcaaatatattaccttcgggggagtgggtaactggcatcctggggccccgctgccattgtccttatgagggagggaggttgtgttgtcctggaagtcgggtccacggtcacgtcctgagagtcccatcacgtgccatgctctgggctggggacttgatgttcattgtttggttacatttagcccttccaaagaccctggcatttttgcagtgttacctataaattccatgtgcggaaacatgggttatttccactcttttttttgagatggagtctcgctctgtcaccaggctggagtgcactggtgtgatcttggctcactgcaacctccgcctcctgggttcaagcaattctcccacctcagcctcctgagtagctgggactacaggcgcacgccaccacgcccagctaatttttgtatttttagtagagacaaggttccaccatgttggccaggatggtctcgatctcttgacctcgtgatccacctgcctcagcctcccaaagtgctgggattacaggtgtgagccaccgcacccgacctgggttatttctacttttgggctattttgagtcctgcagctatgaaaatgggaataaaagagggtccgctttttaagaagctgaatatcggcctttgctgacatgagaggagctggcatccttgggccctgctgccattgtccttatgaaggatggaggttgtgtcgtcctgaaggctgggtccacagacgtgtcccaagagcccatcatgtgccatgctctggactggacgctcaacattcatggttacattcagcccttccaaaggccctggcatttttacagtgttacctataaatgccatatggagaaataggtgcagagaggtgagtgggatgtacctggggtctcacggccagcatgagtggggccctgttggcctgctgctccaaagccatcatgccacacccccttgctgttccatcatctgccgctgtggaggctggatgtccagagctagaggtgttcaaggttcaaggtgattctggtgttaaaagaggaaataccattttacttctgaacctgtttcatggagaaagaggtacagctccgggcacactggcctgggtacctttgcagcatgtgatcagggactgctccccagcggccctccaccagtgccatgaaagtggccagggccctacctgcacccggcaccatggatgcatcttggggctggaacctcgagtcttacatgcagcagaggctgaggctgtgactgtggagaaagcgtgacattacagaagcaagggttttggcacctggtgtctgtgtgggtgggtattcctccctggtggatgtggctgaaaggcctgcagggtctcactggtgcagggagatgaggggtcatttctggttctgggattgtccctaatcactgggcgttccagatcctgtaactgttcagcactcccttgagacaggaggtcatggtgtttctgacttggagcctctggctctctttattagattctgttgcatgttccagccatcctgacccgggtgttccatcagatttctgtgcctgtgaatgtggccatcaccagtgaccccactttaaactccagattcacctgtatgcatgaccggagggggttagcatcttgagtccgtggttcaggacgcagccccccggcagagggaaggcagccccactctctcatgccccatcgctgtggtccatgctttgtctgcctcagcagtcttggtcagatctggaagcatctggaggcatctggaagctttggtgtcttagttatgagtttcaaagggcagtgaaaacagactggcagagctcagcgagacctgggaaatatttggggtggggaggaactgcagaatgtattcttggttcagagcatttttccctctgactctttctgggcaacagaccttttaggaatgtttgttaaatgctgaaaaaaacaggaattgatttctctctgcgtccacagccaacatgtgaggccacggcactccgtgtatactaacctggtttttctttccttttgctcaacagtgagtgacctgcaggaagaaggcaagaatgccatcaactcaccgatgtcccccgccctggtggatgttcaccctgaagacacccagcttggtacgggggttcctccgctccctgccctgagacagttgagcttccgtggcactaagttggtcttggggaggccaatgaggagcccgatagatctggcctcttgatcagatgctgggggcatttgggagtctaagttcttagctcaaggtcatctttagaaaagtccattgggaaaagcaagtccttcattaagggtttctgccctagtcttaaaacgtaagttttatttttcaggtggtgaagcaaacagattgggagaagactgacttgaaaagatagtttgttaaactcatagttctgaaaggaggtgtagcaggccactcagggccatgccatgccacgccatgccacgccacgccacaccatgccaagccacgccacaccatagcacaccatgccacagaaggccacatggaaagcactagtgtgaggcagaggcagaaggagcagggctaatgcctttatttgatattttatgtatatattttttgagatagagtctcactctgttacccaagctggggtgcggtgatatgatcacagctcatggcagcctttaccgtccaggttcaagtgatcctcctgccttagcctcctgagtagctgggactacaggcatgtgccaccccgcccacctaactttttaatttatttgtagagatggggtcttgccatgttgctcagactggtctccaactcctgggctcaagcagttctcctgcctcggtttcccaaagtgcagggactacagatatgagccactgcgcctggccccaacacccttactgtggctttctctgaaggaatgggcaaggctgggtgaacaggcctaggcctggcttgttggaatcgtttcactgggctttgcggtgcaggagctgtcctgagtcttctcagtaagaagactcttcttcttccacaccacgtggcgtggcgtggtatggtgtggcgtggcgtggcatgtccccagggccaggggagattagggtgaggatattggctgggagtgtaggagccccgtgagagcccaaggaaagaggtggctggggactctgggctctgcggctcaggctctgagtggttttcatatgaaaggtgtgctcacagagggtggtttaccatctctaggaattagcttgccctggaggtgcaatctctccagagtcagcaaggccccgagatgccaagcaccagaaaatacagaaaacagggcgggcacggtggctcacacctgtaatcccagcactttggaaggccaaagtggacggatcacttgagttcaggagtttgagatcagcctggccaacatggcgaaaccgcgtctctcctaagaatacaaaaattagccgagtgtggctagcctgtaattccagctactctggaggctgaggcaggagaatcgcttgaacccgggattgggatgttgcagtgagccgagatcgcaccactgcactccaacctgggtgacagagcgagacatctcaaagtaaaaaaaaaaaaaagaaaaaaagaaaatgcaaaacacaattaatatgcttcttccctttgggccagccagagctgcccgcggcctgggcttgcagggtgggctctgccaagtggcccaggcccctgcgctcactgcctgatgtaatgggtaacagccaagacacattttccttaaagtgtgttttgggatctagctgatctggaaggcatttatggaacattctgcgtatttccaaaccctggttcgaagggaagtcccggttcatcccttttttgtggtttccgtgacgaggccaggccagcaagagcttatggagaagaaacgccgatgcaagttcagccgccaaccgacccgaagccagagctggtgatgctgcctgaggtcgcaccagggtccacggggctttctctccctccgcttagaagagagtggccccaccaggctcggtggctcaggcctgtaatctcggcactttgggaggctgtggcaggtggatcacctgacgtcaggagttcgaaaccagcctggccaacatggcaaaaccctgtctctactaaaaaatacaaaaattggctgagtgtggtggcaaacacctgaaatccccgctacctgggaggctaagtcaggagaatcgcttgaatccaggaggcggaggttgcagtgagccgaggttgcaccactgcgctccagcctgggcaacaagaatgaaactccatctcataaaataataaaataaaataattagccaggcatggtggcacacgcctatagtcccagctactcaggaggctgaggtgggaggattgcctgagtctgaagaagttgaggctacagtgagccaagatcacaccactgcactctagcctgggtaacagagtgagaccttgtctcaaaaaataataataattgaactcactcactgaatatttgcacagcacctgattctttctgaagtcctctttgtatatttcatatcctttgggctcataaatgtcatcattgtagcgaatattgggggtccactgtgaatgcttctactcctcagtcccttcagtgaccctgtgaggtgggttgtatcattatccccattgtacagatggggaagctgaggcacagatctaagatcacagagatcactagtaagtgccaaagtcttgaaccccgggcattttgcccccagagctaggctcctccccctgctctagaccctctcagtgaagatggtggccctcatcagaggtgagtaggacaggtccctgtccttgggcacgttttattgcagctggctatgacgcacaaggtggggagggcgggggctcggttcccacaaaacactggcacagagataccaccctggcctctgggcactgcttctcctctgactgaagtggagagaaacctgaaccaggcccacctagcctgtgtggacccagacctgctgaagattctgagcccatgtctgaccccccggcaccccctggatggagcagcgcttgctgtacccactgtggtgtcccgggactgtgggctcctcgaggggtcctgcctcagtcttggagccaccgagaggagcatggcacagtttagcgaccactaaagtcacacagctcagagatggcatggcggctggtgtctgctctcagcttccttttaggaaaaacaaggagcctctcacagcccttttcttctctcccagagtccctggagtcctgttcctcaatgcaggatgtcagaaagtcccagggcacttggcagtgagggttcctggccacccgaagacctaccaaatgggagtatgcgggcccaggcccctctgctttaaacatgcctgcagtgactccggggcccactgaggtttgggaattgctcccctctaggccgcgtgagcagcccgtagcagactgagggccatgatgtgcagtggcctgcgggggtttcatgtccagggtccccggtcaaggctagcaggtcatgaatgctgacaggcagcaagggctgactgtgagctctggagcccccagatacagaggtgtttctcatctggagcaagcgcctgctctgaatcaggcccctgccccgtgagacgcagctgctccctggtctgtgcagagcctctgattctggcctactgtcaccatcaccaggtgaccaggagatcccggcgggatctgcagacatggacacactgccacacatagctgcctgcctggggcctgctgtccaccctctcaggcccactgttcccctctaggcggggtcaggaatgaaagctaccccacggggacaggtaaagaccggagatgcctctgagaaagtgtttggtaacagtaagcctcgaaacggcatctctgtcctccacctttcacagtctctgggtcagacgccccattcctctcagtggtcccgccgactgaggcaggacccctcaagaagcacacagtcctgggacatccgagccaccatggcatgctgcccagtctggggtcagacgtgggctcagagccttcaggagggagcagcgagttccctgtgggggccacatgagctgggcgggcccgaatcttgcttctcctcagttcagcgagagcaaggtgtggggacatgctagatagggcaatgctgagatttttagtgtgggttgaaggggatgtttccagaaacgggctctctgaaggctgggattgggtagtgacctgctcactctccgtcctgcaccccctctcatacacgtgtggactcacggcctggccctgctccttgcccgcctgagatgggtggtccagagggggtctcagacatgggtcacacaggcacacaaagtcctctttggggctggagagcttggaagatttggcattcgggctcaaggatctcagctggggagctgaggtctgaagggtgaaggaaacatgggccagggagagagtgtcagacagcgggagcaggtgccaaggctcagggcaggtggcagcaaggcttcaaggagtgagggaaggccggatgggctggagcagattgcaccaggagggcaggaaatgaggcgggagaggggccttggaggccacatggaggacgccggccttgatcccagcaggagtgggaggctgcggaggcctttgcagagatatcatcaggactcccgagaactccctgcacattacctggagtgtccttttcaggcatcagatctgtatgacttcaaaattagtttctccatgttgtcagagtttacactctgctgccgggaagttgcatcacatccgtgtcagcagcaaagtttcactcaaagccattttctttctttcttttgtattttattttattttattattttatttatttttaaaaatagagacagggatttcactatgtagcccaggttggtctggaactcctgggctcaagcaatcctcccgcctcagcctcccaaagtgctgggattgtaggcaggagccacttacgctcagcttcaaagctgttttcattctgaccgacatggtcagtgtccccagccccatgggagcctgtctgggctctgggaccctggtctcaactgtgtcctggccatctccacttgtatgtcctgggggtaactggcttctgcctggagcccctcttgtgccttttttcctctttaagagagaggtgtggtatagagcctcccggtgagtggagcctgggccccacccgacccatgctctgtgcaggtcccggagctggacagtgtggcagcctgagacccccttgcccttccctgtgtgtgttcagaggtgctcggcgcccgctggcttctgtgtggtgctgggcatttctgctgtggagcacgcctagccttggtgggtgccccctccgcagtcccgcctccccactgtctccacggcactgtcctccatgacgggctcagctggctgcctggtgtctgtgggatccaggctgaaacgtggagggaaagcaaacaggtagagaaatagaaagagggtgaggctgaacacgttttgctgttacacatcatccccccccacctttttttttgctatttatttctcaatattttttctgcatgttattttacatacaacattgcatattgattcttttccatggaatgtaccaaacattttccatttcattataaccatccagactcttcaaatgtatttataaatagtggccacagggaactacctggtgcctgaagctttcccacataccagattccggccagcggaggcatctcatgccctgtgaatgctgctctctccttatttctcctgaaaaatggaaatggtttggaccagctgctggcggagtctgggaggagcgaggccgggcagaatgatgagtttgacttcatccctttccagaagaggggaaggcgggaggatgccccatccaccttccagaaggcggttccttgcagtcaccctcccctagtgctgggttctctgcttctccatttgtcagagatgagttggcctccccctggttccccgtgtccctgccacccccacaatcgctgaccgtgacttccttttgtccctggcagaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattcagatttaaccctgaaaagcaggaggggtcaccctggccactcctggccaggagccatctgatgccgatgcctgcgctgagtggacagtcagtttccaccacgtctggaggcgtgaatcccagctgggcgaggaacctggctgccccgctcccagaagtcagggaacagtgagggaaggggcccatggtgctggccttcttgggcagcggctgtccttctccagcgtggctcctgctcaccgtgaggcagtgcttgtgtgggtccaaggacagattgcagttttggttgctctgatcgaaaccacggtagggcttgagagagaatcccctgaagaggagaggctgtgggctctgcctgaccttggtgaacccagggtgggctcttgggcacacggctgtggcagacacttggcttccatagcccacggcgagcttgggcaccccgggattcttgaaaatgccgatggtgacagtgtctgccagaaacagacatttttctattaaaagtgctttttaaaaagcttctccaccttcaccaccacagtggacccaatgctgggctgtacaactgtgttttcatgagggctcattcagaataagtaagacggcttgcaagttatgttcttttaaaatctacattgaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcacctgtagtcccagctactcaaaaggctgaggcaggagaatggcatgaaccccggggggcggagcctgcagtgagccgagatcgcgccactgcactccaacctgggcgacagcgaggctccgtctcaaaaaaaaataaaaaataaaaaataaaatataaaataaaataaaataaaatctacattgagaccgggcgcagtggctcatgcctgtaatcccagtactttgggaggccaaggcaggtggatcacctgaggtgaggagttcgagaccagcctggtcaacatggtgaaaccctgtctctactaaaaatacaaaaaatttgccgggcatggtggtgggtgcctataatcctacctactcgggaggctgaggcagaattgcttgaacctgagaggcagatgttgcgttgagccgagatctcgccactgcactccagcctgggcaccaagagtaaaactccatctcacagaaaaaaaaaaaaaagaaattccaaatgtcagttttagggtccacccaaagatgttgattattaataacttaaattatttaatttgttttattttttccctctgaatacccactttgttatttcaaacagaagaacgttgatgaggaaagtcactgtcttttagccacgaaaatgttgttcttgggggatatttaagcaagggatgcatgagaattatcaggcttctacaaagaaacagacccaattgtgtcaatatctagagagaggtttattatgatattggctcacttgactacggaggctgagaagtcccccgacctgccatctgcaagctagaaagctggagggccagtggtagagatgccagcctgcgtctgcagccctgagtaccgggaacagggtgggagaagatccaggtgctggcactagcagtccccggcagagagaggtgaatcccaacttcctccacctttttgttctatgggatcagatgaggcccacccgctttggggagggctgtctgctttactctatccaccaattcaaatgctcatctcctctgaacaccattccagacacacccagaaacaatgtttcattggctatctgggcaccccagagcccaggcaagttgacacagaagatgaaccatcccatgcacctttctaaagatttttttctttgatttttgagcaatgcttgagagttcacaaactccattcacaggattatctccttgaaacaacaccctggggagctgtgtcattcttgcttccatgtggagactcagagagaggtgaaggggctgggcgccatggctcacacctgaaatcccagcgccctgggaggccaaggttggggggaatcacttgagcccaggagttcaagaccagcctgggcaacatggtgaaaccctgtctctaccaaaaaaaaaaaaattaactgggtgtggtgggaggcacctgtaatcctagctatgcaggaggctgaggtgggaggattgcttgagccccggaggtcaagggtgcaatgagctaagattatgcctgtgaatagccactgcactctagcctgggtgacagagcaagaccctgtctcaaaaaaaaagacaggtttaagtaactccccacccccaggtgctggggttagtgatgtgtctgggcttgaatggctctgtccatttggtgctgtgttcactgagccaagttgagtgcgtgtggggtcctgtgctgggccctgggattcggggatggataagtgacttccctgctatgcaggatttgatttatgttcctcctggatgtctgcagtgccacccacccctgcctttgctgctttgctgccaaagacccccaggctgttttggccttggtggggcgagggctggctgctgcatgtcttccaggtttcagattgagaagaaggccacattgaggggcatggggtggactgatgggaaagctaattagcatcctttggggcaaagtacaactatggggcaaaatacaactaagaacaggaaggagctgaggaataaatgcctctccccgacttccctgatgtgggcttctgagaccatggctcatggagatgggctgcatggctgatcatcagctgggttttcttctgaagccatagccagctcatgcacctgcctcacctcccttcccctccctgttgctcgtctagggtgccctcccctcacccccaaacccctgccaaagaaaaggcatcagcagtgagctttgtcctggctctgtttttcagggaacctgggccagaatcatggtccccaaagatgaccatgtgataatccctggagccattgactatcatcttacatggcaaagggacatggtgggtgtagttagtgaccttgcaatgaggaggtcatcctggatgatccaggcgggcccagtgtgttcgctagtgtctgtataagagggacatggggagctttgactgcccatgaacatggcagcttgaccctggaggcaaggtggtagcttctggctctgaagatggaagaaggggccatgcactaatggatgcaggcggcctctgcctctagaagtggaaaagacaaagaaatggattctccactagagaacccagaaggaaccctggagcctccagaaggaaccagccctgctgacacctggattttagcccagtggaacagattttggactttgacctctaggactgcaagagaatccactgagccgttggaagcccctgggtttgtgttaatttgttacagtagccacaagcaactaacaccatcctgttctccaggctgctgcctccagctgcagctggcgtgccctggccactggggccaggcagggtgggttttgatacctgcagcggcagcatccttggccatttcctggaagggccagttgccagacactgagatgcctgttactgcaactgtcccaccagcctggagcacgtgtttctggagacaggcaaattctggaaggctccacctgctctcagactgcaggttgcgtctcaaagcaggctggcagacattttccactcttgatcaatcattttccaaaataagcatagacacagcaacccggagagcagcttcggtttggctgtcggtggcgtgttagttactgtagtggtggcacagaggcgatatacgttaaatattagttctcactgactatagccttttaaacagagcagcgtgtgggtggcagcaggtgagttggctatactgagcttgggctgcccttggttgattcttgtttgtcaggcatgcagggggctctctgtgcgtccaggcatattccctgtctggatttgcttgtgttcatggattttcagcacctcctttcttctggtttgggaatgagtcaggtcctcactacacaaggccagagcagtatgcgtgtgtgggtaggggtgagcaggtgtcattccctgcctcccctcctccttcactgccccagccaccctgaccaccttgctgttctgaggacacactgagccagtgcccactgggcatcaggtgaaaggggacatcccacaagcccaccctcacttctgacaccaatggcaagttcaggatctccaacactgccctgaggtttggtcatttgctagagggactcccagaacccacttaaagctgtcaccctcacagttacagtttctgatggtgaagggatacacatgaaaatcagccgagggaagagttgcccagggcagagttgaacgcacccacacagcacctccattgtcctttcaccatggggtcataggcagcgttactctcccggtgatgtgggacaatgcgcatgcagtattgccagccggggaggtcatctgagcctccgtgtccagagtttctgctggagctcacttgcatgggtgtggctgactgtccacatggctcatctgtctccagcccctccagcagctggctgatagagtgcaacccaaagccccctccctgaatgacatagttactccctggctggcccgagggccccaggtaagcagaggtactttatctggcagggcatttcggagcttaggagatcacctcccaggggctgaggtcacaggcccaacctctctgtgggcaaggttaggttcattatcacgtacctggtctttggactttcaaaggcccatgcctggagctgtcttcaacacttctttcagttttctctcaatgcttcctccttggagacgtatttcctgcccctgtcactccatcactctcctcctaaccccagttactttttctttgctgggcttgctgctgcctggagtcatttcctatttactagtttgtttttggtctttctcctcccctagaatgtaatcttatgctgtgagggaccatgaccattctcttcccagctaaatccccagggctggagttgtgctgcacatgcagagctaattcatccttgatagatagtaagagaaccgatgggggtctgtgtcagcagcaccaacatgaggttcacaccagcgtctcccaagatggcatgcggcttagagacaagacagatgtggttgctttttgttgttgttgttttgtgttgttgttttgagatagggtcttactctatcactctatcacccaggctggagtgcagtggcatgatctcagcttactgcaacctctgcctcccaggctcaagtgagtctcctgcctcagcctcccaagtaaatgggattataggtatgcaccatgatgcccggctaattttttgtatttttagtagagagggggcttcaccatgttggccaggctggtctcaaactcctgacctcaagtgatctgcctgtcttggcctcccaaagagctgggcttacaggcgtgagccattgcatgcccagccagatgtgtttttttttttttttttttttttttttgctctaccccaaacctgtgagatggcagggaggaggctctgggaagagggggtgagggttggggtaaacctgtggattggatgctgatgtaggtggtcccaggtgctcccttgggaggagatggacagtccggatggtgcagacaaaacacctccatccacattacctgcgtaattctctttgctttccagaacatcctttgtgtactgtggactgtgatgatctaatgctagtggattacatctaagtaggccttagtagaagccacctcccagtggttcctcggaggcatttggtccagaagcagatgattttagtgcaaagcacagaccgtatgcaggcctgagcagatcaggggacagacagatctggctgacatcctgatccgctggctgtggtggtgtggccattgcttgtagccacattgcagtcttgaatgtcccccttggaaatgggggacatttccaaggatgcctgcctggtcctctagttttctctttctctgttctctgtcatctgcacttttttcctcttgtcttgattgcttgtcctgtctcccctagtagacaccccctctgacctctgctgcctcaggactgttgctgtataaaatattgtgagatgccctctgctcctgtttaaaaaaaaaaaaaatccttagctctgggtaagctaggcactgagaatgaggccagtcattcaaaacttgtctctgagcattgattatactcatgtattatactgttaaggggtgaaggtcggctctagggtcagcttcctggatttaaatcccaactcagattaaagtgggagaataatagcaccaacgtgacaacctcaaagtgtcatttgtaaggataatgttagatcatacacttgatcacccgttagcagtgtaagggcagtgtgggaacatgagcatgaacagggcagcccagaagggagttgaatggacagatgggcaatgccagtttggaagtgggtgcatgcatccggtgggttcaggagcctggaagacttatccaaaagtcatctttgctggtgtttcttcctgtgtattttctctaaccttctccagcagtgacctgaattacttatgggtgaacactgaatgctgcccaggcaactagaggtttatagatgagatactttaaatttttaatgattcttaaaagagggagtggctattcttatgctttccagaatgaatagccaagggaaacctgtacagttgccatataaggagaaacctagacctggccttagcctctaggtcctggtgcagattcttagcacgtagcgcctaaaacctttgcgatttcctgagtgataggagcgtcttttgttattcataatgagatctgggtttatgctaacgaggtgactcagggtgggggctggccccagagtaaccaacacaggattagagggttgggtctatcagtcctacccacccccagcctctgggtggggtggagaggggctggagagtgaatcaaatcaccaatagccaatgatgtaatcagtcacacttacataatgaatcctccgcaaaacccatcaacagtggggttcagagagctttggcgctgggaaacacacatggaggtgctggagggggacacgcagggagagggcatggaagccccgcctccctccccgaaaactctgtcctgtgcagtgtttcttattaattacactgtccctgagttctttttttttttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaaaaaacacagaaaactccctaagcagattggttgaaagcaggctgactgcatgtcatctgggggtgcgtctccccccaagagcaggtttcacatctcattccccggttgattggacaagacccttcctgtctttaagttctgttttcttcctccctttgtctctccgaagaaaatcagctgcatgaaaacgatcctctgggcagaaattggtgctgttggagccgcacagaggtgccctcccgtgccccctggcccccaccgggccgtgtctcctcctgcctgttgcaatcagccctcgtccgactctttttggaagtgattaaaacataactgtcatagctctgggggagacaggctgcagatcctgattataattcagaaggatctaaagaaaaagtaattttttaaaaaaattctggttaaagccaaagctcataagacgtgtgtgatggagtggtatgcaagagcacaattaatgtatgtcctagacatctgcccacaggattcagggctggcaaatgagtgcgtccctaaaaataatgactagtgctatctttaaaaagtcttttgtggcatagcagattaagatggatggcctgggaagtacagtggcagcgtgtgctgtggtatccaggaataagttgtacctcctcggggtggcagtggaactgggccgtgaacagcttttgcttcccagagaggactgccatggcctgctgcatggaatttgattttaatctgtttgttatttttgggtttggtcttggactgggtttgaaatccagatgtgacttttttttttcttttttcagttttctttatagcagcaatgttgtatcttgtgtgtttcctaacaagactgagctctgagcaaggcagcctctggaaccaaatgtctgcaggcccaggagacctttctagaaagttcataggtgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaaagttcataggcggttctgcagtttgagccccttctgtgggtctgtgcctgctttagccgcttgagatatggcattgaacaaaacacaggccccgcctgggagaagctgccaggccagctggggagacagacctgataagtgaaaatgagatcgcgtggcctgcatgctccgaagaagactaaggcaggaaacaggactattttctcccgactgaattgtcctggtatccttgttaatatcagttgactgtgacttgagacttatcttggacacccctttctgttccgtgggtctgtgtctgccttgatgtcagtcccacagtttcgacgactggagctttgtagtcaggtgtgaaacagtggagtgtgggtcctccagttttgttcatctttttcagattgttttggcaatccaggagtcctttgaatttacatatgcattttattttattttaattattaatattattattattttttagatggagtcttgctctgttgctggagtgcactggtgcaatctcggctcactgcaacctctgcctcccaggttccagagattctcctgcctcagcctctcgagtagctggaattacaggcatgcaccaccatgcccagctaatttttgtattttcagtagagacagggtttcaccatgttggccaggctggtctcaatctcctgaccttaagtgatccaccagcctcggcctcccagagtgctgggattacaggcgtgagccattgcgcccggcctatatatgcatttaagacctgcttgtcaagttctttagaagccatctggatagtgattaatttgtaaaaatgatacttattatctttttgaactgccaaagtaatatatgctgctgaaaacctggaagacagaaaaatccaatagaaggcagggctaattttttttttttttccatgtatgtcccttcaggcttctctgtgtttttcatttttcctacacaaatttggaatcattccagagctagtaagcatctagggccacatttggactagtaccttgggataaattagagctggaattgccgggtcatatagtgtgcacagggctagggactgacttattttcctttctgaatgaagactctgaggtctagagaggttaaatgagtgactcaaggtcacacagctaaaactctggtggagctgggtcttaatgcagaccctacatattcatgccatgctgtatttatacaggcatgtacaccagcgggtcgggattttagggggtgttttaaaattctgcctgcaaaacctttttttttttttttttttttttttttttttttttgagacagggtcttgctctgttgcccaggctggagtgcagtgtcaccatcacagctcactgcagcttcctcccaggctcaagcaatcctcctgcctcagacccctgagtagctgggactacaggtgtgcactgccccacctggctaatttttaattttttttgtagagatggggtctcattttgttgcccagggtagtctcaaactcctgggctcaaacactcatcctgcatcagcctcccaaagtgctaggattgcaggtgtgagccgctgccccaggcaaacccattttaaagccatgagccaaaaattataaaagacatgcaaaatattatgagtagtcacttatctagtatttgcggcatctctcaggcttggggctttgctgggagctctgagggggtggaagaggctctgtcactggccttacctggctgtcaagggctgagtgtttggtggagggaagacgtctgcagcctgggaggctgcgggtcagaaggaggtcagccggggagctgggaggatcgtggggaacccgtggtggaaatcagcatggcgagagagtggaagcaggcagaggagggctttgaagaccaaaaagggtagttaggattgctgctctgtgtgtctgtaaacttggtgttgtctctcgaatttaaatgacatgctttgaaaacaaaaaaacaaacaaaaaccaaacccataaaatctcactaagtggccagagcaagttcccggggggtggcgcatagatgcagcggtctgggttctgtggctgggggagttggcttggggtccgtggctgggtcagtcttcaagagccaccctgggtggcactccaggtctcttggtctggggggaataccctgaccccagcggtttcacggcctcctccccactcagcctgggggagagtccagggtcggccctgtccccctccccccactcctgtcactatcagtcccctgtgctcagcttactggcagggttcctcctggctgtcccctctgcctccagcgctctttcctcaggtgtccacgcagctcgtcctcacccttttctgtctctgctcagatgccgcctgaggctcccaaaacagggtctcactctgtcacccagggtggagtgcagtggtgcaatcacagctcactgcatccttgacctcccaggctcaagcgatcctcctgccagcgagcttgttacaattcctgcaccaacacggatacattgttactaactaaggccctacaccagcaaagatacattgttactaagtaaggccctgcaccaacacagatacattgttactaagtaaggccctgcaccaacacagatacattgttactaactaaggccctgcaccaacacagatacgttgttactaagtaaggccctgcaccaacacagatacgttgttactaaataaggccctgtaccaacacagatacattgttactaactaaggccctgcaccaacacagatacgttgttactaagtaaggccctgcaccaacacagatacattgttactaactaaggccctgcaccagcacagatacattgttactaaggccctacaccagcacagatacattgttactaaggccctgcaccaacacagatacgttgttactaagtaaggccctgcaccaacacagatacattgttactaagtaaggccctgcaccagcacagatacattgttactaaggccctacaccagcacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaactaaggccctgcaccaacacagatacgttgttactaagtaaggccctgcaccaacacagatacattgttactaaataaggccctgtaccaacacagatacattgttactaactaaggccctgcaccaacacagatacgttgttactaagtaaggccctgtaccaacacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaagtaaggccctgcaccaacacagatacattgttactaactaaggccctgcaccaacacaaatacgttcttactaagtaaggccctgcaccaacacagatacattgttactaactaaggccctgtaccaacacagatacgttgttactaagtaaggccctgcaccaacacagatacattgttactaaggccctgcaccaacacagatacattgttactaagtaaggccctgcaccaacacagatacattgttactaactaaggccctgcaccagcacagatatattgttactaaggccctgcaccaacacagatacattgttactaactaaggccctgcaccaacacagatatgttgttactaaggccctgcaccaacacagatacattgttactaagtaaggccctgcaccaacacagatacattgttactaactaaggccctgcaccaacacagatacgttgttactaagtatggccctgcaccaacacagatacattgttactaaggccctgcaccaacacagatacattgttactaagtaaggccctgcaccaacacagatacattgttactaactaaggccctgcaccaacacagatacattgttactaaggccctacaccagaatggatacattgtacattgttactaaagccttgcaccaacatggacacatcattactaactaaggccctgcaccaacacagatacattgttactaaggccctgcaccaacacagatacattgttactaagtaaggccctgcaccaacacagatacattgttactaactaaggccctgcaccagcacagatatattgttactaaggccctgtaccaacacagatacattgttactaactaaggccctgcaccaacacagatatgttgttactaaggccctgcaccaacacagatacattgttactaaggccctgcaccaacacagatacattgttactaagtaaggccctgcaccaacacagatacgttgttactaactaaggccctgcaccaacacagatacgttgttactaagtaaggccctgcaccaacacagatacattgttactaaggccctgcaccaacacagatacattgttactaagtaaggccctgcaccaacacagatgcattgttactaactaaggccctgtaccaacacagatacattgttactagctaaggccctgcaccaacacagatacattgttactaagtaaggccctgtaccaacacagatatattgttactaactaaggccctgcaccaacacagatacgttgttactaagtaaggccctgcaccaacacagatacattgttactaaggccctgcaccaacacagatacattgttactaagtaaggccctgcaccaacacagatacattgttactaactaaggccctgcaccagaacggatacattgttactaagtaaggccctgcaccaacacagatacactgttactaactaaggccctgtaccaacacagatactttgttactaagtaaggccctgcaccaacacagatacattgttactaactaaggccctacaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttagtaactaaggccctgcaccaacacagatacattgttactaaggccctacaccagaatggatacattgtacattgttactaaagccttgcaccaacatggacacatcattactaactaaggccctgcaccaacacagatacattgttactaagtaaggccctgcaccaacacagatacattgttactaagtaaggccctgcaccaacacggatacatcccattactaactatggaggtgctttattcagatatcctcagtgtcacctgttctcctttggccgtctcagggttcctcccaggacaccacattgcattcagtcctgaggcttctctgggctctgacagtttctcagactttccttgtttctgttgaccttgacagttttgaggattactgctcagagagtttgtagactgtccctctgttggggtttgtctgatgctttcttcatgattcgatcaggttgtcactttggggaggaagtctgtgaggtcaagtgccattttcatcgcatatcggggcacacccatctgcacaccttcgctattggcgtcggtcgtcatcacctgtgcaggcgtgctcacccggtttctccactggatccagctttattttcctttctatcaaccatcacaacctgaaactgtgggcgtccgtgtgtctcttggagtctagtagaatgtaaggccctcaaggcagaggcctcgtctgtcctgtttgtcaccagagcctggtccgcagtggtgcctagtaagttagtccacccattcaccacatccttacagagctctggcgccaggcagcaagtgctggtgctgcggacagagccacagacaagccggtcatagcttctggcctcatagaccttggagtctaacaggggagagcctttcaaagatttgctcccattgctaatgggacaggatgagacagggtgctgggggactgagagctgtgatgggggatgctgcctggagggctggggtggtctgagctctggaggaggaagtgctgctcaggtagtgagggagggggtggtatctgggttaggggaagtggcgtgtgcagaggccccgtggcgcagatgagcttgggctatttgaagaaccccagcgaggaggcagggtgttcaggtggctgtggctgtggcccaggggcaagagggagatggggaggagtggaactggttaagaagtggacagaagtagggtgagaaggcaaagtccaggatctgagacaggaggatggtggccttcctgcctcccttccttcctgccttccctggaaaggagcacgcctggggtgtggtgagtcctgttagagatgctcacggaaccccctctccccaccccgccccgtggcaggggcatggagaggcgggccctgtgcttagggggtcctgggttagggacggcgctggaagttgcaggagggcagaaaccggcctctgaagagagtggggagggagaaggggagctgtccagggccctcaggcatgcatcatgtaagggtcaggggagtcagggaggatcccccaaaggaggctgtagagggtgaaggaggagggcaggaagccagtgagtgtgggggtctgtgggccatggggggtgggggaggcagctctttgggaactgagggggttcgggtgcagccctgggactcccaggccagtgctctccctccccctgccagccacctcgcagagagagcccggggtggaagcagggtagttggtgctgtgccctgaccttcagaggtggcattgacaagaccagaatgccacagggccatgcacctctccctgcaaactgccctttaatttatttttacctctgttccttgtgggcttgtgtgtcaggttcgatatttttatgttactgggaaaatagaatgtgcttcacagaaatttgccttgtggccaatattgcaggttgcagctgtttcagagtgacaggggacggtatattctggacttgtgcccttttgttcatctctgagaggggccataaactcccatttccgagaggttactgggaccaatgagatcatttattagttttccttgcacaggaaaatcacacactctgtgccattgattgagtccattttattttgtggaatagacatgtcagaagcaggattggccaggtggaattgtgtttggcgggagtcctgtctttccataggtactttcataatggaagcaatctccttctgaagtgtatcacccggtgaactgaatggaaaatctcttgtgaaaaggcttaagaggaaggctggcctggaaaaatgaaactcacatccacagagagacttgtacctgaatgttcatgtcagcaccactcacaatacctaaaaaggggtgataaccgaaataaccatcaaccaagggatggagaaacaaaatgtggtcccccatgagatggaatatgattcagcgtaggcacgaaagaaggacggaaacatgctataacatggatgaaccttgaaaacatgctcagtgaaagaagccacacatgaaagggcagacatcatcggctcctattaatatgaaatgtccagaaagccaaatccgtggagaggggaagtagatcgaatcacacacttttaaaggatgaattgtgtggagtgagaattctatctcaataagggtgcatacaaaatgcagctgacggtggtcacaccaagcctgtcagtaatgatgcataacttccctttgctgtcctgggttagggtgggttgagacttagggtgaccagggaggaatggatatcttgtgggtcaccttgactgtcttggggtgatgagagggcagtattaccaatgcttaatcatttgcccccataccaaggtgaacacgagatgctctggtcctagtggctgcagagttgtgcagcctctgtccctgtgctagctctggacctggtggtggccgcagagctgtgtagcctctgtctctgtgcttgctctggtcctggtggccacagagctgtacagcctctgtccctccgcttgctctggttctggcggctgcagtgctgtgcagcccctgtctctgtgcttgccctgtccttgtggtggctgcagagctgtgcagcctggccccagagctgtgcagcctctgtccctgtacttgctgtggtcccggtggtggctgcagagctgtgcagtctctgtttctgcactttccctggtcactgcctcattgccgtggcgctggtggactgaggccataatgcctgcgtctcctgcaggtcctcctcgactggattaatgacgtgctggtggaggagaggatcattgtgaagcagctggaggaagacctgtatgacggccaggtgctgcagaagctcttgggtgagttcacagcagggacagctctgtcccacccccatctccctgcagcggccctgggctgggccaggattctctgcatagtgacatcggccacaggtcctaggaagacactcaaagctgcagtgtgcatctcccaggtggtgcccaggccctgggctgtggcttcagggtcctctctccccttgccgtttctacagagcacccagccatggggcagcagcaggttggggacagcttccaaaactgcctgcggctcccatcctgttgggtctcaggcccactttgtgtccctgccaccctcttttgacttgaactccttcggttcaggatgggaggcagcaggagggaagcgggtctgcagcaatattctgtgagtgaatgtgtcaccaaatacatgatagctcatgttccctcaccaggggcgggctctagtgtctgcatttgctgggtgaaggcagtttagtgatcttcccgggactgactgatgcatggtttgatgtgcagacaaaccggttgtttattcatcagatgttggatgagtcccgagggctgggtaccagggatacggtgatctttgaaacagacgtggtccctgtcctcagaacttacagtctgtctgaaaagacaaatatttttgaatggttacagttactgttcagattgcttgtgatgagggccttcggagatgccgcaggttctgagtagaggacgccggcctggcctgggggtggggcggccttgcagctcatatggaagaacgagcgaagagttgccaggcaaagaacggaagagcagagttcgcagatgatgcatgagaggaattcttggacttgtagtgggttctcacgatgcctggcactgtcatgtctcattgtcacaatggtcctagggggcagtactgccatcgccttcgacaggtggggacgttggggcccacagtctcctggtgaacagccgggcagcctggccccaagcatagctcttgagcccggccgcggggcctttctctgacctgtctacggagcagccccaggtacagggcctgggtcaggcgctcctgcatgatcacagctggttctcacaacagccctgggggtctggctgaatgagcagatgtccctggttgtccccacgatgccttttgtttggatccaggagtgaatcacacatgaacgtttgtctcttcttttaggcttctttcatctggaaccgccttccctttccctctctccgttctgttctgtctttctgtcttttatgacgttttggaagggtctgggcctcttgtcttgtagaatatcctcccatcgggatctgtctgtctcctcacgatgagatctgggtcacatgtttctgctgagagtgtgactgcgctgcctgcttgtcctcctgggggcatcgtatcaggaggagcacacaatgtcaggctgcctgtcattggtggtgctgacagtttgatcactgggttaaggcagtggcctatgggtttctccattgtaaaggtgcttctttcctgttaaaaaaaccacttttttatttgttctattttggtagagtcaggatctcactcagttgcccaggctggagtgtagtggggtgaacatagctcactgcaccctcaaactcctgggctccagtgatcctcacaccttggcctctagagtagctaggactacagatgtgtaccaccacacttggctgttttttttttttctttttttgaaatggagtcttgctctgtcacccaggctggagtgcagtggtgcgatctcagctcactgcaacctccgactccctagttcaagtgattctcctgccttagcctcctgagtagctggggttacaggcacataccaccatgcccaggtaatttttgttttttagtagagatggagtttcaccatgttggccaggatggtcttgatctcctgacctcatgatccacccacctcagcctcccaaagtgctgggattacaggtgtgagccactgtgcctgactggctaattgttttgtattaaatttttaaatttcatttttttgtgttagagacagggtccttgctttgttgcccaggcctgttttgtactggcctgaagcaattctctcatgttggcctcccaaagtgttgggactacaggtgtgagctaccatgctcagcccttctttcctttttaatacatggtctctagaggggcagactctgggactttgtgaacgtcctgttcacccatgatgcgctccccatgattttatcatccgctgattatcattctctaaattatgctaaatatcatctctaaatattatgctggaggttgcaaaatagtgatttctgtatctttatcatggcttccccacttattagctggcattttcttctgtaaataagtgcttttcttctcctgtgtccttttttaaaaaaaaaaaatcccctaaaatagaataacacattcccctggactgatgaattattttatgttcaaaagagaatggtaattagatagcaaaatctgggccttatgggtgcttgtggctcctggggtgtcattgcttctagtctctttaagccaaaagaggtagcaaatatatagttttttaaaaattgtgagttcacactgctacttctaattccagttcaatgctacaagtttatcccttaactgtcagcattcagtattccagtctccagggagaaccttggttccagaaatatatttgctatttactctgattgcatacaaaaatagtgtcagaattacaataccaatacctctatcaactacaaacatgctaggtacaagatttctttgccattattttttaagtacaatatatccactaagagtatatagtcagaattctgtgttcagaacttaactgaattattttctttttgagtggtcatgtcatccatttaatgtataaataaattaatttgtttctctctgtatttagtttttgtgtatatgtttacatttaattttatttaatattacttttaaaaatgtaaagcatttacatgcttcaaaagtcaaaactatggaaatgacataccttgaaaggtcttagccaggtgtggtggctcagcctatcatcccagcaccttgaggggctgagccaggaggatcacttgagccgaagagtttgagaccagcctgggcaacatagtgggacctcgtctctacaaattaccagtcgtggtgatgtgcaccgtgcacctgtattcccagctgctcaggaggctgaggcaggaggatcacttgagcctaggaagttgaggctgcagtgagccatgattgtaccactacattccagcctaggcaacagagtgagaccctgtcgatcaagagagagagagagagagagagagagagagacagagagacagagagagagagagagagagagagacacagagacagagagagagagagagagagagagagagagagagagagagagagagaggtctcactgctttctctcccacgtatacactcccaggtaacaattttcaatggattctgattttatccttcttatgtttctttacaaaaatgtccatatacacacctactcatttcccttttattccttgcataaaaggtgatgtattttgtacattcttttacacaccctgcttgtttcgcttaatatgttctaggaatccttgcatgtggagatcacctttctttttctttatggctgcattgtactccactgtgtggatgttccttcgtttattcacccagtctcctatgtggggcatttttgtcatttctaatatttttctatcaccagtaatattgtgggaatatcctcgtgcagatgttacagaaactagaattgttgacctcaagtgtaatgggttgcttccttgagctgaccactgtagaggaaggaattctcaaattctgagaggcttcacctctctcacctctggccttcccaggtctgttgtgccttggttgatctttcctgtagccactttctgtcttccctggactgttcagtgtgcagacatgatgtaatatttccattaaaaaatggctcccttgctcctgcaacactccaatttctctgcatcactcaaatgtattgaccattagatttggcaccggatgggtcattggtggcccagatgagagcagttttggcgcagtggtgggggtaacacgctgatcggggagggtccaggggcagagaactgtgcctttgaggtacataattttgagagggagagagaggaagggagtgaacctgtggttgctgcagctgcttttcttttcaagacagggtctcactccattggctggcctggagtgtgggggtacaatcatggctcactgcagcttccacttcctgggctcaggtgattctcccaccttagccgcccgagtagctgagagtacaggtgcatgccaccatgcatgacttattttttgtattttttatagatacgaggctttgccatgttgcccaggctgatcttgaactcctgggctcaagcaatccacccacctcagcctcccaaagtgtggggtttacaggcatgagccactgcgcctggccaatacgaggctttgccatgttgcccaggctggtcttgaactcctgggctcaaacaatccacccacctcgggctcccaaagtgtggggtttataggcatgagccactgcgcctggccatagtagctccttttcatgtctgtccactgggaaccatgcaagctgcctgctgaaattacgtggatggagcccctggcacagtgcctggcacaggtctgtcgtcaataagcaggagttgttattgctgttgttttttaaacagacaaataaatgccaagagcagaactaaggagtatctggctcgctgctgggtaccccatccaccccaagtcccctgggtgactggcacatgacaaatatttgttgattaagtcaatgaaagaattcctgcagtttcattacctatgaagattgtggggtcctcttgtgggacatgaaagggggacagatagatgagtattgtttggatttttggtcctcagtgccatccacagactccagaagggatcagctatttgctgaacaatctttcagttctcatagagccctgatatgttttcagggtccacaaatgcctgtgacggtggcctcaagaacccagtgtccccttgtaggtgggatagcatacctcttaaaggtcagcatgagattccacccatgtcatccccagcattggtggggtcagcagatcctctctctggggtttcttttctgctcaacctccctgctttgatggactgcacagacaagccccatcttggtggaagggtctccccatgggctgtcctggagggtcactcccacagatatgccccatcctggtggaagggtctccctgggggctgtcctggagggtcagtcccacagacaagccccatcctgtgggagggtctccccgtgggccatcctggagggtcagtcccacagacaagccccatcctggtggaagggtctccccgtgggccgtcctggagggtcactcccacagacaagccccatcctggtggaagggtctccccatgggccatcctggagggtcactccctcagggcagggctggtgactggggtgggatcatgtttttctccgctgttgtgacagaggagtatctgctgcaggggatacgtggactgcggggggactgccacaaggatgtgaatgggtagggggtggggtgctgtttaggagagagagagactaggggagcccctgccagagaaacttggccctgaaaacacaggggtgcagcatctgtagctgcctctggacagagtttgcacactctgcacaaatggctcttacagaccagctcttggagggaaacctcctaggcttgtgacaggtggtggtgagggtggggggatgaggtgctggggaggccatgtcccataactcactctgaaggacacagtgatgcttggaccacattgtttgtccttattcatctggccctcagaaagtatatttggagggaaacatgtctgtgtttgttttggtcacacattcattcattcatctgatgaatgaatgttcattggcttacatgtgtcgggtggctcttggctgtagagacacagtgggaaacaagagagatgagccccgcaccctgcgcctgcccactcccccagcacacattctagcagagtgaagaaagagaagtattatggggtggagtggttcaacctgaaacctagatgatgttttaaaggaatgacaagtgctaggaggaaagtaatagaaggttatggggtacagtggtgggtgggggttggggaaggcaatccagggaagctcctctggggaggcgacatctgagcacatgtctgcacagtgagcttgggaagggcgttctgggctgaggctctaaagcgagaaagagcctgttgtgttggaggagcagtgaaaagaagcggaggcggggcccaggtggcagagagggagggagagagccaagagatgaggctggggccagatctcattcagccctgctagacaacagtctattccaagtgacaggaagccattggaggttttgggtagggctgtgacgtggattgggttagagtttaaaaggtcacttaggcttctgggtgcaggatggatggggaggagagtcaggagttggaactgagagatcagtcaggacaccattgccatggcccaggcatctgatgaagtagctcagcccccagagtggaagggcagacatggggaggtactgtacagttaaactgccataggaaccaagactgatggccaggtttgtggcttgagcaactggtaaatgggaagccgttgggagtagggtgggaggttgggaaggcgggggtctgtgttgtacatgctggggctgagatacctgcccttttggaggtgatgctgagcaggtgagcctggagtccaggctgcagtgtacgtgtgaacccagcagcactgagctgatgtttagcaccgtgggactgcacggcttcacccaaagagggtgttccaaattttatttggctgaatgccgaatgcccaagaattaacatctatatttggctaaggtgagaatccccatcttagaatgagatcccatggtacaagaataagtctgaaatgttcatcaagattgtgtcataattatcacaattttattattaaaaacgttagtggccaaagttttgatgttttgcattgcagtatcagtacagtcacacccagcactgttgggtaccacttgctcttgaggtcttcaaaccagacatttgtgatgctagatgctcactttcaactcagaaggctggaggagcacgtggacctttggctgatgctgtctgaagggatactcctcatgtgaagctgcccctgggctgtcagtttttctctctctgagtggctggttatggtagagacttacctcctctttgatcttggatgtgaagattgggctgttgctggtgatggccctctgttgaagcagtccccccaattggtactttgctccctacctgaagcagatattttctaatattttcagaagcaaacttgagtgttttgttcactttcattttttatttctgattcttttgcctgcacctgtggcttctcccacccaatgacttgaaacagtatgtcagcaagccttgtatctggcagcctggctgtggaactggccctcagaatctcaggacaggctctgaatttgcatctgcatctcagccgtggttgcctgtaaaccatgccagtgccttctatagagcagaattacaggggcatctttaaagctgcatcttcccctctcaaggcacatccttttggttccctcttcagttagtgctagcaaatgcagcacttactccggagttgctgtgattgtccatgagtcctgctatatcagttgtgttatccataaagtataacatgaggcttcctttggctcaagcagcctttttcttgtggagtagctgctgttccatcttgtttgaataatcacataagcacttgagaaggcaattctaaaatctcttgagtgtcaagtggtttgacatattaaaaccactttttttttttgtactgaaaaaaagaacagtggactagaatattcagatagtaacacagcatcagaatgtcttgcctcattttgtgaatgttgttacactgaaatgacataatatactgttgatgtgagatcctcttgatgtgatactactgatgtgatcacctgatccttgagctccaggatgccaggaatgacactgatgtaggcattcagctctttggctttccaaaggcagaagcccaaaccaaataggagattttagctgaataccaaggtcaaagccaacttctgtgcatccgtagtagagaagaggtctgaggactgggtctgggctgtcagccattagtggtcaggaagaggaagttctggcaaaggtcagtcacaagggagggggagccagaggagtgttgcattcaggaagggtaaaggaggtgtttctaggaggtgagaggaggaaagagaacagacttctggtttggccatgtggaaattgcccagagtgaaccagcaggacccctgaggagtccctcttctttttttttttttctcttgagatagtgtctcactctgttgcccaggctggagtgcagtggcgtgatcacagctcactgcagccttgacccctaggcttggatgatcttcccacctcagcttccccgggaagctgggatcacagatgcataccaccatgcccagataatttttgtattttctgtagtgctgaggttttgccatgttgcccaggctagtcttgaactgggctcaaacgatcctcccaccttggcctcccaaagtgcagggatcacagggatgagccactacacccagccgaatccctcttcttgagagaagattctggaagcagctgccgggttctctgccacatgccaggtttctgggggtgtagctcccctgtgtttgcagtgcagccctcaaggtagactgcatatggccagagtgaggtgcccgtgctgtgggagctcctggctgtcgtcctgctggtcactcacgggcacaccctctccttgtgaaggtgaagttcttcatcacatgtgtactcaacccccatgtggccatcactcagggtcacctgctacatgggagaatcctccccagttttctctctttctgtgctaggaagataggggtcctggccacaacagagccctgagctgctcctgcggcccccgccagtgggcacagtgatgtctgatgatgcaagtgatcatgtgccgtattctctgttgcacaggagtcacccaagacccagcctaaggcagcacacaggcatggccagtctctttggtctctgttgcctgctgtttccaccaccaaattcatattttcaagtcctacatgcagggcccacccatgtgacctcattttaccttaactgcctctttaaatacaggcacattgcaaggtatgagagcctcgcccactaggagagatgggtagcctggcagcctcccactgtccctgctaccagccagccctgcaggttgaacctcggaatgtgactgtatttatagagataataataggctgggtgtgatggctcacacctgtaatcccagcacttccggaggctgaggtgggcagatcacttgaggtcaggaattcgagaccagcctgatcaacatggtgaaaccctgcctctactaaaaatacaaaaattacctgggcgtggtggcacatgcctgtaatcccagctactcgggaggctgaggcaggaggatcgcttgaacctgggaggcagaggttgcagtgagctgagatggtgccattgcactccagcctgggtgacgagagtgaaactccatctcaaaaaaataaaaaaattaaaagaggtaatgaaagtaaaatgaggccatacgagtgggtgggccctaattcaatatgtctagggttcctataaaaagaggagattaggacacagacatgcacagagggagaccaagtaaggacacaggaaggagagggcagccatctacaagccaggagaggggcctcagaagggtctaccctgccggtgccttgatcttggacttctggcctccagagctgtgacataaatctccgttgtttaagccgcacggtgtgtggcatgcttcgttgcagcagcccagacaaacgaatccagtgtcctccgctcctctgccgactcctcttcctccaccctgggtgacgtggccatgttcagtctgcggggccggatggtggcaggtgcaacgggggcgcgtcaggcttcccatctccctggtgggcgaggctctcagaccacccagttctgtatgatcctatctctctccttccttctccaagctgccctgctctgccctttccatggttgttgaacacctgtgggacctacttgctctctacttccagggcgcaaattcagacagacagctgtggatgactcagcgaggagctgttagatccagatggagggaaatcagatgaataagcgggaatcgtttccactcccctgcaggatgtgttttgttgggctgctttgttttttctcttgcagtcattgccacccaatcagatgttttttacgggtgtttatctccccactagggacctctgttatctgtgccatatccagcacctaggacagtgcctgtcccatagtaggtgttcagtccctatctgtgagccaacaaacgcatgatcgaaggggtattccgagcccagcaggccttgctctagaattttattatcttgaaagggatgccaaagctgtttgttttctaattgagggaggggaggctgctggggagataacactgaagacatgggggcctccagctaaaatgttttaaacagaactttgtgctgggaaccacttgcaaaacagaaaccccatttgtgactggcctggacttgattgctttcatgatggcatgtcaatgccgcgtcactgacagcagctgtgtattgaaggctctgtgctgagtgcttgcagtcaccctcccagtgaaccatctcacgatgctctgtgacgtcgcttttgttgttttgcagagtggatctatcagtaaacactggagtcttagaatcgaagactagcagggaaactgggggtccttcctgctgtgtggccctgcagcgggcgtggggtggggcgctggtggccggcacctgccagtacctactgctaacaaaagggaaattgaaggaggtgcaggctgggctggagctcagtctcagtaattgaatcttgatgaaatgtgacagttcttgtctgtgctcctccggattgtttcctgttcattcttggtaataaaatcatcgccagttctgtgaatatctaatctaacttcctattgtggcattagaatgtttaagaaacaagaatgggagcctcaggtgtgtggggaggcagaggcagcttttaagaccttttttaaaattatctttatcagtcctctcccttttgggacccacagggacagtcttctcacctcctgactcccactttcattcttcccaggtaacctccttgcctctcaactacatcttattatgttttttccattttgtatgcatagaatgttcccgagtataacacccacagttttatccttaactattcttcccttttcaatctggcgtcattctctaaggaagattagtgacctggaagctcagcgttcatggttcaacatctcaagacgcccccatggccacatggtaacctgccccgcttcggggacctccttgaggctggggtcttggtggttttgagttcctccagtatatctctctccccttcctccctccctccctccctccctccctccctctctctctctctttttttctttcttctctctctctctccttccttccttccttcctttttctttctttctctctctctctctctctctttctgaggcagggtctcactcaggttgcccaggcttgggtgcaatggcatgatcttggcttactgcaacctccacctcccgggttcaagcacttctcctgcctcagcctcccgagtagctgggattacatgtgtgcgccaccacgcctggctaatttttatatttttagtagagacgggatttcaccatatttgccaggctggtctcgaactcctggcctgaagtgattcacccacctcggcctctcaaactgctgggattacaggcatgagccactgcgcctggcccttccagctttttctgaccctcttctcttgtgcttctcattgcagaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactgtgagttccacgccacagggggagggactgtctggagggagcccgtcctctcgacattcgtcatccacatttgtcatccacattcatcatcatcccatctggccttgcatcttaaaattgggttcatctccctgctctgtaagaggtagaacattgcaggggagaagaacaggagaagggttagggagatcctagaaaagggacctggtcaggccacaattctccatcctccccatgctgcagaggagagaggcaatgtttatggatgggtggatcagagggactttgagagagagaagcagccttggggggttcttgttgggactcaaccccaaatactggtggcagcaacacctagtgggctgtttgtctatgaccctggcattatgagatgtgacatcacggtattttcagccaagacatgaacccggcaggtgaaagactaaaccaggagaagctggaaagttctcctcggtcctgcccactccttccccacctccctcccctggaagcagggccatgagggtgtggcttcagggctctctgtgctgggccagaggtctccgtgctttggtgagctgggctctcagtggtaggcaggagaccctggagcctggccttgcacccggtttcttggtatcgagaccttgggcagacccaggctgtctcgtgggtggctgggtccgtgggtggggaatcgggtgccttgtaaactgtaaaaccctgcaggagaagtggtgatgttgaccaaacctgagtccgcatgctgaggaagagagaggacagactcaggcaaggcaggggctaatgtctaatgtccccagagtggcctctgctcttggcagcctacccttgttgggatggttcattgcggagagggagcccttttttagtgccagagataataacgcacatccttgtgatgggtaagtggccgtgacctgctttccatgctcttttcccttctgtgctaattttactatcctgttcctttccctcatcactgcccaatttattgcttttaaaaacattgtgcttctaaaagtggttgcacaagtcaccttaggccaacaggaaaggagacagtgaagctagaagtaaattcaccaggttgctcatcagctctcttgatttgtccacacttcgctccatccttgtctcgctggggtctcatttagatgctgtgtctctgttgccttctgcacgtgggctcaggttcctgtgtaacctgatctaaagcgtctcccttcctccttcctcctgcagcaattcacgggaagaacctggtggccatcctccacctgctggtctctctggccatgcacttcagggcccccatccgccttcctgagcatgtaacggtgcaggtggtggtcgtgcgggtgagtataaccgagtggtcggcctgcctgtaactccgccagagaggcaacatcttcctcctgcagttttcctgccctccccctccttttttccccccaggaggctaccttctatttttcccttttgacaaaatgtgtgtctcaccctggctccgagataaatgattggaacgggaacaatggcattgatttgatgagaggcagaagcagaggcatgagggtgttgaggtttaattttccacatttttgaaaagaacattcatttctctccaaagccaactggttggaattcaatccccttgaatgtgcttattactcattggaggaggttggccccgcgggatgaaacagacacccaaattaaagccgctttgcattcgttggggattattcatcatgccccatcatctctttttttgggttcatttctcttgattcacttggagaaatggaaccagaacccaggtccttctaacagagggtgaagtagagttacctttctcttgctatttcccttacatttattttttattttattttatgttttgtgaaagggtttcactctgttgcccaggctggagtaccatggtgcagtcatggctcactgcagcctcaacctcttgggctcaagcggtcctcccgcctcagcctcccaggtagctaggactacaggcacatgccaccgtgcctggctaatttcaaatttttgtagagacaaggtctcgctatgttgcccaagctggtctcgaagtcctgggctcaagcgatcctcccatctcagcctcccaaaatgctgtgattataggtgggagctgccatgcctggccttatttcccttacatttaagtggacagtcgctgcctagggttcgtgtgtgcagtttccctcagtaaatgtgcaatgagcgcctactattctctaagcactcagcataggctgccgagccactaaaggaggaacacatgcctggcgtctgtgggggtgaccactgcggccagagttgaggtcacgctcggaaccttggatgcctctgtgtttattttactcgagacatccggctccactttcctctggtttttaaacttctcagtcccgtggtctctgtggtcggggaggacctggctgtcactgtgttttccgaacccattctggcccctctgttaccctgggagctcagtcttgaccggacgggaatgctcctctctggcatccggcaagggccacctgccatgtgtccatgtttccttcctaaggaggatgtttgtggctggtggtggtgactcgggacctggggggccattcctatggccccgtgtcttggccactggttcacaggcagccggcctgaaaaggcttccctaggacacattgggatgtggttcccaagcctacctacgtcagctcggggccccaggagccctgtgcaggctcagaaactggagtatttcctttcaggcttgcacttgggtccaagataatctttgcggtttgcagaaagtttgaaccaggcaagcacttgctggtgcttcctgccataacgggttagaggagtgttgtttggccacgaccaaagcagaatgaaacgggagcagggggtcctgtgaaccgggcgcagttactccccagaccttagagccgccttctgtcttctctgcagccccctggcctctgagcttgctcaggggaccccttatctaaccccagatggaatggttggtgtaagggatgtggcatttccagggtggaaggaaggaaggaaagggccttatttactgcctggccacgtggctttgggctgatcacttgcttttgctgagctgcaatgcttttccccataaaaccaagattttactacaaacctgtaaaacatccagcttcatgtctacaatcctagacctgggcccagcacctggtgggtgcctcaggcatgtttgatccttgactaggtgaacacaatgtctggaccttccttggcaggcactcctgagaatcaggataaatgtcacccacactgttgttcaataacaagcaccaaccctgagtattccatggaggtcaaactcaggaaagggatggaagcccagatcttggtggtgtccactgtgggctggcccagcgggaaatgagttcccagtcccttgaggggttcagtggtggttggattagccacccaggctccatctggagctcctgtgacaggcgggctgccacccctaccatcaccactgccatgcccccctcactaccatcattacttttttttttttgagatggagtctcactgtgtcacccaggctggagtgcagtggcacaatctcagctcactgcaacctctgcctcctgggttcaactgattctcctgcctcagcctcccaagtagctgagattacaggcacatgccaccacgcccagctaatttttgtatttttagcagagaccgggtttcaccatgttggccagaatggtctcaatctcttgatctcatgatctgcctgccttggcctcccaaagtgctgggattacagctgtgagccactgtgcccggccatcattgcttttctatacctgccacgctctgggagaagtgtgacatatactgtgtcagtttcctagggcagccataacaaagtaccacaaaccaggtggcttaaaacagcagacatttattctctcgcaattatggaggccagaagtctgaaatcaagatgttgtcagggtaggatgtcctccctcatgtctcctcctctaggggaggggtcttcctgcctcctccagcttctggtggtggctgtcagtccttggtgttcttggcttgtggccacatctctccagtctctgcctctgtcatcacatggcctcctccctctgtctgtttctgtgtctgtttcctcttctaataaggaggtgagccatattggattaaggaggggctcaccataatccatgatgacctcatctgagctagtatctgcaaagacccttatttccaaatgagatcatgttctgaagtttgtggtagatatgaactttgggggaccctcttcagtcccgtgcacacacatgattgcaggggatgttccctgttatttatgttccttccaattgcatgcctcacctctcctggctgcaaagcatagaggatccctttggggaatcctgacctggggtgtttctcctgagacccacacaaatgccaactctcaaggccacgtggagaccagagggtggggaggaggatagggacaggttgtggtcgctgaaaggcaccctgcccagggtcccctgctgtgtactcacccaggcctggcatgcgtgttcaacaccacccctccttctcctgttgctcttttctaagatgatctccggccccgcagcttcgtctgccctgtcagtgcatctttcctcaactctccactgcctgattttgtatgtttattttggggttttcagaaacgggaaggcctgctgcattccagccacatctcggaggagctgaccacaactacagagtaagtggacccctgtcttgcccttccaggccctgctgccccgagtgagtgggaccccaggctgccacttcagccagggacaccagcgcccatggggctgctcccgctccacaccccttctctgtagcatgtgattctcatgctggttcccaccccagctctcctccctctgcacactttcttcagagtttttaacattagaactgagttaccttccacagactttgaattttttcattcctatcttaaaaggtgagctgtaagaacattgcaaagtggggcaggcagagagagttcaggatggttagagagaaccattgtctcagttcatttatccatctacattagccccatcagaggtgggagctacatctttaaaccagaactttcctttgacagacactactaagccatctgttatctcctagagaaagccagagggcaggtgttcagaagtctaaaaggcttcaaatctattgaaaatagcaaatcaaacagtatctgtggtatgtggttttaaggactccttgtgataacctgctaagaatctttagaattcactgcatttgtgcctcttgactaaacctgtttcagatgaaacagaacatttaaaaattgattgtctcagctaatccatcagctaagttcacagagtgattaattactgtgttgtgaattcatggatggtatttcaaaaattggagctgacacaggaaaccactcgtggcttgcaagctctcagggaagatgatgggacagtggagtgcaggctgatgcatgtgcagaggcccatgaagaggcctcccagtctgccccaggcccacgaagggaacagggagagctggaaaaggggaggatgagaatgtggttctttgcccagcacagtgggcctttggcagcagctctgcctattcagcagtaggagaagggctgctcgtggggaactgggattgggctggtgtcttagttgtttattgttgtgtaacaaatcacccccaaagtcaagtggcttaaaacaacatctgtttcatttgctgctcacaattctgtgggtcagcaatttaggctgggctcagctgggcggttgttcagccagtctcgcctggggttgctcatatgatgcagacatctgaaggctggatggaggctggggaggctgagatgggctccccctacctctggtggttggtgttggcctcccctgggtctctttcctcctcacagtgctgggcatcttcccagggtgctctcagggtcctgagagagtgagaatgcagctgcagtccccttgaggccttgtcttggacatccatacctatgtcctcaattctgtgagtcaaagtgagtcacaggtcatcctggatcaaggtgcaggaaacagactctgcctccttgtgcaggaatggcctgtgcacattgttgggtggtgggcatgctgtgataggagttcccctctaggtgagggggtcccatatgaggacagcaaggaggagctgggccccctgccataaaactagaatggtccagagacagagaatgagcaagtgggtgggagaattgtctcagctattcatcagcagtaagtggccccaaggacctgctgcatgccagcctccttgctggatcaacagagacactgagaggtgggctgagtgcagttcttttcctccagggcgacccatcctgctgatgagaaaggatgcatccacagacatgtacagtctaacacaggggcttgtgggaagtgcctcggggccctaagggaatttccaggaggaggggagcaccccaaagtcagggaaggggagatttcagtgaaagccacctcaatcagatatcagatggccctgagcagtgaggaagggagttgggattttctagcctgagtcagtgtccctctgccagccagggtcagggtaaaggagaggctgggtcacctctccaggatgatgccccaggtaggttctcctcagggctggtcatcccatccttgtctcctgttccttcccctccccgtggctgcggaggctctgacggaacatttgaatcattggatgtctgctgaaaaccagcggcccaaagatccacattcagtttcctaaggcagcattgccacctcctatccagtctcagtgttcccctttctctttcaagaggtggctatgaggtcaccccttccaggaagccctcctgtctgccaagcaggagtgcttggcttcctgttagttcccttagcctctggacacatgtggccaacattgaaatattggcttatgaggtctgtcactcccaggcatcctgagggcagggccacatagtgtttatctccaggggatgttaatttctgtatctgcacagcctgcacatagtaggtactcaagtaagtgcttgttaaataagatggagccaaaggacttgagcctagagggatttggggacaaagtaaagacttccttgcctctcaggaaggcagtgcatggaaaggatctgtgcactcactcactgggaatctttgaggagaagctgctcaccactcccgtctcccccattgcttccgctgccgcctgcctgagatcagggcctggcctcgtggttctccaggatcctttagttccacaagtcctgcaagtacattgtgtttactcctggaaacatgagtaacctgcaaccttgtgtgtgtgtttgtttgtttatttatttatttgagacagggtcttgctctgttgcccaggctggagtacagtggtgcgatcccagctcagtgcagtcttgacctcccaggctctagcgatcctcccacctcagcacctgagtagctgggactagagcgcacgccatgacacccagctaattttgtatttttcttagaggaggttttgccactttggccaggctcgtctccagccttgcatttttttattgttttgtttgtttgtttgtttgttttttgagacagagtttcactcttgttgcccaggctggagtgcaatggtgcaatctctgctcactgcaacctccacctcctgggttcaagtgattctcctgactcagcctcccaagtagctgggattacaggtgcctgccaccatgcccggctaatttttgcatttttagcagagatggggtttcgccattttggccaggctggtctcgaactcctgacctcaagtgattgacccgattctgcccctcaaagtgctgggattacaggcatgagcccctgtgcccggcccagcctgtgttttgagcgttccacggctgctggaagacctgttgtctgctgaaatcttcatattaaccactcttctgatttaagtacctcccctccaaacaacattaccagggtggttaatgtgcaaatagagatggtgatttgctgctgaccttgtgcaaacattaataattcacacaagcacctctcgtttataattagagcaggctggaacacagcaccatgtgacttgcgttcttatcagtaggcctttacctgggcagcgagggcccagctttctggctggctctgtccctcatcctccattgtgctgcttgtgaaactgtgttctgagtgacccatctcatggctctctctgtgttcttgtttgcaggatgatgatgggccggttcggtaagtaaccccagggaaagtggggagatggaggcatgttagggctcccccaggaagctcccagagagtgtacatggttatctggagggagtgggaaactagatgggtctcactgcccccatagttctggaatcctagagaaagtgcacagcccacccccacctttctgtataatgggcttgtttctcagagctgagagtggctgggttgtgctaggaggagtggggtggaaggctgggtgaccagctaggggagcaggaggggcctgggatgtaacactggctggaactgtcaggggctggagcaagagtggttgagggtaaaagggagggaggagaggcagccagcacatggagcgtcgttagctggctggaagagagtggctcagctctgtggatgtccttccatgtgtattatttcctcctggaaaccactggtttagcagacttccttagagtcaggcagccagggctcattcctggctggtggcttgtggcctgccccttcctctctctgctcctcatccgtgaaatgggagtgtaaaaggctctccccaggcaggggctgctgtgagtattgggtgagatcacaggtgagtgccctgcttggccgggggacagccctctatgtgggctggttttattagtgttggttttcagtggctcttcccaaagagagagaggtaatcactctctcttccctcatgaaagcctgagacctcatcttcatctcggtgagggatggtaacgtttcaaccctcagtaccaggataccccggccctcggcctggccagcctcagtgctttgggaagcatttcaaaagagaaacctcttgacccccagataccctgttctccagtgagcagggaggggagaacagctcttaaaaggaaaaatggaaaccagatagaagtctcccacctgcctctctagcggagctgatatctgtcttttgggggccctctgggtgggggtgccaccccctgagtcctatacaatgagggctgggccagcttggccatggggctctgtaacctcaagttattatggggaccagctaggatgccattgctgcttatctattgtattagggttctctagagggacagaagtaatacgatagatagatatatataaaggggagtttactaagggtattaactcacacgatcacaaggtcccacaatagtccttctgcaagctgaggagcagggaagccagtttgagtcccaaagctgtagaacctggagtttgatgttcgaaggcaggaagcatccagtatgggagaaagatggaggctgggagactaagccagtctagtcttttcatgttcttctgcctgctttttattttggctgtgctggcagctgattaggtggtgcccacctggattaagggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaagagaaacatcctgtatatagttgctgagggaggcgaaaccgcagtggggtcacagctcatgggaccggggtgaggcgtctccccaccctgcgtctaggtagaggcgcgttttgggggcccagtgcccccctctgtcacctcttctccatcttttcttcctggaggaggctcagaacccctttggaattgtagaggcctaaagatgaggagagggccgggcgcggtggctcatgcctttaatctcagcactttgagaggccgaggtggatggatcatgaggtcatgagatcgagaccagcctggctaacatggtgaaaccccgtcactactaaaaatacaaaaaaattagccgggcgtggtggcgggcacctgtagtcccagctactcgggaggctgatgcaggagaatcgcttgaacccaggaggtggaggttgcagtgagccgagattgcgccactgcactccagcctgagtgacagagcaagactctgtctcaaaaaaaaaaaaaaaaaaaaaaaaaaaaaaaaaaaaagatgacagtgggcccctcaagcatttttgagtctttttgttttttttgtggcgctgtcacttttgtgtttggttcgggccttgttggaggtttagggaaaagacagtctgttcagttcagttgggagcacatgggcctcaggctgtgtatagcaccctgtggcccgagggcccagaagcctggccccggagcccctgccaccccatgaatgagctttagggtctgatggctggggcagtggctccctaggtaagagccaggtgtcacatgtgaaaagtggacccagctgccactccaggggtgggaggactgtggaatcgcaagaccatgtacaagaggccgatggaattgttctcgttactttgtaggctttatgtgctgtgcttgagaaaatgcaaacaggctattagtcggtgacaggcaattagttccacccccggccttgctgcttctgctgacgcaggttccgaagtctcctggttacccagcctggcaccctcaggcacagcagggtgtctggcccggcacccgcccctgtgggggcagcagcacgccttgtcttcgcttccctgccatgccattcccctccttcagcccccgagagcaccccagggtgctccctcctccagcaaccttcacctgaatgctctccctctagattaccccatggctcactctttcagctctgccagctcttggttcaaatgtcactgatcagggaggccctctctgactccactgccccaaactggcctccactggctctcctccccacccctgccttagttctttctgtactcatgtgacacaccaagcagcactcagctcatggggatggcctggctcctcttccctgtgccagtgtttacacaacgaagcttgcacgtgtctggcagacactggtgccagcaaactttcaggggcacccacagcccctgcctttctcctttcacacatggctccttgacccagaggtgctctgtgggctggagctgacctttcctcggggtgcaccccaccccctgccaaagcagccagccctggccacagtctgcacgcagctgggggcagatgttttaggagcttctggaaggccgggcagaccctccttggctaatgtgctgggctttgccaggagtggtcttctgggcctcagtttccccacgagtaccctgagccagggagggatggggactccattctgcccactccccatcattccggggagggaggtggctccacaggtcctcgctgcctcctgacagcatcactgtcctggatgaggtgggtgaggaggcttctctccacggaaacaagtctcaggggttccagggaggttgcagcctggtctccatggcaatgggtgagctggtgcggcttctccgcgggcggcccttccccctcctgggcctgccctgggctggaggctctttctgaggcagaggggaaagaagggggatgtgccttcctcactctcttccccctcattgtaactcctagtaattccccttcacgtctctcccatttctgccaacagggcttgttccaaaacctctggctccatcccatcacccgtggctcctgactgtgccctccataactcccacgttgcaggccacagcccctgttaacccctctcacagtccacccggctcttgaacctgcgctgggctttctggcatctctctctccttgtgcctgctggtccctcggtggagcgcctttcctcctcctcttgccccagcaagcctggcttgaaccccaggactgctttgtgaagccttcctcaggtccccccagcccttggttcatgggtcccagactcaggtgtctccagggaccaggctgataatataaaagaggagagtgtctagattatgcaatgataatgtcatctgccccttcaccccagggctgggtggcagtggggagtggtggggtctggcgcaagctggagagtccacacccccatccccaggggcagcttattgctgccaggtgggagtgcaggctcactgttgccacagcctccagttcttcaagagaagccagaagttaagaacttttggacaaactttccaatttaagaactgttcgctctcgccgggtaccgtggctcacacctgtagtcccagcactttgggaggctgaggcgggtggattacttgaggtcaggagttcaagaccagccttaccaacatggcgaaaccccgtctctactaaaaatacaaaaattagccaggtgtggtggtgcatgcctgtagtcccagctattcaggaggttgaggcagaattgcttgaacccgggaggcagatgttgcagtgagctgagatcatgccactgcactccagcctgggtgacagagtgagactctgtctcaaaaagcctaaagaccaaaacaaaacaaaagaaaacaaaacaaatgaaaactgttgactcaaatcaaaacattacagcgaccaagctgagcattcctgcagattgagcttgggcagccctggcatatggtcaggtcggttggccccccgtctggcttcgtcttttctgacactaacagggttgcactatcatagtttactccctctccaggccctcccccaagtctgtgcctcttccaagagaggagtccctccttgtttatctctgtgatgtccccagagcctgcggaggctctgggggacaggacgagcgggagctgtaaggactgaggaccgacaatgctcctgccaggctccatgctcctgcctctactcactgccccacttagttccacaccaagagcgaggcaggggctgtgagaatgctgcctttatggaggaagaaagggggtcggagagggaaggatttgcccagtcatggggtgtgaagtggggcagctagaacaaaataggatctattttcgttcccaaggccaagcacatcacaggggtgcagtatgctctctctgtctctctctctcccctaggtcagggtggtccctggggaggcccctgggttaccccaagacaggtgggaggagcttcctacccgaccctcttcctgtcaacctgggctctgcggctcccagggctgctccttgtattggggccccagcctggctggtaacagagggtccctccactgggctcagtcttctgagcatgctctgcccccaggaacctggaggatggaagttgggggccctgggtcccttccaaatgcccttgggtcctgtgcctggtccccagtgcccattttcagagcccctggcccctccctgccttgtggactgtgtgacgtgatgccagtcccctgggtccaggggcatggcagccggcggagaggcctctgcggccccgatgtctccttgagtggcttgactctgccagcccagcggtggcccagctaaatataccctggctgacgtcaagcactcttctgctcctggggtttttcttaagctgcatttatagtttgcgtattgctttgtaaagatgtaaaaatttcactttttttttttgttttgccccttagcagactgtcttattgagtgtagtcttagatgattatgaaaatcatttacagctgccgcattaggaagctggcgtgtgtgcagaggcagggcattttggtcaatgttggtctttaggtgaagaaaacttccctcccttcccccagtcacgcacatgctcacacacgcacacatgcgctcacacaggcacacacacgctcacacgtgctcacacatgcacacacgtgctcacacgtgtacacacgctcacaccgcacacacgcacacccgtgctcacacgcacacatgctcacacatggacacacgctcacacacgcgctcacacgtacacacgctcacagcacacacacatgttcacacacaacctcacacgcacacacgtgctcacacacgcacacatgtgctcacgtgcacacaggtgctcacacacacacatgcacacacgtgctcgcacacgcacacatgctcacacacgcaaacacgtgcccacaatgcacacacatgctcacacgcgcacacacacgtacacatacactttccttctctcctttcctctttgtttctcaccacctccacaaggccacggaaggggctacttgggctgggctgggcaggggggtgtgagctgcctcctggggcccagcctgggaggaagggtcagcatgcttcctctgggaggaggcttggccaacttctctccgtaggtctctggcttacctgggcctaatcccttctttctttttctgggctctctttgtctctctcctaggccagggcggtccctgaggaggctcccctaggccacccactagacgggtgggaggagcttcctaccccactctctccctgtcaagctgggctccgcagctcccagggctgctccttgggttggggccccagcctggctggtaaaagagggtctctctgctgggcttggtcctctgaacatgctctgcctccaggaacctggaggatggaagttggggggccctgggccccttccaaatgccctcctccctgtcttttctgccctggcagtgatgccccacagctctgtgtctacctggagacctcagccctctgcttggggtccaagtctctgttccatatgcccctatggaactcccccctccatggcagcaggagcaaaggctctgaggcaagtgtgcaccagtgtcagcaggagcagctgggaggccggttggtggagtgaagtcagggagggtgcatgtaggaggataacgctgagtctgagtgtcccatggcacgtgggagagaggatggattttatctgagtgtcccatggctcgcaggagagaagatagattttattctaagcatgataagaagcagttggagggttttagttgtggtgggagtggaggggggaaacaaatgatcctgtttgcacttggaagggctcactctgcctgctggggagaagggctcaggggccaggagtggagtaggaggctgcagctgctcccaggcgaggggcagtgaggcgtgagcaggacatggccaccgtcgcgggggaagtggttggattcacaggtgacatttgccagtagacaaggagtgtgggaacagggagaattcaggacgcctcaagtcctaggacgtggcaggtgcagatgccagatgccatctatgtgtttcatatgagaaggtaaaaagcaggtggaagggaccctctgcagcctctagtccacgctgttctggttgttcccaagcgctcttgctcgccttggtttggccgggactgatcatcagggtcagccctttcattctggtaggaattggaaggattctaggcaggtgtgggagttgaggctgaacctcctgagggatcagaagctggcagggccctggattagggcagcaccacgggtttccataaacgctccttcgtgtctctctttgcatgtcctcagagcgggatgccttcgacacgctgttcgaccacgccccggataagctcagcgtggtgaagaaggtgagctattggtgggatgttggatgtgctctcccctggctcgcggctttttgacagcacaaacgccccgctgggaagaaggtgggaaaatgtttggaatctcagaaatgtttgccacatggattgaaatgtaattacagtcaaaaacctaaccacagtgcataaaatcagcgccttttaactcaacctcgctgctccctgggtgtcttcctgcccgcccgctccgcttctgttaagtgaattacccagcccccatttctttctgactcgagaccttttttcaatgtggaaatgtttttaagcatgtcagcctgctgctctcgctggcctcatttaccatctacagcctgcccagtaaacacgcaggcctgtgcggctgagctgtgccatacatggatttggcccgtttccctccagacagagaatgggccctcactagcccaggcagcctgctggtcaatctgtggatggaaaaatctccgaggctctggagttgggggctgggtgtgatcagcttctgggggatctgccagggaggcttgttcccgtcaaaaggaactggagcccactggctgctcattaacttatccgagtgcctgcaggcatcccattcaggaggctgctgcatccctccttcccataacatcggaggagcgctcatttcaacccatggtgcaggcaagagagttctcctttgtctaggacagcttacccaaacagctttcttagtgcaagacttgtcagaacctttaataggctgacctatactgtacttctccaagagggagcttggtaggaagcatttttcaaacttgtttgtttatagtgggatttatttatctatcaattttggggtaagacgcattgtattttagtggaacccacttttggaaaatgttggcctgggtttggacgatgagatcattcatttttggaagcattttgcaaaaggctgttggaaccgtgctaatggtccttctgggacaaagccttcctagcactcttgggtggtgagggatatacttggagcatcagagtcccccacctccacctcgtcacatgtggcccccagggaccctgacagaaccggttcagggaatgaatcaaatccagcttccccacttatcagctgtgtgacttctggcgaagggcgagattataccccccagcctcagtttccccatctgtcaagtggggacagagatgttacccacctctcagggcactgtgaggataaactgggattctctctgtgcatgggcttagccggcagcgtatagtcactggtagcattgagaatggtgtggcctgagattgctttcatctctcggtagataccatgttaattcattctgcgaaagacacattttcggcactggagccaccagcaaggaagaagacagaatcctttgatttgcctggtagcttcccactccagcctgtcccttcctcacctccacattgcaagtttaggtgtctgtagctctctgtgccccagaatgaagtcaggggcccctgcccacctctgcaggtttctccctgggtcgtcccctcctactccttcccatcccacccacatccagccacagcctgaagaccccaaagggtttgcagatgtgtctgggtgcccactcggctcactctcaccttgcactggcccaccctcaggcccagctccaatgctccctctccatggtcttaacgggggtccgcacacccattaatggctcatgaaatctcccttgcattgcgtgtttccctgtagtgccctatctcttgacttctccgtcccaccactacacgcatatggagaattacatcacaggccctttggcgggggccaggggtggagctctctgtgtttgtgtccttagcaccaagcagcatgcctggcacatagtagctgctcagtaaatttgagcagaatgggtaagaaatcatatcatgggcaggctgggcgcggtggctcacgcctgtaatcctagcactttggaaggccgaggtgggtggatcacaaggtcaggagatcgagaccatcctggctaacatggcaaaaacccgtctctactaaaaaatacaaaaaaattaggtgggcatggtggtgggcacccttagtcccagctactcgggaggctgaggcaggagaatggcgtgaacccgggaggtggagcttgcagtgagccgagattgcgccactgcactccagcctgggcaacagagcgagactccatctcaaaacaaaacgaaacaaaacaaaacaaaacaaaacaaaacaaagaaatcatgtcatgggcagtggtggatgatattgagtttctatcaaagttggctttggtcactgaggaattacaggtgacaggttttaagcttgtgccggagagaagccagtgccccttggtacttacataatagggctcagagagatcaccctgggtggatctccccatgtattgcaaatcgataggcaggctgggcgctgtggctcacacctgtaatttcagcactttgggaggccaaagtgggtggatcacctgaggtctggagttcgagaccagcctgatcagcatggggaaactccatttctactaaaaatacaaaattagccgggcttggtgacgggtgcttgtaatcccaactactcgggaggctgaggcaggagaatcgcttgaacctgggaggtggaggttgcagtgagctgggatcatgccattgcactctagccggggcaccaaaagctcggatgatcctcagtggtctggggtgcaggcttcaaacctgtagctgtctagtgacagagtggttcaattccacctttgtaggcccggcgcagtggctcacgcctataatcccagcactttgggaggccaaggcgggtggatcacgaggtcaggagatcgagaccatcctggctaacacagtgaaaccccatctctactaaaaatacaaaaaaattagctgggcgtggtggcaggcgcctgtagtcccagctactcgggaggctgaggcaggagaatgatgtgaacccggtgaacccgggaggcggagcttgcaatgagccgagatcacgccactgcactccagcctgggcgacagagtgagactgtctcaaaaaaaaaaaaaaaaaaaaaaaaaaaattcagtaggtgtggctcaaggcagcactttcctcagtcttctgagtatgccgtttattgttccaggtcacacctaagatacatttgcaaatgtaatgatcctcccctggcagtttcatctttcttaagagcacagggtgctctccagtatgattgttaaatatgtcatgcgtgcacggattggcatatgtgtgcatgggttggtgagcagagacgtgtagccaggatagatgtgggcattatgccatgaaaactaggggctactgtcaggatattgagtttgaaacatgggctttttattttagcaaacaggagatgatgaaagcgtttcacagagctggggctggcaaatgtcaagcctgcccctccagatgggacctgcatgcgggccattcatggctcctgtgtctcttttattcttggcagtctctcatcacttttgtgaacaagcacctgaacaagctgaatttggaggtgacggaactggagacccaggtatgtgctgctttggcttgaaggatcctttgtccaccgccattttcagtcagtgttttgatcccaggtggggcgcgtgaacaaagctggcgccattttgttcatctcacaaggaactcccgtggtgcaggcagaaataaccaccgtggccttctcagcccctctgtcttcctttcctggggctgctgccacaaagcaccacaaacctagtggctgaaacaacagacctttgtgtcctcgaagtgctggaggcctgaagtccaaaatcaagatggggcctgggtgggttccctccaaggctgtgagggaggagctgttcctggcctccctcccagcttctgtggttttgccaggatctttagcattccttggcttgtacacacatcactcccttctttgccttcatcttcatgtggtgtcgtccttgtgtgtgtgtctctgtgtccaaatgtcccccttttatcaggacgtggtcatgttggattagagcccacccatggcttcatcccaacctgactgcatctatgtaaaccctgtttccagatacggtcacattcagaggtcctggtgattagggttccactgtatcctttttctttctttttttttttttttaaagacagagtctcgctctgtcacccaggctggagtgcagtggtgtgatctcggctcactgcaacctccacctcccgggttccaaccattctcctgcctcagcctcccgagtagctgggactacaggtacatcccaccatgcccagctaatttttgtatttttagtaaagacggggtttcaccgtgttggccaggatggtctcgatctcctggcctcatgatctgcctgcctcagcctcccaaccactgtatctttttttgggagacacaaaaccccaaaacacctgagtggtgttattcaacccataacacactccagggctccaccccagcccaacacagggcctttgcacacgcagttcctctgtctagaacgtgctggccccttcagcctctgctcagtgctgctgtcacactgtggccaggacctagcaaatgtccccctggtaggtatgtacaacacatttcttctgcaataagtatatcaagtctacttccccagccccgacccctactcaaagctaaaggagcatccttaaattatatttttgggcactccgagagcattaaagacaaaatatgattttcccaggattagcagggtgcttgaatgcggaggtttttgagctcttggtacagacatccctaatgcacagctgatccttcttaaaccccaaggtgaatgcattcattcccttctctttctttaactttcctcatttgcttttctaattaaaaaactaattcaggttcattgtagaaatgtctgaaaatgcagataagcaaaacaaataaaaatcacccataatcccgtcacccggagatgaatgcacagagggttttgttcaggccttttctctacacatatagcgagtcatggacagtgtgggtctgtatataaaagcatcacggtctgtttttaatgtatatatttatttgtgtatcgttggccaacacatttcttattttccgcagtttacaaatgttgcacatttagcctcagattattttctgtttgagacgttagcaccccagaagccactgaggtgaaaagtaaaaatcttcctttctctttttctggagacctcccccttcagactctccaggggcagctaactgcagttcatggttggatgtgtatttttctagatattttctttttctttctttctttttttttgagacagagtctcattctgtcccccaggctggagtgcagtgacacaatctcagctcactgcaacctccacctcctgggttcaagcaattctcctccctcagcctcctgagtagctgggactacaggtgcgcctcaccatgcctggctaatttttttgtatttttagtagagatggggtttcaccatgttggtcaggctggtctcgaactcctgaccttgtgatccacctgcctcagcctcccaaagtgttgggattacaggtgtgagccacattttctatgcacaaaggtatttttctaaataacagtggatcttaccgcccactgttttgtaatgtgttttgtgtcactaaatacactgtgggcatcttttggtgtaagagaaagtgtgtgtgtgtgtttctatctgatcctttttcccttgctcgatctatcggtctgtctatattttgtcacttttaatgggaagtgtatctcatcagcgggaaggctgcactgcacctcattaaaccagtgcctcacgactggatgtttttctgctcctgtaaacagcagtgcagagagcagctttgtgcacggctgtctgtgctcgtgcctgcttcctcggaataaaagcctagaagtggagtcattagagcgaagcctgcaccgcacactttgaaggctcaggaagatttgctgtgtgggggcccctggtactgtcatggggcgtgtgaggggcactgctcccccacatccataccagctgtccccacagcccttctcagaggtgtctgcacatcagtattagcagctgagcctcttacattgagactctaaaattaaatttgcatttgtttttatttactcaatatcttcatttttttccccccgattaatcgtactatatagagtcttaaaagtacatttaaccactggtcccccagaaaaggtcgctggttacagaaatgcagggatttttgttttgttttgttgcaaaggaatttgggtatttttataaataccatatatcatttatgaagactgtaaatcattaacgtcttgatgccctaggagtcggagaggccctggtttaatttcttcaatttctatttgtgtgtgggtgagtgtggtttatgtagtctggtatgtgtggtttatgcagtctgttgggggtgtgtgtgtgtgtgtggtttatgtagtctggtgggtgtgtgtgtgtgtgtgtgtgtggtttatgtagtctggtgtgtgtgtgtgtggtttatgtagtctggtgtgtgtgtgtggtttatgtagtctgtgtggtgtgtgtgtgtatttgtggtttacgtagtctgtgtggtgtgtggtgtgtgtggttttcgttgtctgtgtggtgtgtgtgtgtggttaagtagtctgtgtggtgtgtgtgtggtttatgcagtctgtgtggtgtgtgtgtggtttatgtagtctgtgtggtgtgatgtgtgtgtgtagtttttgtagtctgtgtggtgtgtgttgtgtgtgtggtttatgcagtctgtggtgggggtgtgtgtgtgtggtttttgtagtctgtgtagtgtgtggtgtgtgtgtggtttatgcagtctgtgtggtgtgatgtgtgtgtgtgtgtgtggtttttgtagtctgtgtggtgtgtgtgtggtttttgtagtctgtgtggtgtgtgtgtgtggtttttgtagtctgtgtggtgtgtgtgtgtgtgtgtgtgtggtttttgtagtctgtgtggtgtgtgtgtggtgtaggtgtgtgttttccctccttttccaaaccattcttacattgcggacagcgtcccagctctgtgatggtgagtgaactcctcagcctccctgagcttctgtccacagaattaaactggaggcgatgggcagtgtgaggactgggtgagatggcgcactgagatcaagtgggcagggctcggcaggggttagcactgcggatgaggaggcggtggtggggcctctgggcctccgtggggattctgctccctgctgagctagacagcaggttgtggagagagggcaccacgctgggtgcttgtgaaagtggagggtcacccgctcgcagctgggccccccagccctgccctctccttgtggccgtccctccctccttcctgtgagcccgtgtgctgggacagtgaggagacaccacggaaggaagaaaagactcagcaggctcagggcctgcgggagcagcggcgtggccaccccagacctcctggggagaggtgtgggttggtgccttcattcacgtggcagcttccattccctggaagttagtccatggagacgtgggcatggcagctcaatgttgttctgctgggaaggtgccagcacgcttaaccagggtgctgtgggcatgaagcttccatgtggagacacacttaaaagaattcttcaaacccgtctgatctccttaatgataggagtggctggctgctttgtggtgtggaaggctgagggcatgtgacatggaggccaagtgccatttgcccatcaactgacagcgtgttgaatttccaggcgcagtggctcatgcctgcaatcctagcactttgggtggccgaggtgggtggatcatgaggtcaggagttcaagaccagcctgaccaacatggtgaaaccccatctctactaaaaatacaaaaattggcgggtatggtggcacgcgcctgtaatcccagctactcaggaggcggaggcagaagaattgcttgaacccaggaggcagaggttgctgtgagccgaggttgcagtgagccgagatcgcaccactgcactccagcagggcccagaccctgtcctgagtcccttaagggactgttgcccactggcactagctttatgctttacagctctagctgcagctctccctgctaaaggtcagggcttctgatattggatgtttgtgattttgacttttcatctttttttttttttttttttgagacagtttcactcctgttacccaggccggagtacagtggcgcgatcgcggctcactgcaacctctgccttccgggttaaagcgattctcctgcctcaacctcccgagtagctgggattacaggcatgcaccaccacacccgctaatttttgtatttttactagagacggggtttcaccctgttggtcaggctggtcttgaactcctgaccttgtgatccacccaccttggccacccaaagtgctaggattacaggcgtgagccactgcgcctagaagtttttacttttaatttttttaaaaattcaaatttaagaattctggagattgtttgtacaataacgtgaatgcacctaacatgattgaactggacagttaaaagtagttaagatggtaaatgttatggtatattttatggtatattttaccacaatttaaattaattaaagagaaaggttagcataagcgagacacaaaagataaatggatatgcgattccacttacgtgagatacccagaggagtcaaattcatagagacagagagcagaatgattggtggttctcaggggctggggggaaggtagaatagagaattgggggacagagtgtcactttggtaacatgaagaagttctggagatgggtggtggtgagggtgacccaacaatgaggatgtacttaatgctactggcctgtgcgcttacacacggttaagatggtacatttcagcttatgtatattttatcacaataaaaaataagttagcaacattcaaacaaaaacattttaatttaaatagctgcatgtggccattggctaccatgttgaatagcagctccagaggccccctggagaatggggccacagtcactgtggtctctgctgcaagacagagtggtgagggccaccaggtcccagctctgcaccctgcagatttgaatgaatccttccagcagctgatgctgatggagcactcacgtgtgccaggtgctccctcccagccgtctcgctgtgtcttcacgacagccctgaatgatgggagtcactactatccctggggtcaggagtgggggacagttccagaggcacggtcctagccaggcagctgcactcagctccaaacactcatcatatttggtctttgcagagccccatgtgttagagccccctccccttttgcttttttctaggttaggagccaggtctcaaaagacttcacattcaggccttcacttgattccagattctcctgcctaaagtgagaggagggatggattgctttactttaaaatatttccagctgggtacagtggctcccacccgtaatcccagcactttgggaggctgaggcaagtagatcacttgagcccaggaatttgagaccagcctgggcaacatggtgaaaccctgtctctacaaaaaatacaaaaattagccgggcatggtggtgcgtgcctgtagtcccagctacttgggaggctgaggtgggagaatcgcctcagggaggatcacctgagcctgggaggccgagctgcagtgagccttgattgcatcagtgcactccagcctgggtgacagagtgagaccctgtctcagaagaaaaaatatgccccccttaagtttgtgcaaagcatttgccaactccttaccctgcccggaaacatcacaagtctttctctgcagtttgcagatggcgtgtacctggttctgctcatgggccttctggaagactactttgttcctctccaccacttctacctgactccggaaagcttcgatcagaaggtatgtgcatggtctccatccttggtaggggctcaagaaatgctcattgaaatgcagagcatagactatcccggcagctcttcctgcagcctggctgcattcttcagaaagtaaaaaatgcacaagtgatattgcaattagatgtaactctcagcaaaagaaataagaagcccatcagccgtccacaacgcatccgagttttgtttgccacattttctttgcggtcttttccatgggaccgtgtagtttttaataattgtgatcacatctcggtagagttgtaaacccttcccccattctgctgcagctccaccacctgtggttttccctgctgcttcccaagctttccaaataccatctccagtggtggcacgaagtcccaaggatggctctgttaccagcgtctttccattccccattcttgggcagtcaacttgaacatgtttctattgtttttccctactgaaacaacagagcatctttttgatacagattttttttttcattcctgtggattgttttcttaggaaaatttctcaaatagggtcaaatttggggcattcctttcaatctgggctggcccacgccacccggtcccgctgtcactgccctcgtgcgtgggcctctccctgctgtctgccctctgtccagggcttcccgcagccaagcctctcacagcagtatttagcacattgcctttaaaaacttggccatggatggtctatgttgctttggattcatgggcatctgtcattttattttcccaaagtgttagacccatgagtcagggaggcagacaatgtaagctggtggcgacagccagagaaatagcagaaatggggccagtgtttatcaatctgcccacttctggcacgttgcagtctgtttgcttgtggccaaatgttgttcctatcttgcctgctgagatggaatcaggacagattagagaggtcttggcacatggagtccatgttgaatcgagagagagagagcgagcgagcgagcaagagggagtgcagagggaatgagcagaattgtgcagaactcaccaggaaactcaccaggtgcctgtgctgtcatcctggaaatgaaaggtcagaccatccagcgaagaagcgcatgcatttccaggccccgatatggctggttgcagacacattgttttggagagatcttttctttcttcaaactagtaagaatgctggcgagaacagtgagtttagccaggagacctagggctggtttctttccaagacaaggctttgtacaaatgtcagaggcatcatctcctgggccctggccttcttccctttgaaactgggatgaaagtctttgacaattgctgccctggcctgcgaggcttgaggaggcttgagtcatctgccttcccctctgaatcggagcgaggaagggaaggctattttcaggtatagcatgcagcacaccattcatcctgttcactcaggagaaagggagcctggggtggcggtgtggctctgcgggtggctggaacactctccttcggaggatgggaggctgtcagtagttcctcctccagcccctgccttttttccctttctcctcatggcagctgctggcaaggtcttcatgagcccatagtatttattatctaccttgtagtcttcgtgaatcctggacaggtgggtggtccctgctgtggaggactcacccacttcaggctgggcccaacacccgtgtactcaaaactgcttgcggatgggatgttgatggcatcccttgctaatgtctcctgtgggctgagaccccgaggtgcgtttgctctggccctgggaatcctgacagctgctccacatttttgggaggagggactgaggttcagtgagcaaaaccagagatgcgtcatgagctgctgtccccgagggtagtaatgacttatggtttaaaacaattgcattggatttaaaaaatatcacactggacagctcagagcctgtaggctcgtgccccatgagctatctcagaggcatgagtgtggccttcagtttttttgttgcaaagccactgtttgagccttaccctgcactggccacgtgctgagcaccttgcacccattggtcatcattttgggagactctgcaggctccctctctctgtcgagtggggtgcatcctggagacgtggagatctttcctagaagaagacacgagttgcttccccctcagcattactggatgaggacagggaatctcaggaaggcttagagaccagcccagggttgcacggccagcaagggcagagccaggagggtcgactcctattccagaaccctctattctttcctcacctggccaagttgattaaaaccttttgaattgcagagagaaaggatttctgcccatgtggctggctcgaagcaggtgtgtatatggcctggtctctgctgggccttggggcctcctactgcagtcacagctggggtgagcggtccccaggcctctccgggatccatgtgctgggtatccagggatctaggctcaggggacacttctctgcctggcatgaaagagggctgggggaggaggcatggccttgagagataacaggcatgggagggtggcaatttcctgcctggcatttcctcagcctgagaagaaagcagaaggaaaatctcacttcaaaaccacttactgtggggccgagcggctgcagagcaatgaggcttggaaggggctttgctctccccttaaactgttctctcatggtgtaggggtgaccacctcgtcacccgatcacactctccagccgtctctgagtgtctccacgtgtcatgcatctcatccccagcccctcctgagcatccactccctcagcgtggaagaggattcctcaggcttaagaggtgcacgggagaggcacgtgaaaagaccggtccaaattggtgctgacttttacaatggagaagaatcttttcttaaaagaaaaatcttttctcgctattccctctctttgctatcctgtctccatctcgatttggggtcaagcctgttgtgtgtgtgtgtgtgtgcacgtgtgcatgtgcatacgtgtgtgtgagctcatttgatgatatggacggtggtcagctaaagggacctgtgttgctaggggagtggaggtgggaggctcttggaggagaacgggcacagattctacgtttcagtcctggttccatgcctgtgagccccgtgccttgtttttcttttcttttttttttttttttggaggcggggaaggaatctcactctctcacccaggctggagtgcagtggcacgatctcggctcactgcaacccccgcctcctgggttcaagcgattcttctgcctcagcctccttagtagctgggattacaggcacatgccaccatgcctggctaatttttgtatttttagtagagacggggttttaccatgttggccaggctggtcttgaactccagacctcatgatccacccgcctcagcctcccaaagtgctgggattacaggcgtgagccactacatccagctgccccatgcctttttagggcaccgatgtcctagcccatctcagcccagcaccaccctcctttgtgaaggaagatgatattcacctcgtacagggctgggaggggaaagggaacctgtatggaatacactgaccccatggtggatgcacagcacccgcaggtcgctccctgctctctccttaggggaactgcgttctgcaccctccgcacgggccgtcctcactcctcccccattgccagtgtttggccatcctcaggcccagccctggtgcagcactcccgcatctccaggcaggctgtcctgcagggttggggtgtctgccatgtggcccagtgttcccattggcagtttctgagttggcctctggagcagggtctccgtctgctgcacccccgcccctgggtggacatggcctgccctcctgccgggctgtgtcttccccactgaccctatgactagccagaccctcttgcggttggtgctggcaggtcattcgcccctttgcttctccgagcacaggccgtgtgcactgtggaagcttttccaaagcaccccacactgttttccagtgttgttcgtttgattaactcagggaagcctctttttcctggttaattattaaattacattgcaagtaaaattgttcttgtttctgattcattggcctcaaaatcatgaaaatatgatcgttgaaaggattttttgtttgtttgtttgcttgtttttttgagacagagtgttgctctgtcacccaggctggagtgcagtggcacaatctcagctcactgcaacctccgcctcctgggttcaagcgattctcatgcctcagccacccaaatagctgggattacaggtgtgcaccaccatgcccggctaatttttgtatttttagtagagatggggtttcacccattggtcaggctggtctcgaatgcctgacttcaactgatccacctgcctcggcctcacaaagtgctgggattacaggtgtgagctaccacgcccagccaggatgtttgattactaagagccctgaagtcccttgcactgtgacatctgtgcttgtttgctgtttgtttgtttgatgtcccctcctcccatcagccttggcttgcggcaggtgggtggctggatgtaatctggttcattgccggcatccctctgagtggtctttaaacacagcccagaaggcttttattttaaacctgttcagccatcattagcaggataaaagcttcaggtacatttgggggctgaggagtaatagaccctttaatttcaggggaagtcacggtagggcggaggtggccacgtttctgtagcatctaacaggaccaaggtcctgcaggctgacgcttgcagccaccatcgatctgacttccgttctgactggtccactgtccctactcagtgctaaggccctccctcccctgagggcaccccatcctgcagagacacagcctcacgtgcaggtctttacagcccttcctggggcagtgccaggcctgcgtgcctctgcacgggactcatcctttctgggcctcagtttccctgtctgtgaaatggggtcactgtgggccaggcgcagcggctcacgcctgtaattccagcactttgggaggctgaggcgggtggatcatttgagcccaagagttagagactagcctgaccaacatggcaaaacccgtctctaaaaaaaataataataatacaaaaattagccgggcacagtgatgcgtgcctgtagtcccaactactggggaagctgaggcaggaagatggcttgagcctgggaggtggaggttgcagtgagctgagatctcgccactgtgcactagcctgcgctctagaccctgtctcaaaaaacgtaaataaataaataaacaaagaaataataaataaaatggggcccctgtgacttctcatcaggtggctggcatctggggcagagcaggctcttggtggccgtgagccctcgagagcaggccgggcacctcatccttccatctctcagcccagatcactggtgtgaggggtgagaaccacctagtaagcgcacatggccctccgcagacttcctcacccgtgtctgcccaccctgtggcccgccccgggctcactgggtccttgtggacgtcagcgttgcagaggctcggtcctgtccatgccggctgtcctccagcagtgggccgtgtgtgggaacgactgttggaccctaacgctgacccaccccccttccttggcaggtccacaatgtgtccttcgcctttgagctgatgctggacggaggcctcaagaaacccaaggctcgtcctgaaggtaatgcccctggctcaggttcccccgggagaggtgcgcacggaggggaagaaaaacgggtcctagaagtggctggaaggctggcatgttgttccccagatgggccccacgtctctggctctggggcaagggtctgccaaccccagctcctcagtctcctcattttgggaaccaggaggacttcgctggtggagctggcagtgccggttctttaataaccacttgactttgaaggacgtggcctctgcccacagacctcaggattaagtgcgtctctagctggccactcaggctggaaatgcagcttcgtgccctgagaagaaattaaaggcttactcaactgtaatgactgttgggctggaggtcccctgatgctcagccaaaggcagtacttggtagcagggacttggcatgctctgcgtgggtcggagctggaggcaggaggccagcagagctggggcgggcggttgcttccctgtcccccccccggctcctgtgccaagttacctataggaggactctctaacctgagtgagcatcacagttccccaaacacacttcctaggtgtttggggacagccaggctcagcagaacatgggtggcactgcctgtgaaccctgctggaaagttacagggcagagctgaacattaaaggctttgacaagtcctatatgaagacatctgtttgcctccatcaaaacctttgccatgcaggaggagcccacagaactcagacactgtggtttagtgccctgggcccccactttgaccgtggccccctacctagccctgctccctctcctgagtcccccatggtgctatatgagttgggagcccatgatgcttcctacacctgttgccagcatccgctcaacggcgggctttgtagagtctccaaaatagctagaaaatggatcctgtcccttccatctacccactgcagccaccgcttcctgccagtccacgcggaaggttcctggccggtcccttcctgcctgttcatcctcctcttggggtttcacaggacaatttcacaccctcctgtctcgtgtgtatggctgtttattcttttttgttttgagacagggtctcactctgttgcccaggctggagtgcagtggtatgatcacagctcactgcaacctcttcctcttgggttcacagcatcctcccacctcagtctgtcgagtaactgggactaaggcgcataccaccatgcccggctaatgttttaacttttcttttttgtagagacaaggtctcactatgttgcccagactggtctcgaacttctgggctcaagcgattcgcccattacaggcacgagcccccatgcctggccttgtttattttttattgtccctccctccccactagaacagaagcctcaagggagcagggctttgtcccctgcatgccggtgctgagaatggtgcctggcctggaaactgctcgacagcacggatcaaagcacatgtccagcagggagtgtggcgagctgctgcctgtagataccggcccggcctgggtctctgggacccctcgttgctgctgccctgcagcccttttgttgctgtgaggcagggccatgagggagtggctagaggcccgagggatgctgctttgcctctccccagctgtgcatccttgaacaggttactttgcctttctgtgccagggcctcctcctctgttgaggggagtgatgatggcacctgcctccacgcgtcatggggtcgctggatggggggcggatgttcatcacacaggacttgtcagagccttcactgttcaactctgccctgtaactttccagcagggcccacgggcagtgccaccacgtgctgctgagcctgactgctcctgagcacctattacgctcaagtgagctgctcccatgagcactggaagagggtcctgcccacagaacacaccaggtccctgctgatggtggctgctagctcggcgttagtgtctggtgggtcgcacactgtcagggaggagaaatccttgctcatgtccactgtgggcttggctggggcttcctttagtttcctgtagcccaaagcctgggccctatctgcagcatggggtgcttcccccgtaccctcagaagagcccctggtggccctttgcctctgagctgctgagggagccctgcttctttgtcctcccgaacccacgactttttttttctgagacagagtcttactttgtcacccaggctggagtgcagtggcgcgatcccagctcactgcaatctccgcctcctaggttcaagcaactctcttgcctcagcctcacaagtagctgggattacaggcacccgccaccatgcctggctaatttttctatttttagtagagatggggtttcaccatgttggccaggctggtcttgaactcctgacctcaggtgatccacctgccttgccctcccaaagagctggggttacaggtgtgagccaccacacctggccctttgtcccgtttttgaggagtgaggcaggagcctgtccagaggccaggatatcctctgacaggccggcctcctaggagggtgtttgcccctgagcccggatgtgtttcctactcatctgccgctggacggcacgttagggaacccaccacggacgtgtggaaaccaggccagaggcagaggcactggtccagggcaaatagcaagttctgcagcctcccaggcagggtcccttgggtgtcccagggcctctgtccagcccaggcagggggcagagctggtctgcagtgctcattagcaccttcgctgggccagcactgggcaggggccaagccgcagagatttatgagatggggtccctgctgggcctctttattttgtggctgatgcaatgaatgagagacttttccttcttcattcaaaatcagctggggagcaagaatcaggaggtaacagagataagaatgacacggagaatggggtgcagtggctgcggtctccctgacaccctcctctgagctaggcagacttacccgggtacccagggctggtggggagggaggcagtggctgtggcctcccctgcaggcctgagactgccctgttggtccccacccggaggaagcagagcagtctcacaccccctgcacgtgggcgggtctgaagagccaggcctgcacctggttccctaggcccccagcaatgatgggcatcctggccccctgcccccttgtggggacctggcggagactccagtggggtccccgaccctgctcttaaggaggccccttgcctgggagaaaggcttgtggctcgctccaaattcacagagccgagtgcggagctcgatggtggggtgggtgtttggggagcacagagggactgaggttcatgggtcacagaaggtgattcctatccctgggcgcaggtgctaaggggtggctgtggttagcaggtctggcaggggtgtgagggttaagttctgtttgtccagcgaggctgtctggaagttctcagagctcagacctgggggctgctgcgtgggggcatcggtgtcaggctgctgctctggtctccctgtgagtccaccatgggagtggagtcagagggggccaggaggtgatggcccccacccctgggagctcctctgtccttgctgcccccctcgccttggccacctccaactccatggccgccattctccctcccctgcctccactgggctgttgggagctggggtggactcttcaggtcagggggagaccctgggatccctgacagagccccgggtgtgtccccaagcccgccgagccgagttccccgacagagccccgggtgtgtccccaagcccaccgagctgagttcagccctgcttttgctctgacagcacactcgtgggcaggtcatttctccatgtgagtcttggtcctctttgtaaaacgagagggaaggaaaggaggctgtgcaggctctgatgagggtgtgtgagtcgagaaactccatgcccagtgacaaggacagttgctgattcttagcatccaccccacctgctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaa

SEQ ID NO: 2139 - DNA, 100117 bp, Homo sapiens
ggctgtgctggtctgcagagctgccgccagctgcaccctcctcgccagtgagttctgttgctttcgtatcattttcagcaggagctaaacccaggccagcccttcttttcttttctgctttatggcagaattttgttttgcaagaatggaccctgggtggctgcttgacttttcccaggaaggtgatggggacgttggtgttaggacgatgggcaagggggtccaggttgtctcactgcggccccagagggatgagggtctgacttgtggagtgaaatttccagcactctgctgggggcgagtagatcattgggcccagaagaatgggatttggaacattctcaggcacatgctgcaattaagattttctttttcataggggtacctgatactgtgggtttctctctctctgtcttttttttttctctctgagatggagtcttgctcttgtcacccaggctggagtgcaatggcgcgatcttggctcactgcaacctctgcctcccaggttcaagtgatcctcctgcctcagcctcccaagtagctgggattacaggctcccgccaccgcgcctggctaatttttgtatttttagtagagacggggtttcatcatgttggccaggctggtcttgaactcctgacctcaggtgatccacccacctcggcctcccaaaatgctgggattacaggcatgagccaccgcgcccggccatgggtttctcgttagtggtcttcggttctgtgtttcccctctaagtagctgatcgtggccggtgcctggctttcccctggtcaccactagatattctgtcttgtctttgggaggcagagtcagtagaaggtgctttgcactgggcatgcctgggagtgagcccagccttgctgttattagcgcccatcgtgacggtcggccaggctgccctatgttcgatttttcctcctgtgaaatgggaacaacagtagagctgatgtgtcctgggctttctgcatcccagggactatcccagctccttaacgtgctttgctcagtgctatcctcctaaaaagttttcttttacagttgagtaagctgaagcccagagaggttaagtaacctgcccaaggtcacaccgcagatcggaatgggagtcaggagtgtacccaacagcctggctccctagtcagtgctctcaacctcagcttgaaggccgcctccctgggccctgctaggggacccagtaagatgacagttattcacattctcctttgtttctgataccaagcaaactcctggtaaatgctccttccccacttttgtggaataaagaatgcacatttttttctgagctctgcctgggtatccttaaggagagggacgctgtgcctgggacgcagatgaacaagataggagctgtttcctggaggagctcccaggctgatttttgcctttgatgttctgcatctttttcacaggctttttgtagatgtgtggggatatttctagaggagaaaccagaggtggaaggaggggcataatgaaattgaatgctgggcatctcttagctcacattatatgaggctcttcagggacaatagaccttgcaataaaaggcaaaaaggtgattgcgcacagagtgcttttcctgcacagtgctgggcgggatggggtggatggggcttggcggctggaggagggtagaccctgcccgcacctcctgggacctgtgcgggactttgctcaccttgctgtttctaaccaaggtaccagattctcttcactcaggtgtgtcagattttaacccttgaggctagaaccttgccaggcttattcgaagtcagtggttcctagtagtcacagggcccctgccctagaccccagaccaggaccccccggcccctgcccgcccgccttggcctggtggggtaggagtcactgtgaaaggggtcctggagcccagtatcactccagcgacatttcccagagagcatcctggggccagtgtggggtgtgggggaacagatactgagcgctctgtcccctccccttggagaatctcacagtacattagcagagtcaagactctgagaagtccggtaggaaaagacacctgcttagcttcccttaacttcacgactcctccacctccttgacctttgcttgattcatgtgtgacctgtgaacgtctaaactgcaggactcactttgggagatactgatggagaccaaataggtgtcctgctcatatatcctccacttcttcagttttgctcaggatccactgggcttcctaaaatgcaaacgaattgaaaagctgtgctgaatgtgtttttctctgtctgaaagtacagccacccacgaaaggaggaggtctgctaagttttcttttagaaaaggggtccccaggctctgaatgcttgaggacctcattgggatcaccccctccattgtgggctacccatcctccacccgctgtggcctattgataacctcccagccaccacctatgctcctagaggccctgactggaatccctgtcctcaccctgagtttgtcacctccttccaaacttcgtgtcctctgttgcagttgaggacctggaagtcatgattgggctgattagtgatgggtgtttattttgaattcttaactaaacaaggaggaatcacatcctagctccgtattttactagttatgggaccttgactttcccaagatctactttccttgtcagtaaaatggcaataatcggggtaacccataccctgattgctgagaacccctgtaggcgtccatgcctggcccaaagccaggacccaggaagggaggcgcagctgggcggcctcttctgcgtctctgccagttgctggcttggattctaacaccctccttccctccctccctcgctctctaccagtgggatctgagaccatgaaaacgtttgaaggtttctcaagcgtctgtgactgccccacgtctgtcgttgggtggaaaggactttgtaattgaacggagtcagttgtaatgtgaatgtcatgtggagctgcttttccttggcaagtccttgctgtgtgagccattgtttccagatctgtagaaccctccctaccctgtccccctttccgggctattgggaggctgagcgagctcatcatgaggcccctgaaagatagtttctgtgccctgtggagctgagtccccgagtctctgtccccacctcacaggccccctctcaccaccctattgggttggtaaatttcaagttgggcatcagataggacaagggaaggggactggagaaggaagagccgacagtttgccctcaggacttcagagtcactcttttttgtttggttggttttttgagatggagtcttgccctgttgcccaggctggagtgcagtggcgtgatctcatctcaccgcaacctccatctcccgggttcaagcgattctcctgccttagcctcccgagtagctgggattacaagtgcatgccatcatgcctagctaatttttgtatttttaatggagacgggggcttcaccatgttggccagacttgtctcgaactcctgacctcaagtcatccacccaccttggcctcccaaagttgctgggattacaggtgtgaaccatcgcgcctggcccagagtcaccctttctttttgtgccttattagacatcttcctgctacaggatagcccagaagaaaggaacaagtttccgtcatgaataagtcccctacctactagggatgtagggataaaggactggaactctctttcttcaccctgcagggcaaactccttcaagactcagctccaggaagcctctctggactactacactccctcctgagcccccagccttctcacatacctcccttatgtgtctcctgggtgctggagccctcagagcagggcctgtatctaagtccccctgtggcccacccagtgccccgtgccaggcctgaccatagtggatgtcactaagcagttgttcaatgagtgaatgaacaaatgcaaactaggcccaatcttatcaaattatactagaataattgtataaaaaaccagacttctttaagtggaggaaatttaaagtcagaagtgggctgggcacaatggctcacacctataatgctagcactttgggaggctgaggcgggcggatcaccggaggtcaggggttcgagaccagccagcctggccaacatagcgaaacccgtctctattaaaaataacaaaatttagctgggcgtggcggtgcatgcttgtaatcccagctactctggaagctgaggcaggagaatcacttgaacccaggaggcagaggttgcggtgagcggaggtcgcgccattacactctagcctgggcgacagagtgagagtcagtctcaaaaaaaagaagtgaatgaatacgaccatacctgcttttccagctcctgactcttaaacgtctcgaataccaatgccaaataaagggaaccgagagatgaaaggtgtcactgtcctgatcttcagatgcagaaatttctgtgtagctgaggaggtggggcccgcttgcccccctttgaattttgggttgtgcttgagcagaagcattcattgcttggagaaagcagaggagaccccagaagcacttccctctgaaagggagaagcaggtaggccaaggcagcggttctgggaccagctctggggccacctgcttttcccacactgggtctgtggtgggctcggcagctggcctgcacacaggagatcctcaaaacagatgagcgagcatgattgccatttttacactccctcatttaatccgcagcactggaggaggtgtgattatggtgtgtattttgtgcagccatttggtggacacctaccgaggacccgccgtggggcaggctgctggctgggctctgaggatgctgacgaggacccttctttgggatcctctgttcgggttgaagacagtttatgaaaacataagataacagaatggccgactctgaggcaggagccaggggtgtgtgagtgggggtcctggaaggggtctctggaaaccagaggaggagtggtcctctgaggctggccaaggctcccagcagagagacgggggcatgggcagaagcctgtcgtgccagtgagccctggcatttctgagcccctgatcggttctgttgcctgcacgacggcctgggtgagcaacactgacaggagacccctgccttagtaccatgtctcctgggctctggctagtggcgcctcctggcagcagctgcccaggccacacaggatgctggctacatgcttggctggtctggccatccctgcatggccccgctgtcactggtatctggagatcacacccagccagagcctagtgccaccctcggatgcttccttggggagggaggatgccctgtttccatggcaaccctaggtgggaggccagggcttcaggcaagctgctgagcttttcacagccctgggagtgaggagcagggcaggctgaccctggcctgtggggcagaattagtagaggaggagccccaccatccctgagaagaggaggggagtggggtggggaacattagacaatgttcactgcccctccctcagcttcccagctgcccacggcagtcccaggccaggccagtgtgggcgtggggggcagttagagcgtggccgtgtggtgtgccagcacgcagtgcaacagccaagacaatggagtcatcccctgcccctgggcccttccctccaccccacctcatgtctgcactaggtgaggaagcagaggacggaggagcccagtgggctctgggagctcctgggactcctgagtcggtggggacggggcttcccagcctcaacactgaggattcttggttgtggagctctcctgagcattgcggggtgttgagcggcatccctggcctctacacacgaggtgtcagttgtgacaacccaaagtgtctccagatgccactacgtaccctcccagtgtgggggtggaggaatcgtccccagttgagatccgctgagctgagaggctccccggaagcaggtggtgaaggaagggaaggccctgggccctggagacatggatgcctgcctgggacacacacaaacacgcacgcacatgcacgcatgcatacactcactcatatgcacacatgttcatgcatgcacccgcagtgaccctgaagggactagactatttttagagcacttttaagttcacagcagaattgagtggaaggtgcagagatttcccgtgactgcacggccccaccacgcacactatcaacatcctccccctctaacaacgtccagaccagagggtgcatctgtggtacctggtggacccacatggccatatcagggtcacccagagtccacagtttccatgaggggcccctcttggtgctggacattgtgtaaggacagggacccccatggtagcagtgacactgccctgagatccccgtgccccacctgctcatccctgtctccctctcactcctggcaacctctgctcctttcactgtctccgtagttttgcctgccccacagggtcgtgcagttgggatcacactgtctgcagccttttcagactggtttttcactcagtgagatgcatttaagtttcctccacgccttttcacagctgacggcgcgtttcttcttggttccaagtggctctttctgcattgtctggacggatccatttgttccctgtttgcctcccagaggatccgctgctcttgctgcagatgtatagcccaggtgctgtggagttgggatggagcagtcgagctgggatcagagcccaggcccctgccctgaggttggagctctctgactgcacctggcctaggcctgtgcattgtctaaactgatggccgtggggcaggggacctggagcgcaaagcaggagaggatgctgaagggggcaggtggggccgggacttgggagtgtctggaaggaggaccgcctgcctcaacccagggctggtctgtggaggccagagcgctcagcccctcaatgctaggcctgttgtgagtttctccatgaggtggccctctcagaaagagtggctccacagcagctgagttgggggccccatggcagctgagtcgtggactccatggccgctgatttgggggatgcctgtccttgtagagactgtcacctctaggaatggtgaaagggcggccacccgcagccctgtgtcctctttctagtcctctgtcttgtaagcccggtccccacagtggccccagtcctcccctgccagaaattcgttctcctcagaaatccgttctcctctctgatctttcaggcctagagacaggctcttccctccggagggtgcagcccaggggttctggtaagatacagagcccagcctcaacatagcaggaagtttttccacaaatacacagttcttcaagaccacatgcagctgtgcgtggggtgtgttttgaagggcaatggcaggagcagtgtatgcctcgtggtgcagggagcacgagttgtttataggcgtgcctgggtcctgggtctctgtgcaccctcctctagattcatggggcatctgcccaccgtgagatagataagccagggtgcctgcccctttctcaggtgagatgctgagggccagaaacatgctgctgtgtcccatggaggaggtggcctgccccaactcccctgcaccctagggagagtgcccacaggctgggggctggggctgggtcctgtgccccctccccagccctcggtatgtggctcgctgaggtgtgcgccggaatgttgggcacatcctgtctgataccagcttggctggaagtcgaattatgatcagaatatcacatgatgtgtggcctgggtccccctttggttgacactcttgagtatgggtcctgtgcctgcccggggccaagcagcaggtgcaaccgggcctgccctggggcagcatggggtgtgctagtgtcctggggccactgtaacaaagcaccacaacctgagtggcttaaacaacagaaacatagtctgtcacagttttggaggctggaagtccaagatcaaggtgtcagctgggctgtgctccctccagggctccgagaggatcccccttggcctcttccaggctgtggtggctctggtgttccctgccgtgggccacatcactccagcctctgtctccctcttcacgtgggcctccttctccgtctgtgtctctgtcctctcctcttcttgtaaggacgcctgtcattggattagggcccaccctaatgaccgaatctgcaacttgattacatctgcaaagaccctgcttccaaataaggccacagtcacaggtgttgggggccagactccagtgtgccttttaggggagatacagtgcaatacacagcacacagtgaggtcttccagatccccagacctatcttcttccagaccgccagacaacaccgataagggtgaagttggcttacgagtcctggccaggatgtgacggggagtcgccaggtgggtgccggggaggtgggaagctctgcaggggattggagaaccacacgtcattgcccacatgtgactttaaaccttagcaatgatattggagggggatagttactctttttttttcttctgagacagtgtctcattctgtcatccaggctggtgtgcaatggttctagcgattctcctgcctcagcctcccgagtagctggtattacaggcacctaccatgacactcggctaatttttgtgtttttagttgagacgggttttcaccatgttggccaggctggtttcgaactcctgacctcaagtgatccgcccacctcagcctcccgaagtgctgggattgtaggcaggggatattactctttacagctagggaaacagttgggcttggtgacatgatagagacaccaggtcccttgaggacagggggccatttgcagagccgtgtggtggaaggagcctgaatttggagccccaagctcacagcgtgggtccttgtcacatgtcctgtgagctctgtttgcatccttagctcaggcaagctactgtgttgaactggctggacacagtgtgtctgtctctccctcttccagagaagtcctcacttaaggttgtgtcactgtttttactgatgttggaattggcacttggagatgtgaactttcccaaggccacacacccagatgagtggttagacccggacctgcctaactccagcatatctttttcagggggacacaattaaatccacagcatggactgagttcccctcttctctgccaccatcctgaccttttcctggccagggttaccatgtcggggcaggcatgggggaagtggtaagggaggtatctggacctagtaaaaggctctggtcctcctgcttcctcttgtaaggaccctgtcaatcacatcgggccccctgaataaccaggctaatctcccaccccaaggtccttacctaatcacatctacaaagtccccctcttgccatgtgaagtcacaggttcctgggacttgatgtgaacatctttgcagggaccatgatccagccttccatagaggcagtgacagatggagtagaatataggtcctttgagtatttatttatttaagatggagtctcactctgtcgcccaggctggagtgcaatggcgagatctcagctcactgcagcctctgactcctgggttcaagcgattctcctgcctcagcctcccaagtaactaggattacaggcgcagaccaccaagtgcagctaatttttttgtatttttaatagagatgaggttttaccatgttggccaggctggtctcaaactcttgacctaaggtgatccacccgcctcggcctcccaaagtgctgggataacaggcgtgagccaccgcgcccggcccctgtgagtttttacaagagacactgcagtagagagaatggtagagtcctcaaaccctgattcagtcgttcatgaattcactgagcactcaacgtttcccgcaatgtgtgtcctcttctttgccagcctgctggtgtgctcctggtgcttggtccaccatagatgggtgtgcttggtccaggaggctgatggtgctgacatctgggctgatattcaccgtttttagtgacttgaatgacgtccatgcagaagagctagtgcaccatccttgtgtttgaaaatgcccgggctccagcctgagaacctggtaggccagtaattggagggacagtagcaggatcgagaagccatctgtgtcacgtgttcttggggacaaagaggagacacaggctcaaggaacagcaaggtttgtgggacacagctgtgtctgaaaacgtcaagcagttagctcatccctggctacttcctgtgaacccattaaatccccaggctgaggaggacagagggtgagggaatctgaccccttactcagccctttagccagcggctgctgtgctaagccattctgagaagccaccggtggagaactgacttcaggtcgtgctgactgtgaggccatccagttgtttttgcacattgaaaacaatacattacactttgggaggccgaggtgggtggatcacttgaggtcaggagttcgagaccagcctggccaacatggtgaaaccccgtctctactaaacatacaaaaattagccgggcatggtggtgggcgcctgtaatcccagctacttgggaggctgaggcaggaggatcgcttgaacccaggatgtggtggttgaagtgagccgagattgtgccactgcactccagcctgggggacagagcaagactccttctcaaaaaaaacattgttccggatttgctaataaggaggcaacctcctcagaccttggtgtcacaggagaatggcccgcggcagccttagggccagttgtgattttatccacagtgttggtcagatgcgtcctctgtgcttgtttaatattcattctgcttgcgtgaacaaagccatgtcagtttcagtaacgcttgtgccagggggcacccggtgtggagcagggctcagtaaaactgctgcaaagaatgttccaggctttttgaaattacgtggagttgctggggctctcttgaggctgttaatttacttagggctgctgtgacaaaataccacaaacccagtggtttaaaccaacacaaatctattattttacagttctggaggtcaggagtcccaacatcaaggtggcagcagggccggttccttccggaggctccaggggagaatcccattccttgccttttccaacttgcagaggcacctgcgttccttagtgcctggcctcttcctctgtcttcaaagccatctcccgatctttctctgtctccttcgccacacctcctctggctctggccctcctgcttcctcttgtaaggaccctgtcaatcacattgggccccctgcataatccaggctaatctcccaccccaaggtccttacctaatcacatctgcaaactccctcttgccatgcaaagtcacagtttcctgggacttgatgtggacatctttgcagggaccaagatccagccttccatagagacagtgacagatggagtagaaagtacatcctttgagtttttacaggagacactgcagtagagagaatggtagagtcccgaaaccctgattcattcattcatgaattcaccgagtgttcacggagcacctgcctcagtccaggcgtcatgttgggagcaggggagacagagcaggccatgcatctgtcctttcagagcactgtagacgcaaatcctgtagcacagatgtgccttagactaatagtgcctcgaaaggagaggaaggggaatggatgcggggagtggggaacctgacctgctttgtggggtcatggagtgactctccacctgccgtcatccctccatcccttgtttggggctgttcctccaaaggtgcagtctccagcaggggtgtggggacccctgtgggccgtgaaggcctttctccttttctgctgtgggcattgcatctgttcctgatgggtagagttgtctgtgcccggtggggcccaaggcagtgccatggtggttctttgagtatctcaggtgggaactgagctgccagcaccagaggccaatggcttccagcactccccaaatccacctgcttttggaaggggcctgtctccgaagcaggccgggtcctcctgttgggggaagctttcatggaggcatctgtgtcacttctgcaggggagacagccgctagagggcactgtccttctggcctttcccacatccccgtttccatggcaggtgcatagtaaagcctttctttttctaacgacttaatgatttaatcttcttattttctcagcagacaacgctttggacttccctggatacattgggacgttaccagtcacattaattaatacgagtttcacaacttgggaaccagcgaacgtgcttctccagacttagcttctgcacggccgtttctgctttcctttatgaagtgcgtttctctaagagcctggcagtctcatggggctcgtctgttgctggaagtgagcagcgggttccattgccccccgcctcggtggggctcattgtgcagcttgctggcaagtggctgggctcggaggggcggtgacggtgacacacgccaggggaaaggttggcatcctcttctgagaattgtttcttttgggtttcacaccctgcccccaccttctgctgcctcgaggctcttttcttcttattattagctaatgacagatttcatgaccagtgactgaaatcatttggaagtaccccctgaaagccagcgtgatgggttggagaaatgtgacagacgcagcctctgaaaatcacagaggcagaggcttgcgtcgaaggacttgctaaggaattaggatgagagtggtcaggaggcagtggctgctgggcactggagctgagggtgaggggccgagaaaacgggaggcaaatggggtagctcttttttggggcgggggaggctggctttggggatgtgtatcccactgtgcaccgcaaggtgggggcactgggcggtaggttcccgtgctccggaagggtggcaattgaagggaggaattaaagaagttggccaggtgcggtggttcgtgcctgtaatcccagcactttgggaggccgaggcaggtggatcacttgaaatcaggagttcgagatccacctggccaacatagtgaaacctcatctgtactaaaaatacaaaaattagctgggtgtggtggtgcacacttgtaatcccagctactcaggaggctgaggcaggagaatcgcttgaatctgggaggtggaggttgcagtgagccaagatcgagccactgcactccagcctgggcgacagagcaagagtccgtctcaaaaacaaaaacaaaaacaaaaaacaaaaaacaaaaactgactcatgtggctttcagtctgagaaaccaatcagatcatcattgtctctaaagaatgtgtcctcctttgtagacaagaagctcaccggcccctccatgccccggtttctcgcccaggtgggttagacggccaacctgacattttaccgtgcacctggaagtctttcttcctgttctccttcccacaaaggattcatttttctgtggttctaacattttcctgatcaccccagggacaaaggggaagaaaagaccgtgtttctgggccaagggaatcatctgtttaacatgggcttcggagctttttttacatttctatgtaagcaacttttcgtattcagaagacccagtttccctgagccagatggactccttccatctcggggtggtctgtatttcagattcctgcagcaggtggctggtcggaatgcacaccccaggaggtgaggctggggggatgttggctcctgggctgcttgtactagcaagtccctaattgcggagcggactccttcctcctgagcccatcagcctctacgtggccacatcagggtaattgggttccttgtgaaacacgactgccaggctaatgtaaaccttaatggaaaccctctttttccacccaattaagtggctggaggtgggatgctgtgtgagagccgtcagttcagttccctgactttctcttgtagaaattatctatgtagctccatttggcctacataagcttagcatttgtgttcattcattcattcattccacagatattcagagagcagttatccatgtgctgggttttatgcaggatgtgaggccatggtcatgaatgggacctggcccctgtgcactccttgcggggtcggggggtgcagggagatgagcacagtccacaatcacatgatcggggaatagggtttgtcattgtcatgtgcacggggagctgtggaaacccagaggaggggcccgaactgcacccagggatagaggatgtgcagagtgtgctttccagacggtgggaaatgggtggagctagctgacctgaagtgaagggcattgcaggttgtggggacagtcgagcagaggggcagagatatgacctacagaagtggcctggaatggcctcatcagacgatgagtgtggaagcatggtaactgcagctgtattgatgagaggaggggtctgctcattaacagtcatcgggtaccactatgaaggttttgcgttttaccctggagctggtgggagccatggggtgcactgcagcagggagtgaccaacgccagctttgtgtattggaaggatttctacatcagacaggactctcttggtttgcaaaggacagaaaacccaactcaaaatggcttaaaagcaaaacagaattcactggtacatttgacagaatggtctgtggggttggatggcctcaggtaaggcttgatccagcacatagaaggtgttgctagatcctagattctgttctccccttccccgagctctttcgatctggtgccttcatctccaggctctgtatagtggtaagatgatgggacggcttcaacctccatcctttctgggtcaaggccagtgggaaggagtgcctgtctcattctctattcctggtaaagtctcagtgcagttcattagctctaactgggccatgcccatccctgactgtgttcctgggaggccagtgtgccagctggctttgtcctgggatgcctgctccaccccagagctgaactacaaggcccgagcatggtggcaggaggggtggctctctctgagggaggctgagtcttgtttgcctgaaaggatcaatggatgctggagaagaaaagcaatggtgtccataacagtcacctccagaaggggagaggctgggctggggtgggaagagtttagggcagggcttgcaggggccaaggtggccatcctggtgagaaagccccactggccaatccaagaatagggcacgagatgtgagcctgccaagggtactcccaggtctggcatcttggttctttccgctgcgttcttggcacagacactcatgccagggcctttgctgtcacccatagtctcagagtcatgttattattctgcagtcatctgtggggatgggaccgtgcaggactttccctccccagcttcctccctccttcagggtagctcactgtgtcccccgaggcagccagtgctgccgggagaggcccgagactccttctgggtctcagagccatttctatggttgaacccagtgtgtgtccttccctgtagaattggctgccactttgtttcctttagggtccccactgcaccctgtacataaccctgccaggacatctgtttattttccattcttgtagctttatttttatttcaaaaggagtacaagaacacagtctggtggcagagcctccctctgtctcctccttaccttcagccactgggccttgcatcagtaatgctgctcttgtcattctggagcatgccctttcatttctttttctgtgaattttgatacgtacacatagaaatacatagtggtgagttttctagttgtattttttacataaatatcatgctgtatttattttaaagtgtctcaccatgttgcccaggctggacttgaacccctgggctcgagtgatcctcccaccccagctccaagtagctgggacaacagatgtacaccaccacacccagcctttgctgtattgttctgcaacatggttttctttttctttttctttttctttttaattttttgagacaagatctggctctgtcacccaggctggagtgcagtggcgtgatcttggctcactgcaacctccgcttctcggcttcaaactttcttcccagcctcctgggtagctgggactacagattcacaccaccattcctggctaatttttgtattttgtgtagagatggggttttgccttgttgccccgctggtctcgaactcctgagctcaagccatccacctacctcagcctcccaaagttctgggattataggtgtgagccactgcagctggcccaacctgcttttgcttttttaaaaaatctcaacaccatgctatgtattgcacttaattaattgtgcatcgaatccttcacgagccttctgtgccaggtgcgaggtcggctgctgggtggaagtgaccaggatacgtcttccctcggctacacgcagactctccacggtgcaagggcagggcctgcccagccccatgcccagccctttggcatccatccaccagtgttagttagatcagcaggctgtcatgcccaaggcttgctgccatctgaataggacagggtttcagcagtgagctcttgatgtggagtctgcgccacctgttgaccttctttggatttaccttattgaaatgttcacacatttcttttagcttctcaacttatttcatcttgagaaatgggctggaacctcatgccccagcacaacaagccccataaatcagatgttcaagctgagcgatccttccggtttgggccacagtcacggggctttcttactcctctagtcatgtcagcaccgttcagaaactcatccttggcttagagatgatagtgagttacatgtacataaatacaccgagctcattaccctgggccggcatcctgcatgacaagggcccacatccatttctcggcaaaaacaaactacatctgccacttgaaacgtcaagaagcgctttcttgtatgttgtgctccatggatcactggaagtcctttccctcttttcccatgtccgggccaggaggagcagctgctctctggcactgttagcctttgctgccttttatcctaggcaagacactttgttattcctccgatttgtaatcccaagaaccttggagattggacttggagttcgtaacctcctggggagggccaggcctcacatttcaaggcctttgcacgcgtgatgtgccagcaacagctcagccctttgaattatgatccgcgactccctccaatcaccttccttctggatgtcagaaaagactgcccaacagcatctcctcccagctgccgaggctgatgatgtttttattctgatttagatctcacttaggtcttattttaactccactgagctgcaagatcttcactgaagtacaactggacttatttttagaaaaactgctctgttaagaagaccttcgtgcctgatgaagttagttattctgataaattacagcttctacgaagaaaccacacccctctgagtacggatggaagttggaaaattcatagaaagctgtcatttcctggcagaggcctggaaaacctcatttaacagagatgtctttgggttcctgcttaagcccaagcgaaggatcccgatgccccctccccagctgggaagaggagctggtggcgtgagttggcacagagccgcacctttctttctcctcctgtatcctcccgcaagctctgaagaccactctgtttctttgagcaggatcagttgtaactagaagtgggtaggatttgaaaagggctggttaagtgtttaaaactggggcagctttcctgccattttccagttcttttagatgtgcagggatggagaatggctgtttttgttggggttttctctttgatcctggttcagacggggccctctgaaatttctcgccctgatcttttgttctctatgaaaaccaggaattgcacggatggtgtagaaagtccccgtaggtggcaaagcatctctgctgtgttgaaatgacacacttagaaaagtgtcagaaaatggagttgccattgctctggccccccaggacctgtggctcagcctccattgggcctttgtgtctgggccagaccctccaggcaagcccccagtgaggctcttgggcccgtgattgcaggggcgccttgccatcccccgtgtcctgccctggttctgctagtggagcaagaagctgatcagcctttgtgttttcagatttcttctctccgttaaggtaaccttgttctttaaaccagcttgctttcaaagttgttttcctaataatatcaaaagggggaaaaaaagctgcctgaaaatccttttttgggaaagagcctgggcataaataaataaatacaaccatacaaagaagaagattaaaaaaaaaaaaatcaaagatggaactttcgcatttggcctgaggtataaatggcaggcttctgatgacatgcttttagtttttgattctctttctttccttttatgttcttgtaattccaaatcaggaacgatggtgtttttttttttttttttcttttttcttttttttaaaccttgcccaatctttgggtggaggctttggaagccgcacatattccaccattatagttactcaaagctgacgcttcccgaggggtggctgcatgctggcgactgtgccgagggtgtgtgtccctgaatctttgtgatctctctgaggtgtgttaggccccactttacagatggaaactgagacacacagagccgtcaagcagcttgcccaaggtcacacaccttgtcagtggtcaagctgggatccaaaaccagcagcctggctctgggattctaagctctctgttgtgctgctccttgaatatattaaaaggcctactatgtgcaggaactgggttggcactggcaggaaggcaagttcgggaaggagatagttacatggctgtgtggcttcagctggggagaggggaacacccaggagggcttcttggaggaggcggccagtaagatgaggttgaagataggtaggatttagtagggcacagtgaggtgcaagatcaggtagaactggctttagtcctgactctggggcttcacatctaacagcacaggaccagccactccctcacagacttgtttatttattattattgttattatttttgagacagacggagtctcgctgtgttgcccaggctggagtgaagtggcacaaccttagctcactgcaacctccacctcccaggttcaagcaattctcatgcctcagccgcccaagtagctgggattgcaggcgcccactgccacgcctgactaatgtttgtatttttagtagagacagggtttcatcatgttggtcaggctggtctcgaagtcctgacctcaggtgatttgcccaccttggcctcccagagtgctggaattacaggtttgagccaccgtgcccggcctccctcagacttgttaggagacaaggtgaatggctggcatggaagatgccctgcacatagtaggtgctcaggaaacgttagtggtgctctccccctttccaatggacagtcagcaatatgggttggacaagtatgttctgtaatccgaggttgtgtgccctctggctggcccacaaaatttgaattaatggctcgtatttataaatggggagattccacaccaaaccccacatttccagcttttcttgaaaactcagatctggtgactgcagcctgcacttcccactctgccatcccgggctgagcgaggagtgcccgtctccagagacagtgtgccaaggggccctcctcctatcaaatgccctcctgtctctctcttcctacctggccccccgtgcaggccacagagcgtggtgctgcaggtgaactctgctgcggtgggaacgagttggcatcgactccctcgtggctggctgctgggtttcgtgtggacagagacattcatcttagaacaatgcagacacttaggaaaacaagcacaaggcggtctttttcccttaatcacccatctcatgaaatcaagccccagtcccttggaagctcacaccctccacaccctccagacactgagagaatgcatgccagcatgcctgtgccagcgcgcctgtgccagcacacccgggccagcacacccgggccagcagatctttctctgtgactgaagacagccggcacttcacatctttgaagggtttgtctttctggcaagtagaccggtactttaaaaaccaaaacattcctgggattcactgaaagccagtaaactggcaccgttcaggtggcgggggggtcgggggaggggggaagccaagggtgtgagaggagcccctccttccaaaaatcacaccgatcctctgaaggtgacgatcagatccaggctgcaagttcttctgcaaaggagctgtgtccataagggaacccaggctgcaaaatatagcaaggcccagaagggcatccctcaaaccttcatggggttcagctttggacatgctggctgtggtttgtctccactgcactctgcaaagagccccgaaggccctttccttagcctggccatatttcaaggccagttcaattgctgcctcctccaggaagccctccatgcttctctgtggaataggggacctcgcctgccttgtggtcactcttcctccagtctgtgtctctcttggagcctaatcacagagaccctgtacatccacagctgcctctcccacttgcagggagtagtttgtgggccatgtgtgggtgctcacggttccccttattcctcaggaaatgtgaggaagttcctgtgaggccggtattcccaccaccccatgttacagatggggaaactgaggcttagtgcggtgaggggacttccccgaagccacacaccaacaagtggcaatgcgagatttggactggggctctgtggccacaggcctgggctcctcctgccaaccgaggggtctgccagcctgtgcccccctcctcctggtccccgaagcctttgcttccctcaggccatcgtgcataaccagccccttcagaatgcgctgctgagcagtccctgggcggtgttcgtgagcacgtttctcatttattaaggtcacaaaatccctggccctgtttagtgtcatctttgatgttcaagggcggtgtggaaatctctgttttgatatgacccaatttctaggctttcaaaatgtggcttctctcctcctccctctctgtgtttttgaaatcaggtgagcagggctgcctcgaagcgttgaccacttgccccgaggtctccctccccacccctcaggcccaggcacatgggtgcagtgccagctctcgggccttgccaagaggactctcgggcgtagcccacctgtgtaatcctccacacatagggaaactgggtcttttgttcttcctctgccatcagcgtgagcactgcaggcagctgtgctggacgggacctccctgcccctgttgtgtcctcctatgatgccagccaggacatggaacttccaccccgaccccctgtgctccagggctatcatattcccaaggatttctgtgaaaaatcacttttccctgtttcctttctgccttttaagactctctgctggttacaactctctttgtaactcgtcatgtggtacaaatacttgctgaaatttggtccctgttttctcagctgatctgggtgacctgtgggggttcttctggattatttttagagaggtggggcagagggagtctcaaaactctatgtctgtatcatttccctgtgaaggtatttaacatttgtccactgctggtgtagcgttatgctaaggattttggaaattcaaggatgagtggtgcctggatcttcccttaggatgctggctgtgggtggaggacagtgtgtgcggcagccaggctggctcgcggctggaatgtgggttacctggagagggcctgctttttttttttttttttttttgctatttaaaaaaattgttgtaaaataggcataacgtaaactttaccatcttagccattttcaagagcagagttcactggtattaagtacgttctcattgtgcagccatcaccaccacccacccacagaactctttcatctttccaaaccgaaactctgccatcattcaacactacctctctatttgctacttcccccgcccctggcatccaccagactgctttctcctctatgcattcgcctactcgagggacctcctactggtggaattgtacagtgtttgactttctgtgtctggcttatttcactgagcagaacattctcaaggttcacccatgcggtagcctggtccgaatgtccttcctttttagggctagataatattccgttgtatacgtggactaccttttgcttactcattcatctggtgttctcaaatgccaagactcagtgactgcagcagtgcccgaaggttccctcgaatcaaagaacttcctaaccccaacctgtacctaggctctgatactcctgcatcaggcagtcctctaggataaggtgcctgtttaaaatgcaaatatattaccttcgggggagtgggtaactggcatcctggggccccgctgccattgtccttatgagggagggaggttgtgttgtcctggaagtcgggtccacggtcacgtcctgagagtcccatcacgtgccatgctctgggctggggacttgatgttcattgtttggttacatttagcccttccaaagaccctggcatttttgcagtgttacctataaattccatgtgcggaaacatgggttatttccactcttttttttgagatggagtctcgctctgtcaccaggctggagtgcactggtgtgatcttggctcactgcaacctccgcctcctgggttcaagcaattctcccacctcagcctcctgagtagctgggactacaggcgcacgccaccacgcccagctaatttttgtatttttagtagagacaaggttccaccatgttggccaggatggtctcgatctcttgacctcgtgatccacctgcctcagcctcccaaagtgctgggattacaggtgtgagccaccgcacccgacctgggttatttctacttttgggctattttgagtcctgcagctatgaaaatgggaataaaagagggtccgctttttaagaagctgaatatcggcctttgctgacatgagaggagctggcatccttgggccctgctgccattgtccttatgaaggatggaggttgtgtcgtcctgaaggctgggtccacagacgtgtcccaagagcccatcatgtgccatgctctggactggacgctcaacattcatggttacattcagcccttccaaaggccctggcatttttacagtgttacctataaatgccatatggagaaataggtgcagagaggtgagtgggatgtacctggggtctcacggccagcatgagtggggccctgttggcctgctgctccaaagccatcatgccacacccccttgctgttccatcatctgccgctgtggaggctggatgtccagagctagaggtgttcaaggttcaaggtgattctggtgttaaaagaggaaataccattttacttctgaacctgtttcatggagaaagaggtacagctccgggcacactggcctgggtacctttgcagcatgtgatcagggactgctccccagcggccctccaccagtgccatgaaagtggccagggccctacctgcacccggcaccatggatgcatcttggggctggaacctcgagtcttacatgcagcagaggctgaggctgtgactgtggagaaagcgtgacattacagaagcaagggttttggcacctggtgtctgtgtgggtgggtattcctccctggtggatgtggctgaaaggcctgcagggtctcactggtgcagggagatgaggggtcatttctggttctgggattgtccctaatcactgggcgttccagatcctgtaactgttcagcactcccttgagacaggaggtcatggtgtttctgacttggagcctctggctctctttattagattctgttgcatgttccagccatcctgacccgggtgttccatcagatttctgtgcctgtgaatgtggccatcaccagtgaccccactttaaactccagattcacctgtatgcatgaccggagggggttagcatcttgagtccgtggttcaggacgcagccccccggcagagggaaggcagccccactctctcatgccccatcgctgtggtccatgctttgtctgcctcagcagtcttggtcagatctggaagcatctggaggcatctggaagctttggtgtcttagttatgagtttcaaagggcagtgaaaacagactggcagagctcagcgagacctgggaaatatttggggtggggaggaactgcagaatgtattcttggttcagagcatttttccctctgactctttctgggcaacagaccttttaggaatgtttgttaaatgctgaaaaaaacaggaattgatttctctctgcgtccacagccaacatgtgaggccacggcactccgtgtatactaacctggtttttctttccttttgctcaacagtgagtgacctgcaggaagaaggcaagaatgccatcaactcaccgatgtcccccgccctggtggatgttcaccctgaagacacccagcttggtacgggggttcctccgctccctgccctgagacagttgagcttccgtggcactaagttggtcttggggaggccaatgaggagcccgatagatctggcctcttgatcagatgctgggggcatttgggagtctaagttcttagctcaaggtcatctttagaaaagtccattgggaaaagcaagtccttcattaagggtttctgccctagtcttaaaacgtaagttttatttttcaggtggtgaagcaaacagattgggagaagactgacttgaaaagatagtttgttaaactcatagttctgaaaggaggtgtagcaggccactcagggccatgccatgccacgccatgccacgccacgccacaccatgccaagccacgccacaccatagcacaccatgccacagaaggccacatggaaagcactagtgtgaggcagaggcagaaggagcagggctaatgcctttatttgatattttatgtatatattttttgagatagagtctcactctgttacccaagctggggtgcggtgatatgatcacagctcatggcagcctttaccgtccaggttcaagtgatcctcctgccttagcctcctgagtagctgggactacaggcatgtgccaccccgcccacctaactttttaatttatttgtagagatggggtcttgccatgttgctcagactggtctccaactcctgggctcaagcagttctcctgcctcggtttcccaaagtgcagggactacagatatgagccactgcgcctggccccaacacccttactgtggctttctctgaaggaatgggcaaggctgggtgaacaggcctaggcctggcttgttggaatcgtttcactgggctttgcggtgcaggagctgtcctgagtcttctcagtaagaagactcttcttcttccacaccacgtggcgtggcgtggtatggtgtggcgtggcgtggcatgtccccagggccaggggagattagggtgaggatattggctgggagtgtaggagccccgtgagagcccaaggaaagaggtggctggggactctgggctctgcggctcaggctctgagtggttttcatatgaaaggtgtgctcacagagggtggtttaccatctctaggaattagcttgccctggaggtgcaatctctccagagtcagcaaggccccgagatgccaagcaccagaaaatacagaaaacagggcgggcacggtggctcacacctgtaatcccagcactttggaaggccaaagtggacggatcacttgagttcaggagtttgagatcagcctggccaacatggcgaaaccgcgtctctcctaagaatacaaaaattagccgagtgtggctagcctgtaattccagctactctggaggctgaggcaggagaatcgcttgaacccgggattgggatgttgcagtgagccgagatcgcaccactgcactccaacctgggtgacagagcgagacatctcaaagtaaaaaaaaaaaaaagaaaaaaagaaaatgcaaaacacaattaatatgcttcttccctttgggccagccagagctgcccgcggcctgggcttgcagggtgggctctgccaagtggcccaggcccctgcgctcactgcctgatgtaatgggtaacagccaagacacattttccttaaagtgtgttttgggatctagctgatctggaaggcatttatggaacattctgcgtatttccaaaccctggttcgaagggaagtcccggttcatcccttttttgtggtttccgtgacgaggccaggccagcaagagcttatggagaagaaacgccgatgcaagttcagccgccaaccgacccgaagccagagctggtgatgctgcctgaggtcgcaccagggtccacggggctttctctccctccgcttagaagagagtggccccaccaggctcggtggctcaggcctgtaatctcggcactttgggaggctgtggcaggtggatcacctgacgtcaggagttcgaaaccagcctggccaacatggcaaaaccctgtctctactaaaaaatacaaaaattggctgagtgtggtggcaaacacctgaaatccccgctacctgggaggctaagtcaggagaatcgcttgaatccaggaggcggaggttgcagtgagccgaggttgcaccactgcgctccagcctgggcaacaagaatgaaactccatctcataaaataataaaataaaataattagccaggcatggtggcacacgcctatagtcccagctactcaggaggctgaggtgggaggattgcctgagtctgaagaagttgaggctacagtgagccaagatcacaccactgcactctagcctgggtaacagagtgagaccttgtctcaaaaaataataataattgaactcactcactgaatatttgcacagcacctgattctttctgaagtcctctttgtatatttcatatcctttgggctcataaatgtcatcattgtagcgaatattgggggtccactgtgaatgcttctactcctcagtcccttcagtgaccctgtgaggtgggttgtatcattatccccattgtacagatggggaagctgaggcacagatctaagatcacagagatcactagtaagtgccaaagtcttgaaccccgggcattttgcccccagagctaggctcctccccctgctctagaccctctcagtgaagatggtggccctcatcagaggtgagtaggacaggtccctgtccttgggcacgttttattgcagctggctatgacgcacaaggtggggagggcgggggctcggttcccacaaaacactggcacagagataccaccctggcctctgggcactgcttctcctctgactgaagtggagagaaacctgaaccaggcccacctagcctgtgtggacccagacctgctgaagattctgagcccatgtctgaccccccggcaccccctggatggagcagcgcttgctgtacccactgtggtgtcccgggactgtgggctcctcgaggggtcctgcctcagtcttggagccaccgagaggagcatggcacagtttagcgaccactaaagtcacacagctcagagatggcatggcggctggtgtctgctctcagcttccttttaggaaaaacaaggagcctctcacagcccttttcttctctcccagagtccctggagtcctgttcctcaatgcaggatgtcagaaagtcccagggcacttggcagtgagggttcctggccacccgaagacctaccaaatgggagtatgcgggcccaggcccctctgctttaaacatgcctgcagtgactccggggcccactgaggtttgggaattgctcccctctaggccgcgtgagcagcccgtagcagactgagggccatgatgtgcagtggcctgcgggggtttcatgtccagggtccccggtcaaggctagcaggtcatgaatgctgacaggcagcaagggctgactgtgagctctggagcccccagatacagaggtgtttctcatctggagcaagcgcctgctctgaatcaggcccctgccccgtgagacgcagctgctccctggtctgtgcagagcctctgattctggcctactgtcaccatcaccaggtgaccaggagatcccggcgggatctgcagacatggacacactgccacacatagctgcctgcctggggcctgctgtccaccctctcaggcccactgttcccctctaggcggggtcaggaatgaaagctaccccacggggacaggtaaagaccggagatgcctctgagaaagtgtttggtaacagtaagcctcgaaacggcatctctgtcctccacctttcacagtctctgggtcagacgccccattcctctcagtggtcccgccgactgaggcaggacccctcaagaagcacacagtcctgggacatccgagccaccatggcatgctgcccagtctggggtcagacgtgggctcagagccttcaggagggagcagcgagttccctgtgggggccacatgagctgggcgggcccgaatcttgcttctcctcagttcagcgagagcaaggtgtggggacatgctagatagggcaatgctgagatttttagtgtgggttgaaggggatgtttccagaaacgggctctctgaaggctgggattgggtagtgacctgctcactctccgtcctgcaccccctctcatacacgtgtggactcacggcctggccctgctccttgcccgcctgagatgggtggtccagagggggtctcagacatgggtcacacaggcacacaaagtcctctttggggctggagagcttggaagatttggcattcgggctcaaggatctcagctggggagctgaggtctgaagggtgaaggaaacatgggccagggagagagtgtcagacagcgggagcaggtgccaaggctcagggcaggtggcagcaaggcttcaaggagtgagggaaggccggatgggctggagcagattgcaccaggagggcaggaaatgaggcgggagaggggccttggaggccacatggaggacgccggccttgatcccagcaggagtgggaggctgcggaggcctttgcagagatatcatcaggactcccgagaactccctgcacattacctggagtgtccttttcaggcatcagatctgtatgacttcaaaattagtttctccatgttgtcagagtttacactctgctgccgggaagttgcatcacatccgtgtcagcagcaaagtttcactcaaagccattttctttctttcttttgtattttattttattttattattttatttatttttaaaaatagagacagggatttcactatgtagcccaggttggtctggaactcctgggctcaagcaatcctcccgcctcagcctcccaaagtgctgggattgtaggcaggagccacttacgctcagcttcaaagctgttttcattctgaccgacatggtcagtgtccccagccccatgggagcctgtctgggctctgggaccctggtctcaactgtgtcctggccatctccacttgtatgtcctgggggtaactggcttctgcctggagcccctcttgtgccttttttcctctttaagagagaggtgtggtatagagcctcccggtgagtggagcctgggccccacccgacccatgctctgtgcaggtcccggagctggacagtgtggcagcctgagacccccttgcccttccctgtgtgtgttcagaggtgctcggcgcccgctggcttctgtgtggtgctgggcatttctgctgtggagcacgcctagccttggtgggtgccccctccgcagtcccgcctccccactgtctccacggcactgtcctccatgacgggctcagctggctgcctggtgtctgtgggatccaggctgaaacgtggagggaaagcaaacaggtagagaaatagaaagagggtgaggctgaacacgttttgctgttacacatcatccccccccacctttttttttgctatttatttctcaatattttttctgcatgttattttacatacaacattgcatattgattcttttccatggaatgtaccaaacattttccatttcattataaccatccagactcttcaaatgtatttataaatagtggccacagggaactacctggtgcctgaagctttcccacataccagattccggccagcggaggcatctcatgccctgtgaatgctgctctctccttatttctcctgaaaaatggaaatggtttggaccagctgctggcggagtctgggaggagcgaggccgggcagaatgatgagtttgacttcatccctttccagaagaggggaaggcgggaggatgccccatccaccttccagaaggcggttccttgcagtcaccctcccctagtgctgggttctctgcttctccatttgtcagagatgagttggcctccccctggttccccgtgtccctgccacccccacaatcgctgaccgtgacttccttttgtccctggcagaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattcagatttaaccctgaaaagcaggaggggtcaccctggccactcctggccaggagccatctgatgccgatgcctgcgctgagtggacagtcagtttccaccacgtctggaggcgtgaatcccagctgggcgaggaacctggctgccccgctcccagaagtcagggaacagtgagggaaggggcccatggtgctggccttcttgggcagcggctgtccttctccagcgtggctcctgctcaccgtgaggcagtgcttgtgtgggtccaaggacagattgcagttttggttgctctgatcgaaaccacggtagggcttgagagagaatcccctgaagaggagaggctgtgggctctgcctgaccttggtgaacccagggtgggctcttgggcacacggctgtggcagacacttggcttccatagcccacggcgagcttgggcaccccgggattcttgaaaatgccgatggtgacagtgtctgccagaaacagacatttttctattaaaagtgctttttaaaaagcttctccaccttcaccaccacagtggacccaatgctgggctgtacaactgtgttttcatgagggctcattcagaataagtaagacggcttgcaagttatgttcttttaaaatctacattgaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcacctgtagtcccagctactcaaaaggctgaggcaggagaatggcatgaaccccggggggcggagcctgcagtgagccgagatcgcgccactgcactccaacctgggcgacagcgaggctccgtctcaaaaaaaaataaaaaataaaaaataaaatataaaataaaataaaataaaatctacattgagaccgggcgcagtggctcatgcctgtaatcccagtactttgggaggccaaggcaggtggatcacctgaggtgaggagttcgagaccagcctggtcaacatggtgaaaccctgtctctactaaaaatacaaaaaatttgccgggcatggtggtgggtgcctataatcctacctactcgggaggctgaggcagaattgcttgaacctgagaggcagatgttgcgttgagccgagatctcgccactgcactccagcctgggcaccaagagtaaaactccatctcacagaaaaaaaaaaaaaagaaattccaaatgtcagttttagggtccacccaaagatgttgattattaataacttaaattatttaatttgttttattttttccctctgaatacccactttgttatttcaaacagaagaacgttgatgaggaaagtcactgtcttttagccacgaaaatgttgttcttgggggatatttaagcaagggatgcatgagaattatcaggcttctacaaagaaacagacccaattgtgtcaatatctagagagaggtttattatgatattggctcacttgactacggaggctgagaagtcccccgacctgccatctgcaagctagaaagctggagggccagtggtagagatgccagcctgcgtctgcagccctgagtaccgggaacagggtgggagaagatccaggtgctggcactagcagtccccggcagagagaggtgaatcccaacttcctccacctttttgttctatgggatcagatgaggcccacccgctttggggagggctgtctgctttactctatccaccaattcaaatgctcatctcctctgaacaccattccagacacacccagaaacaatgtttcattggctatctgggcaccccagagcccaggcaagttgacacagaagatgaaccatcccatgcacctttctaaagatttttttctttgatttttgagcaatgcttgagagttcacaaactccattcacaggattatctccttgaaacaacaccctggggagctgtgtcattcttgcttccatgtggagactcagagagaggtgaaggggctgggcgccatggctcacacctgaaatcccagcgccctgggaggccaaggttggggggaatcacttgagcccaggagttcaagaccagcctgggcaacatggtgaaaccctgtctctaccaaaaaaaaaaaaattaactgggtgtggtgggaggcacctgtaatcctagctatgcaggaggctgaggtgggaggattgcttgagccccggaggtcaagggtgcaatgagctaagattatgcctgtgaatagccactgcactctagcctgggtgacagagcaagaccctgtctcaaaaaaaaagacaggtttaagtaactccccacccccaggtgctggggttagtgatgtgtctgggcttgaatggctctgtccatttggtgctgtgttcactgagccaagttgagtgcgtgtggggtcctgtgctgggccctgggattcggggatggataagtgacttccctgctatgcaggatttgatttatgttcctcctggatgtctgcagtgccacccacccctgcctttgctgctttgctgccaaagacccccaggctgttttggccttggtggggcgagggctggctgctgcatgtcttccaggtttcagattgagaagaaggccacattgaggggcatggggtggactgatgggaaagctaattagcatcctttggggcaaagtacaactatggggcaaaatacaactaagaacaggaaggagctgaggaataaatgcctctccccgacttccctgatgtgggcttctgagaccatggctcatggagatgggctgcatggctgatcatcagctgggttttcttctgaagccatagccagctcatgcacctgcctcacctcccttcccctccctgttgctcgtctagggtgccctcccctcacccccaaacccctgccaaagaaaaggcatcagcagtgagctttgtcctggctctgtttttcagggaacctgggccagaatcatggtccccaaagatgaccatgtgataatccctggagccattgactatcatcttacatggcaaagggacatggtgggtgtagttagtgaccttgcaatgaggaggtcatcctggatgatccaggcgggcccagtgtgttcgctagtgtctgtataagagggacatggggagctttgactgcccatgaacatggcagcttgaccctggaggcaaggtggtagcttctggctctgaagatggaagaaggggccatgcactaatggatgcaggcggcctctgcctctagaagtggaaaagacaaagaaatggattctccactagagaacccagaaggaaccctggagcctccagaaggaaccagccctgctgacacctggattttagcccagtggaacagattttggactttgacctctaggactgcaagagaatccactgagccgttggaagcccctgggtttgtgttaatttgttacagtagccacaagcaactaacaccatcctgttctccaggctgctgcctccagctgcagctggcgtgccctggccactggggccaggcagggtgggttttgatacctgcagcggcagcatccttggccatttcctggaagggccagttgccagacactgagatgcctgttactgcaactgtcccaccagcctggagcacgtgtttctggagacaggcaaattctggaaggctccacctgctctcagactgcaggttgcgtctcaaagcaggctggcagacattttccactcttgatcaatcattttccaaaataagcatagacacagcaacccggagagcagcttcggtttggctgtcggtggcgtgttagttactgtagtggtggcacagaggcgatatacgttaaatattagttctcactgactatagccttttaaacagagcagcgtgtgggtggcagcaggtgagttggctatactgagcttgggctgcccttggttgattcttgtttgtcaggcatgcagggggctctctgtgcgtccaggcatattccctgtctggatttgcttgtgttcatggattttcagcacctcctttcttctggtttgggaatgagtcaggtcctcactacacaaggccagagcagtatgcgtgtgtgggtaggggtgagcaggtgtcattccctgcctcccctcctccttcactgccccagccaccctgaccaccttgctgttctgaggacacactgagccagtgcccactgggcatcaggtgaaaggggacatcccacaagcccaccctcacttctgacaccaatggcaagttcaggatctccaacactgccctgaggtttggtcatttgctagagggactcccagaacccacttaaagctgtcaccctcacagttacagtttctgatggtgaagggatacacatgaaaatcagccgagggaagagttgcccagggcagagttgaacgcacccacacagcacctccattgtcctttcaccatggggtcataggcagcgttactctcccggtgatgtgggacaatgcgcatgcagtattgccagccggggaggtcatctgagcctccgtgtccagagtttctgctggagctcacttgcatgggtgtggctgactgtccacatggctcatctgtctccagcccctccagcagctggctgatagagtgcaacccaaagccccctccctgaatgacatagttactccctggctggcccgagggccccaggtaagcagaggtactttatctggcagggcatttcggagcttaggagatcacctcccaggggctgaggtcacaggcccaacctctctgtgggcaaggttaggttcattatcacgtacctggtctttggactttcaaaggcccatgcctggagctgtcttcaacacttctttcagttttctctcaatgcttcctccttggagacgtatttcctgcccctgtcactccatcactctcctcctaaccccagttactttttctttgctgggcttgctgctgcctggagtcatttcctatttactagtttgtttttggtctttctcctcccctagaatgtaatcttatgctgtgagggaccatgaccattctcttcccagctaaatccccagggctggagttgtgctgcacatgcagagctaattcatccttgatagatagtaagagaaccgatgggggtctgtgtcagcagcaccaacatgaggttcacaccagcgtctcccaagatggcatgcggcttagagacaagacagatgtggttgctttttgttgttgttgttttgtgttgttgttttgagatagggtcttactctatcactctatcacccaggctggagtgcagtggcatgatctcagcttactgcaacctctgcctcccaggctcaagtgagtctcctgcctcagcctcccaagtaaatgggattataggtatgcaccatgatgcccggctaattttttgtatttttagtagagagggggcttcaccatgttggccaggctggtctcaaactcctgacctcaagtgatctgcctgtcttggcctcccaaagagctgggcttacaggcgtgagccattgcatgcccagccagatgtgtttttttttttttttttttttttttttgctctaccccaaacctgtgagatggcagggaggaggctctgggaagagggggtgagggttggggtaaacctgtggattggatgctgatgtaggtggtcccaggtgctcccttgggaggagatggacagtccggatggtgcagacaaaacacctccatccacattacctgcgtaattctctttgctttccagaacatcctttgtgtactgtggactgtgatgatctaatgctagtggattacatctaagtaggccttagtagaagccacctcccagtggttcctcggaggcatttggtccagaagcagatgattttagtgcaaagcacagaccgtatgcaggcctgagcagatcaggggacagacagatctggctgacatcctgatccgctggctgtggtggtgtggccattgcttgtagccacattgcagtcttgaatgtcccccttggaaatgggggacatttccaaggatgcctgcctggtcctctagttttctctttctctgttctctgtcatctgcacttttttcctcttgtcttgattgcttgtcctgtctcccctagtagacaccccctctgacctctgctgcctcaggactgttgctgtataaaatattgtgagatgccctctgctcctgtttaaaaaaaaaaaaaatccttagctctgggtaagctaggcactgagaatgaggccagtcattcaaaacttgtctctgagcattgattatactcatgtattatactgttaaggggtgaaggtcggctctagggtcagcttcctggatttaaatcccaactcagattaaagtgggagaataatagcaccaacgtgacaacctcaaagtgtcatttgtaaggataatgttagatcatacacttgatcacccgttagcagtgtaagggcagtgtgggaacatgagcatgaacagggcagcccagaagggagttgaatggacagatgggcaatgccagtttggaagtgggtgcatgcatccggtgggttcaggagcctggaagacttatccaaaagtcatctttgctggtgtttcttcctgtgtattttctctaaccttctccagcagtgacctgaattacttatgggtgaacactgaatgctgcccaggcaactagaggtttatagatgagatactttaaatttttaatgattcttaaaagagggagtggctattcttatgctttccagaatgaatagccaagggaaacctgtacagttgccatataaggagaaacctagacctggccttagcctctaggtcctggtgcagattcttagcacgtagcgcctaaaacctttgcgatttcctgagtgataggagcgtcttttgttattcataatgagatctgggtttatgctaacgaggtgactcagggtgggggctggccccagagtaaccaacacaggattagagggttgggtctatcagtcctacccacccccagcctctgggtggggtggagaggggctggagagtgaatcaaatcaccaatagccaatgatgtaatcagtcacacttacataatgaatcctccgcaaaacccatcaacagtggggttcagagagctttggcgctgggaaacacacatggaggtgctggagggggacacgcagggagagggcatggaagccccgcctccctccccgaaaactctgtcctgtgcagtgtttcttattaattacactgtccctgagttctttttttttttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaaaaaacacagaaaactccctaagcagattggttgaaagcaggctgactgcatgtcatctgggggtgcgtctccccccaagagcaggtttcacatctcattccccggttgattggacaagacccttcctgtctttaagttctgttttcttcctccctttgtctctccgaagaaaatcagctgcatgaaaacgatcctctgggcagaaattggtgctgttggagccgcacagaggtgccctcccgtgccccctggcccccaccgggccgtgtctcctcctgcctgttgcaatcagccctcgtccgactctttttggaagtgattaaaacataactgtcatagctctgggggagacaggctgcagatcctgattataattcagaaggatctaaagaaaaagtaattttttaaaaaaattctggttaaagccaaagctcataagacgtgtgtgatggagtggtatgcaagagcacaattaatgtatgtcctagacatctgcccacaggattcagggctggcaaatgagtgcgtccctaaaaataatgactagtgctatctttaaaaagtcttttgtggcatagcagattaagatggatggcctgggaagtacagtggcagcgtgtgctgtggtatccaggaataagttgtacctcctcggggtggcagtggaactgggccgtgaacagcttttgcttcccagagaggactgccatggcctgctgcatggaatttgattttaatctgtttgttatttttgggtttggtcttggactgggtttgaaatccagatgtgacttttttttttcttttttcagttttctttatagcagcaatgttgtatcttgtgtgtttcctaacaagactgagctctgagcaaggcagcctctggaaccaaatgtctgcaggcccaggagacctttctagaaagttcataggtgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaaagttcataggcggttctgcagtttgagccccttctgtgggtctgtgcctgctttagccgcttgagatatggcattgaacaaaacacaggccccgcctgggagaagctgccaggccagctggggagacagacctgataagtgaaaatgagatcgcgtggcctgcatgctccgaagaagactaaggcaggaaacaggactattttctcccgactgaattgtcctggtatccttgttaatatcagttgactgtgacttgagacttatcttggacacccctttctgttccgtgggtctgtgtctgccttgatgtcagtcccacagtttcgacgactggagctttgtagtcaggtgtgaaacagtggagtgtgggtcctccagttttgttcatctttttcagattgttttggcaatccaggagtcctttgaatttacatatgcattttattttattttaattattaatattattattattttttagatggagtcttgctctgttgctggagtgcactggtgcaatctcggctcactgcaacctctgcctcccaggttccagagattctcctgcctcagcctctcgagtagctggaattacaggcatgcaccaccatgcccagctaatttttgtattttcagtagagacagggtttcaccatgttggccaggctggtctcaatctcctgaccttaagtgatccaccagcctcggcctcccagagtgctgggattacaggcgtgagccattgcgcccggcctatatatgcatttaagacctgcttgtcaagttctttagaagccatctggatagtgattaatttgtaaaaatgatacttattatctttttgaactgccaaagtaatatatgctgctgaaaacctggaagacagaaaaatccaatagaaggcagggctaattttttttttttttccatgtatgtcccttcaggcttctctgtgtttttcatttttcctacacaaatttggaatcattccagagctagtaagcatctagggccacatttggactagtaccttgggataaattagagctggaattgccgggtcatatagtgtgcacagggctagggactgacttattttcctttctgaatgaagactctgaggtctagagaggttaaatgagtgactcaaggtcacacagctaaaactctggtggagctgggtcttaatgcagaccctacatattcatgccatgctgtatttatacaggcatgtacaccagcgggtcgggattttagggggtgttttaaaattctgcctgcaaaacctttttttttttttttttttttttttttttttttttgagacagggtcttgctctgttgcccaggctggagtgcagtgtcaccatcacagctcactgcagcttcctcccaggctcaagcaatcctcctgcctcagacccctgagtagctgggactacaggtgtgcactgccccacctggctaatttttaattttttttgtagagatggggtctcattttgttgcccagggtagtctcaaactcctgggctcaaacactcatcctgcatcagcctcccaaagtgctaggattgcaggtgtgagccgctgccccaggcaaacccattttaaagccatgagccaaaaattataaaagacatgcaaaatattatgagtagtcacttatctagtatttgcggcatctctcaggcttggggctttgctgggagctctgagggggtggaagaggctctgtcactggccttacctggctgtcaagggctgagtgtttggtggagggaagacgtctgcagcctgggaggctgcgggtcagaaggaggtcagccggggagctgggaggatcgtggggaacccgtggtggaaatcagcatggcgagagagtggaagcaggcagaggagggctttgaagaccaaaaagggtagttaggattgctgctctgtgtgtctgtaaacttggtgttgtctctcgaatttaaatgacatgctttgaaaacaaaaaaacaaacaaaaaccaaacccataaaatctcactaagtggccagagcaagttcccggggggtggcgcatagatgcagcggtctgggttctgtggctgggggagttggcttggggtccgtggctgggtcagtcttcaagagccaccctgggtggcactccaggtctcttggtctggggggaataccctgaccccagcggtttcacggcctcctccccactcagcctgggggagagtccagggtcggccctgtccccctccccccactcctgtcactatcagtcccctgtgctcagcttactggcagggttcctcctggctgtcccctctgcctccagcgctctttcctcaggtgtccacgcagctcgtcctcacccttttctgtctctgctcagatgccgcctgaggctcccaaaacagggtctcactctgtcacccagggtggagtgcagtggtgcaatcacagctcactgcatccttgacctcccaggctcaagcgatcctcctgccagcgagcttgttacaattcctgcaccaacacggatacattgttactaactaaggccctacaccagcaaagatacattgttactaagtaaggccctgcaccaacacagatacattgttactaagtaaggccctgcaccaacacagatacattgttactaactaaggccctgcaccaacacagatacgttgttactaagtaaggccctgcaccaacacagatacgttgttactaaataaggccctgtaccaacacagatacattgttactaactaaggccctgcaccaacacagatacgttgttactaagtaaggccctgcaccaacacagatacattgttactaactaaggccctgcaccagcacagatacattgttactaaggccctacaccagcacagatacattgttactaaggccctgcaccaacacagatacgttgttactaagtaaggccctgcaccaacacagatacattgttactaagtaaggccctgcaccagcacagatacattgttactaaggccctacaccagcacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaactaaggccctgcaccaacacagatacgttgttactaagtaaggccctgcaccaacacagatacattgttactaaataaggccctgtaccaacacagatacattgttactaactaaggccctgcaccaacacagatacgttgttactaagtaaggccctgtaccaacacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaagtaaggccctgcaccaacacagatacattgttactaactaaggccctgcaccaacacaaatacgttcttactaagtaaggccctgcaccaacacagatacattgttactaactaaggccctgtaccaacacagatacgttgttactaagtaaggccctgcaccaacacagatacattgttactaaggccctgcaccaacacagatacattgttactaagtaaggccctgcaccaacacagatacattgttactaactaaggccctgcaccagcacagatatattgttactaaggccctgcaccaacacagatacattgttactaactaaggccctgcaccaacacagatatgttgttactaaggccctgcaccaacacagatacattgttactaagtaaggccctgcaccaacacagatacattgttactaactaaggccctgcaccaacacagatacgttgttactaagtatggccctgcaccaacacagatacattgttactaaggccctgcaccaacacagatacattgttactaagtaaggccctgcaccaacacagatacattgttactaactaaggccctgcaccaacacagatacattgttactaaggccctacaccagaatggatacattgtacattgttactaaagccttgcaccaacatggacacatcattactaactaaggccctgcaccaacacagatacattgttactaaggccctgcaccaacacagatacattgttactaagtaaggccctgcaccaacacagatacattgttactaactaaggccctgcaccagcacagatatattgttactaaggccctgtaccaacacagatacattgttactaactaaggccctgcaccaacacagatatgttgttactaaggccctgcaccaacacagatacattgttactaaggccctgcaccaacacagatacattgttactaagtaaggccctgcaccaacacagatacgttgttactaactaaggccctgcaccaacacagatacgttgttactaagtaaggccctgcaccaacacagatacattgttactaaggccctgcaccaacacagatacattgttactaagtaaggccctgcaccaacacagatgcattgttactaactaaggccctgtaccaacacagatacattgttactagctaaggccctgcaccaacacagatacattgttactaagtaaggccctgtaccaacacagatatattgttactaactaaggccctgcaccaacacagatacgttgttactaagtaaggccctgcaccaacacagatacattgttactaaggccctgcaccaacacagatacattgttactaagtaaggccctgcaccaacacagatacattgttactaactaaggccctgcaccagaacggatacattgttactaagtaaggccctgcaccaacacagatacactgttactaactaaggccctgtaccaacacagatactttgttactaagtaaggccctgcaccaacacagatacattgttactaactaaggccctacaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttagtaactaaggccctgcaccaacacagatacattgttactaaggccctacaccagaatggatacattgtacattgttactaaagccttgcaccaacatggacacatcattactaactaaggccctgcaccaacacagatacattgttactaagtaaggccctgcaccaacacagatacattgttactaagtaaggccctgcaccaacacggatacatcccattactaactatggaggtgctttattcagatatcctcagtgtcacctgttctcctttggccgtctcagggttcctcccaggacaccacattgcattcagtcctgaggcttctctgggctctgacagtttctcagactttccttgtttctgttgaccttgacagttttgaggattactgctcagagagtttgtagactgtccctctgttggggtttgtctgatgctttcttcatgattcgatcaggttgtcactttggggaggaagtctgtgaggtcaagtgccattttcatcgcatatcggggcacacccatctgcacaccttcgctattggcgtcggtcgtcatcacctgtgcaggcgtgctcacccggtttctccactggatccagctttattttcctttctatcaaccatcacaacctgaaactgtgggcgtccgtgtgtctcttggagtctagtagaatgtaaggccctcaaggcagaggcctcgtctgtcctgtttgtcaccagagcctggtccgcagtggtgcctagtaagttagtccacccattcaccacatccttacagagctctggcgccaggcagcaagtgctggtgctgcggacagagccacagacaagccggtcatagcttctggcctcatagaccttggagtctaacaggggagagcctttcaaagatttgctcccattgctaatgggacaggatgagacagggtgctgggggactgagagctgtgatgggggatgctgcctggagggctggggtggtctgagctctggaggaggaagtgctgctcaggtagtgagggagggggtggtatctgggttaggggaagtggcgtgtgcagaggccccgtggcgcagatgagcttgggctatttgaagaaccccagcgaggaggcagggtgttcaggtggctgtggctgtggcccaggggcaagagggagatggggaggagtggaactggttaagaagtggacagaagtagggtgagaaggcaaagtccaggatctgagacaggaggatggtggccttcctgcctcccttccttcctgccttccctggaaaggagcacgcctggggtgtggtgagtcctgttagagatgctcacggaaccccctctccccaccccgccccgtggcaggggcatggagaggcgggccctgtgcttagggggtcctgggttagggacggcgctggaagttgcaggagggcagaaaccggcctctgaagagagtggggagggagaaggggagctgtccagggccctcaggcatgcatcatgtaagggtcaggggagtcagggaggatcccccaaaggaggctgtagagggtgaaggaggagggcaggaagccagtgagtgtgggggtctgtgggccatggggggtgggggaggcagctctttgggaactgagggggttcgggtgcagccctgggactcccaggccagtgctctccctccccctgccagccacctcgcagagagagcccggggtggaagcagggtagttggtgctgtgccctgaccttcagaggtggcattgacaagaccagaatgccacagggccatgcacctctccctgcaaactgccctttaatttatttttacctctgttccttgtgggcttgtgtgtcaggttcgatatttttatgttactgggaaaatagaatgtgcttcacagaaatttgccttgtggccaatattgcaggttgcagctgtttcagagtgacaggggacggtatattctggacttgtgcccttttgttcatctctgagaggggccataaactcccatttccgagaggttactgggaccaatgagatcatttattagttttccttgcacaggaaaatcacacactctgtgccattgattgagtccattttattttgtggaatagacatgtcagaagcaggattggccaggtggaattgtgtttggcgggagtcctgtctttccataggtactttcataatggaagcaatctccttctgaagtgtatcacccggtgaactgaatggaaaatctcttgtgaaaaggcttaagaggaaggctggcctggaaaaatgaaactcacatccacagagagacttgtacctgaatgttcatgtcagcaccactcacaatacctaaaaaggggtgataaccgaaataaccatcaaccaagggatggagaaacaaaatgtggtcccccatgagatggaatatgattcagcgtaggcacgaaagaaggacggaaacatgctataacatggatgaaccttgaaaacatgctcagtgaaagaagccacacatgaaagggcagacatcatcggctcctattaatatgaaatgtccagaaagccaaatccgtggagaggggaagtagatcgaatcacacacttttaaaggatgaattgtgtggagtgagaattctatctcaataagggtgcatacaaaatgcagctgacggtggtcacaccaagcctgtcagtaatgatgcataacttccctttgctgtcctgggttagggtgggttgagacttagggtgaccagggaggaatggatatcttgtgggtcaccttgactgtcttggggtgatgagagggcagtattaccaatgcttaatcatttgcccccataccaaggtgaacacgagatgctctggtcctagtggctgcagagttgtgcagcctctgtccctgtgctagctctggacctggtggtggccgcagagctgtgtagcctctgtctctgtgcttgctctggtcctggtggccacagagctgtacagcctctgtccctccgcttgctctggttctggcggctgcagtgctgtgcagcccctgtctctgtgcttgccctgtccttgtggtggctgcagagctgtgcagcctggccccagagctgtgcagcctctgtccctgtacttgctgtggtcccggtggtggctgcagagctgtgcagtctctgtttctgcactttccctggtcactgcctcattgccgtggcgctggtggactgaggccataatgcctgcgtctcctgcaggtcctcctcgactggattaatgacgtgctggtggaggagaggatcattgtgaagcagctggaggaagacctgtatgacggccaggtgctgcagaagctcttgggtgagttcacagcagggacagctctgtcccacccccatctccctgcagcggccctgggctgggccaggattctctgcatagtgacatcggccacaggtcctaggaagacactcaaagctgcagtgtgcatctcccaggtggtgcccaggccctgggctgtggcttcagggtcctctctccccttgccgtttctacagagcacccagccatggggcagcagcaggttggggacagcttccaaaactgcctgcggctcccatcctgttgggtctcaggcccactttgtgtccctgccaccctcttttgacttgaactccttcggttcaggatgggaggcagcaggagggaagcgggtctgcagcaatattctgtgagtgaatgtgtcaccaaatacatgatagctcatgttccctcaccaggggcgggctctagtgtctgcatttgctgggtgaaggcagtttagtgatcttcccgggactgactgatgcatggtttgatgtgcagacaaaccggttgtttattcatcagatgttggatgagtcccgagggctgggtaccagggatacggtgatctttgaaacagacgtggtccctgtcctcagaacttacagtctgtctgaaaagacaaatatttttgaatggttacagttactgttcagattgcttgtgatgagggccttcggagatgccgcaggttctgagtagaggacgccggcctggcctgggggtggggcggccttgcagctcatatggaagaacgagcgaagagttgccaggcaaagaacggaagagcagagttcgcagatgatgcatgagaggaattcttggacttgtagtgggttctcacgatgcctggcactgtcatgtctcattgtcacaatggtcctagggggcagtactgccatcgccttcgacaggtggggacgttggggcccacagtctcctggtgaacagccgggcagcctggccccaagcatagctcttgagcccggccgcggggcctttctctgacctgtctacggagcagccccaggtacagggcctgggtcaggcgctcctgcatgatcacagctggttctcacaacagccctgggggtctggctgaatgagcagatgtccctggttgtccccacgatgccttttgtttggatccaggagtgaatcacacatgaacgtttgtctcttcttttaggcttctttcatctggaaccgccttccctttccctctctccgttctgttctgtctttctgtcttttatgacgttttggaagggtctgggcctcttgtcttgtagaatatcctcccatcgggatctgtctgtctcctcacgatgagatctgggtcacatgtttctgctgagagtgtgactgcgctgcctgcttgtcctcctgggggcatcgtatcaggaggagcacacaatgtcaggctgcctgtcattggtggtgctgacagtttgatcactgggttaaggcagtggcctatgggtttctccattgtaaaggtgcttctttcctgttaaaaaaaccacttttttatttgttctattttggtagagtcaggatctcactcagttgcccaggctggagtgtagtggggtgaacatagctcactgcaccctcaaactcctgggctccagtgatcctcacaccttggcctctagagtagctaggactacagatgtgtaccaccacacttggctgttttttttttttctttttttgaaatggagtcttgctctgtcacccaggctggagtgcagtggtgcgatctcagctcactgcaacctccgactccctagttcaagtgattctcctgccttagcctcctgagtagctggggttacaggcacataccaccatgcccaggtaatttttgttttttagtagagatggagtttcaccatgttggccaggatggtcttgatctcctgacctcatgatccacccacctcagcctcccaaagtgctgggattacaggtgtgagccactgtgcctgactggctaattgttttgtattaaatttttaaatttcatttttttgtgttagagacagggtccttgctttgttgcccaggcctgttttgtactggcctgaagcaattctctcatgttggcctcccaaagtgttgggactacaggtgtgagctaccatgctcagcccttctttcctttttaatacatggtctctagaggggcagactctgggactttgtgaacgtcctgttcacccatgatgcgctccccatgattttatcatccgctgattatcattctctaaattatgctaaatatcatctctaaatattatgctggaggttgcaaaatagtgatttctgtatctttatcatggcttccccacttattagctggcattttcttctgtaaataagtgcttttcttctcctgtgtccttttttaaaaaaaaaaaatcccctaaaatagaataacacattcccctggactgatgaattattttatgttcaaaagagaatggtaattagatagcaaaatctgggccttatgggtgcttgtggctcctggggtgtcattgcttctagtctctttaagccaaaagaggtagcaaatatatagttttttaaaaattgtgagttcacactgctacttctaattccagttcaatgctacaagtttatcccttaactgtcagcattcagtattccagtctccagggagaaccttggttccagaaatatatttgctatttactctgattgcatacaaaaatagtgtcagaattacaataccaatacctctatcaactacaaacatgctaggtacaagatttctttgccattattttttaagtacaatatatccactaagagtatatagtcagaattctgtgttcagaacttaactgaattattttctttttgagtggtcatgtcatccatttaatgtataaataaattaatttgtttctctctgtatttagtttttgtgtatatgtttacatttaattttatttaatattacttttaaaaatgtaaagcatttacatgcttcaaaagtcaaaactatggaaatgacataccttgaaaggtcttagccaggtgtggtggctcagcctatcatcccagcaccttgaggggctgagccaggaggatcacttgagccgaagagtttgagaccagcctgggcaacatagtgggacctcgtctctacaaattaccagtcgtggtgatgtgcaccgtgcacctgtattcccagctgctcaggaggctgaggcaggaggatcacttgagcctaggaagttgaggctgcagtgagccatgattgtaccactacattccagcctaggcaacagagtgagaccctgtcgatcaagagagagagagagagagagagagagagagacagagagacagagagagagagagagagagagagacacagagacagagagagagagagagagagagagagagagagagagagagagagagaggtctcactgctttctctcccacgtatacactcccaggtaacaattttcaatggattctgattttatccttcttatgtttctttacaaaaatgtccatatacacacctactcatttcccttttattccttgcataaaaggtgatgtattttgtacattcttttacacaccctgcttgtttcgcttaatatgttctaggaatccttgcatgtggagatcacctttctttttctttatggctgcattgtactccactgtgtggatgttccttcgtttattcacccagtctcctatgtggggcatttttgtcatttctaatatttttctatcaccagtaatattgtgggaatatcctcgtgcagatgttacagaaactagaattgttgacctcaagtgtaatgggttgcttccttgagctgaccactgtagaggaaggaattctcaaattctgagaggcttcacctctctcacctctggccttcccaggtctgttgtgccttggttgatctttcctgtagccactttctgtcttccctggactgttcagtgtgcagacatgatgtaatatttccattaaaaaatggctcccttgctcctgcaacactccaatttctctgcatcactcaaatgtattgaccattagatttggcaccggatgggtcattggtggcccagatgagagcagttttggcgcagtggtgggggtaacacgctgatcggggagggtccaggggcagagaactgtgcctttgaggtacataattttgagagggagagagaggaagggagtgaacctgtggttgctgcagctgcttttcttttcaagacagggtctcactccattggctggcctggagtgtgggggtacaatcatggctcactgcagcttccacttcctgggctcaggtgattctcccaccttagccgcccgagtagctgagagtacaggtgcatgccaccatgcatgacttattttttgtattttttatagatacgaggctttgccatgttgcccaggctgatcttgaactcctgggctcaagcaatccacccacctcagcctcccaaagtgtggggtttacaggcatgagccactgcgcctggccaatacgaggctttgccatgttgcccaggctggtcttgaactcctgggctcaaacaatccacccacctcgggctcccaaagtgtggggtttataggcatgagccactgcgcctggccatagtagctccttttcatgtctgtccactgggaaccatgcaagctgcctgctgaaattacgtggatggagcccctggcacagtgcctggcacaggtctgtcgtcaataagcaggagttgttattgctgttgttttttaaacagacaaataaatgccaagagcagaactaaggagtatctggctcgctgctgggtaccccatccaccccaagtcccctgggtgactggcacatgacaaatatttgttgattaagtcaatgaaagaattcctgcagtttcattacctatgaagattgtggggtcctcttgtgggacatgaaagggggacagatagatgagtattgtttggatttttggtcctcagtgccatccacagactccagaagggatcagctatttgctgaacaatctttcagttctcatagagccctgatatgttttcagggtccacaaatgcctgtgacggtggcctcaagaacccagtgtccccttgtaggtgggatagcatacctcttaaaggtcagcatgagattccacccatgtcatccccagcattggtggggtcagcagatcctctctctggggtttcttttctgctcaacctccctgctttgatggactgcacagacaagccccatcttggtggaagggtctccccatgggctgtcctggagggtcactcccacagatatgccccatcctggtggaagggtctccctgggggctgtcctggagggtcagtcccacagacaagccccatcctgtgggagggtctccccgtgggccatcctggagggtcagtcccacagacaagccccatcctggtggaagggtctccccgtgggccgtcctggagggtcactcccacagacaagccccatcctggtggaagggtctccccatgggccatcctggagggtcactccctcagggcagggctggtgactggggtgggatcatgtttttctccgctgttgtgacagaggagtatctgctgcaggggatacgtggactgcggggggactgccacaaggatgtgaatgggtagggggtggggtgctgtttaggagagagagagactaggggagcccctgccagagaaacttggccctgaaaacacaggggtgcagcatctgtagctgcctctggacagagtttgcacactctgcacaaatggctcttacagaccagctcttggagggaaacctcctaggcttgtgacaggtggtggtgagggtggggggatgaggtgctggggaggccatgtcccataactcactctgaaggacacagtgatgcttggaccacattgtttgtccttattcatctggccctcagaaagtatatttggagggaaacatgtctgtgtttgttttggtcacacattcattcattcatctgatgaatgaatgttcattggcttacatgtgtcgggtggctcttggctgtagagacacagtgggaaacaagagagatgagccccgcaccctgcgcctgcccactcccccagcacacattctagcagagtgaagaaagagaagtattatggggtggagtggttcaacctgaaacctagatgatgttttaaaggaatgacaagtgctaggaggaaagtaatagaaggttatggggtacagtggtgggtgggggttggggaaggcaatccagggaagctcctctggggaggcgacatctgagcacatgtctgcacagtgagcttgggaagggcgttctgggctgaggctctaaagcgagaaagagcctgttgtgttggaggagcagtgaaaagaagcggaggcggggcccaggtggcagagagggagggagagagccaagagatgaggctggggccagatctcattcagccctgctagacaacagtctattccaagtgacaggaagccattggaggttttgggtagggctgtgacgtggattgggttagagtttaaaaggtcacttaggcttctgggtgcaggatggatggggaggagagtcaggagttggaactgagagatcagtcaggacaccattgccatggcccaggcatctgatgaagtagctcagcccccagagtggaagggcagacatggggaggtactgtacagttaaactgccataggaaccaagactgatggccaggtttgtggcttgagcaactggtaaatgggaagccgttgggagtagggtgggaggttgggaaggcgggggtctgtgttgtacatgctggggctgagatacctgcccttttggaggtgatgctgagcaggtgagcctggagtccaggctgcagtgtacgtgtgaacccagcagcactgagctgatgtttagcaccgtgggactgcacggcttcacccaaagagggtgttccaaattttatttggctgaatgccgaatgcccaagaattaacatctatatttggctaaggtgagaatccccatcttagaatgagatcccatggtacaagaataagtctgaaatgttcatcaagattgtgtcataattatcacaattttattattaaaaacgttagtggccaaagttttgatgttttgcattgcagtatcagtacagtcacacccagcactgttgggtaccacttgctcttgaggtcttcaaaccagacatttgtgatgctagatgctcactttcaactcagaaggctggaggagcacgtggacctttggctgatgctgtctgaagggatactcctcatgtgaagctgcccctgggctgtcagtttttctctctctgagtggctggttatggtagagacttacctcctctttgatcttggatgtgaagattgggctgttgctggtgatggccctctgttgaagcagtccccccaattggtactttgctccctacctgaagcagatattttctaatattttcagaagcaaacttgagtgttttgttcactttcattttttatttctgattcttttgcctgcacctgtggcttctcccacccaatgacttgaaacagtatgtcagcaagccttgtatctggcagcctggctgtggaactggccctcagaatctcaggacaggctctgaatttgcatctgcatctcagccgtggttgcctgtaaaccatgccagtgccttctatagagcagaattacaggggcatctttaaagctgcatcttcccctctcaaggcacatccttttggttccctcttcagttagtgctagcaaatgcagcacttactccggagttgctgtgattgtccatgagtcctgctatatcagttgtgttatccataaagtataacatgaggcttcctttggctcaagcagcctttttcttgtggagtagctgctgttccatcttgtttgaataatcacataagcacttgagaaggcaattctaaaatctcttgagtgtcaagtggtttgacatattaaaaccactttttttttttgtactgaaaaaaagaacagtggactagaatattcagatagtaacacagcatcagaatgtcttgcctcattttgtgaatgttgttacactgaaatgacataatatactgttgatgtgagatcctcttgatgtgatactactgatgtgatcacctgatccttgagctccaggatgccaggaatgacactgatgtaggcattcagctctttggctttccaaaggcagaagcccaaaccaaataggagattttagctgaataccaaggtcaaagccaacttctgtgcatccgtagtagagaagaggtctgaggactgggtctgggctgtcagccattagtggtcaggaagaggaagttctggcaaaggtcagtcacaagggagggggagccagaggagtgttgcattcaggaagggtaaaggaggtgtttctaggaggtgagaggaggaaagagaacagacttctggtttggccatgtggaaattgcccagagtgaaccagcaggacccctgaggagtccctcttctttttttttttttctcttgagatagtgtctcactctgttgcccaggctggagtgcagtggcgtgatcacagctcactgcagccttgacccctaggcttggatgatcttcccacctcagcttccccgggaagctgggatcacagatgcataccaccatgcccagataatttttgtattttctgtagtgctgaggttttgccatgttgcccaggctagtcttgaactgggctcaaacgatcctcccaccttggcctcccaaagtgcagggatcacagggatgagccactacacccagccgaatccctcttcttgagagaagattctggaagcagctgccgggttctctgccacatgccaggtttctgggggtgtagctcccctgtgtttgcagtgcagccctcaaggtagactgcatatggccagagtgaggtgcccgtgctgtgggagctcctggctgtcgtcctgctggtcactcacgggcacaccctctccttgtgaaggtgaagttcttcatcacatgtgtactcaacccccatgtggccatcactcagggtcacctgctacatgggagaatcctccccagttttctctctttctgtgctaggaagataggggtcctggccacaacagagccctgagctgctcctgcggcccccgccagtgggcacagtgatgtctgatgatgcaagtgatcatgtgccgtattctctgttgcacaggagtcacccaagacccagcctaaggcagcacacaggcatggccagtctctttggtctctgttgcctgctgtttccaccaccaaattcatattttcaagtcctacatgcagggcccacccatgtgacctcattttaccttaactgcctctttaaatacaggcacattgcaaggtatgagagcctcgcccactaggagagatgggtagcctggcagcctcccactgtccctgctaccagccagccctgcaggttgaacctcggaatgtgactgtatttatagagataataataggctgggtgtgatggctcacacctgtaatcccagcacttccggaggctgaggtgggcagatcacttgaggtcaggaattcgagaccagcctgatcaacatggtgaaaccctgcctctactaaaaatacaaaaattacctgggcgtggtggcacatgcctgtaatcccagctactcgggaggctgaggcaggaggatcgcttgaacctgggaggcagaggttgcagtgagctgagatggtgccattgcactccagcctgggtgacgagagtgaaactccatctcaaaaaaataaaaaaattaaaagaggtaatgaaagtaaaatgaggccatacgagtgggtgggccctaattcaatatgtctagggttcctataaaaagaggagattaggacacagacatgcacagagggagaccaagtaaggacacaggaaggagagggcagccatctacaagccaggagaggggcctcagaagggtctaccctgccggtgccttgatcttggacttctggcctccagagctgtgacataaatctccgttgtttaagccgcacggtgtgtggcatgcttcgttgcagcagcccagacaaacgaatccagtgtcctccgctcctctgccgactcctcttcctccaccctgggtgacgtggccatgttcagtctgcggggccggatggtggcaggtgcaacgggggcgcgtcaggcttcccatctccctggtgggcgaggctctcagaccacccagttctgtatgatcctatctctctccttccttctccaagctgccctgctctgccctttccatggttgttgaacacctgtgggacctacttgctctctacttccagggcgcaaattcagacagacagctgtggatgactcagcgaggagctgttagatccagatggagggaaatcagatgaataagcgggaatcgtttccactcccctgcaggatgtgttttgttgggctgctttgttttttctcttgcagtcattgccacccaatcagatgttttttacgggtgtttatctccccactagggacctctgttatctgtgccatatccagcacctaggacagtgcctgtcccatagtaggtgttcagtccctatctgtgagccaacaaacgcatgatcgaaggggtattccgagcccagcaggccttgctctagaattttattatcttgaaagggatgccaaagctgtttgttttctaattgagggaggggaggctgctggggagataacactgaagacatgggggcctccagctaaaatgttttaaacagaactttgtgctgggaaccacttgcaaaacagaaaccccatttgtgactggcctggacttgattgctttcatgatggcatgtcaatgccgcgtcactgacagcagctgtgtattgaaggctctgtgctgagtgcttgcagtcaccctcccagtgaaccatctcacgatgctctgtgacgtcgcttttgttgttttgcagagtggatctatcagtaaacactggagtcttagaatcgaagactagcagggaaactgggggtccttcctgctgtgtggccctgcagcgggcgtggggtggggcgctggtggccggcacctgccagtacctactgctaacaaaagggaaattgaaggaggtgcaggctgggctggagctcagtctcagtaattgaatcttgatgaaatgtgacagttcttgtctgtgctcctccggattgtttcctgttcattcttggtaataaaatcatcgccagttctgtgaatatctaatctaacttcctattgtggcattagaatgtttaagaaacaagaatgggagcctcaggtgtgtggggaggcagaggcagcttttaagaccttttttaaaattatctttatcagtcctctcccttttgggacccacagggacagtcttctcacctcctgactcccactttcattcttcccaggtaacctccttgcctctcaactacatcttattatgttttttccattttgtatgcatagaatgttcccgagtataacacccacagttttatccttaactattcttcccttttcaatctggcgtcattctctaaggaagattagtgacctggaagctcagcgttcatggttcaacatctcaagacgcccccatggccacatggtaacctgccccgcttcggggacctccttgaggctggggtcttggtggttttgagttcctccagtatatctctctccccttcctccctccctccctccctccctccctccctctctctctctctttttttctttcttctctctctctctccttccttccttccttcctttttctttctttctctctctctctctctctctttctgaggcagggtctcactcaggttgcccaggcttgggtgcaatggcatgatcttggcttactgcaacctccacctcccgggttcaagcacttctcctgcctcagcctcccgagtagctgggattacatgtgtgcgccaccacgcctggctaatttttatatttttagtagagacgggatttcaccatatttgccaggctggtctcgaactcctggcctgaagtgattcacccacctcggcctctcaaactgctgggattacaggcatgagccactgcgcctggcccttccagctttttctgaccctcttctcttgtgcttctcattgcagaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactgtgagttccacgccacagggggagggactgtctggagggagcccgtcctctcgacattcgtcatccacatttgtcatccacattcatcatcatcccatctggccttgcatcttaaaattgggttcatctccctgctctgtaagaggtagaacattgcaggggagaagaacaggagaagggttagggagatcctagaaaagggacctggtcaggccacaattctccatcctccccatgctgcagaggagagaggcaatgtttatggatgggtggatcagagggactttgagagagagaagcagccttggggggttcttgttgggactcaaccccaaatactggtggcagcaacacctagtgggctgtttgtctatgaccctggcattatgagatgtgacatcacggtattttcagccaagacatgaacccggcaggtgaaagactaaaccaggagaagctggaaagttctcctcggtcctgcccactccttccccacctccctcccctggaagcagggccatgagggtgtggcttcagggctctctgtgctgggccagaggtctccgtgctttggtgagctgggctctcagtggtaggcaggagaccctggagcctggccttgcacccggtttcttggtatcgagaccttgggcagacccaggctgtctcgtgggtggctgggtccgtgggtggggaatcgggtgccttgtaaactgtaaaaccctgcaggagaagtggtgatgttgaccaaacctgagtccgcatgctgaggaagagagaggacagactcaggcaaggcaggggctaatgtctaatgtccccagagtggcctctgctcttggcagcctacccttgttgggatggttcattgcggagagggagcccttttttagtgccagagataataacgcacatccttgtgatgggtaagtggccgtgacctgctttccatgctcttttcccttctgtgctaattttactatcctgttcctttccctcatcactgcccaatttattgcttttaaaaacattgtgcttctaaaagtggttgcacaagtcaccttaggccaacaggaaaggagacagtgaagctagaagtaaattcaccaggttgctcatcagctctcttgatttgtccacacttcgctccatccttgtctcgctggggtctcatttagatgctgtgtctctgttgccttctgcacgtgggctcaggttcctgtgtaacctgatctaaagcgtctcccttcctccttcctcctgcagcaattcacgggaagaacctggtggccatcctccacctgctggtctctctggccatgcacttcagggcccccatccgccttcctgagcatgtaacggtgcaggtggtggtcgtgcgggtgagtataaccgagtggtcggcctgcctgtaactccgccagagaggcaacatcttcctcctgcagttttcctgccctccccctccttttttccccccaggaggctaccttctatttttcccttttgacaaaatgtgtgtctcaccctggctccgagataaatgattggaacgggaacaatggcattgatttgatgagaggcagaagcagaggcatgagggtgttgaggtttaattttccacatttttgaaaagaacattcatttctctccaaagccaactggttggaattcaatccccttgaatgtgcttattactcattggaggaggttggccccgcgggatgaaacagacacccaaattaaagccgctttgcattcgttggggattattcatcatgccccatcatctctttttttgggttcatttctcttgattcacttggagaaatggaaccagaacccaggtccttctaacagagggtgaagtagagttacctttctcttgctatttcccttacatttattttttattttattttatgttttgtgaaagggtttcactctgttgcccaggctggagtaccatggtgcagtcatggctcactgcagcctcaacctcttgggctcaagcggtcctcccgcctcagcctcccaggtagctaggactacaggcacatgccaccgtgcctggctaatttcaaatttttgtagagacaaggtctcgctatgttgcccaagctggtctcgaagtcctgggctcaagcgatcctcccatctcagcctcccaaaatgctgtgattataggtgggagctgccatgcctggccttatttcccttacatttaagtggacagtcgctgcctagggttcgtgtgtgcagtttccctcagtaaatgtgcaatgagcgcctactattctctaagcactcagcataggctgccgagccactaaaggaggaacacatgcctggcgtctgtgggggtgaccactgcggccagagttgaggtcacgctcggaaccttggatgcctctgtgtttattttactcgagacatccggctccactttcctctggtttttaaacttctcagtcccgtggtctctgtggtcggggaggacctggctgtcactgtgttttccgaacccattctggcccctctgttaccctgggagctcagtcttgaccggacgggaatgctcctctctggcatccggcaagggccacctgccatgtgtccatgtttccttcctaaggaggatgtttgtggctggtggtggtgactcgggacctggggggccattcctatggccccgtgtcttggccactggttcacaggcagccggcctgaaaaggcttccctaggacacattgggatgtggttcccaagcctacctacgtcagctcggggccccaggagccctgtgcaggctcagaaactggagtatttcctttcaggcttgcacttgggtccaagataatctttgcggtttgcagaaagtttgaaccaggcaagcacttgctggtgcttcctgccataacgggttagaggagtgttgtttggccacgaccaaagcagaatgaaacgggagcagggggtcctgtgaaccgggcgcagttactccccagaccttagagccgccttctgtcttctctgcagccccctggcctctgagcttgctcaggggaccccttatctaaccccagatggaatggttggtgtaagggatgtggcatttccagggtggaaggaaggaaggaaagggccttatttactgcctggccacgtggctttgggctgatcacttgcttttgctgagctgcaatgcttttccccataaaaccaagattttactacaaacctgtaaaacatccagcttcatgtctacaatcctagacctgggcccagcacctggtgggtgcctcaggcatgtttgatccttgactaggtgaacacaatgtctggaccttccttggcaggcactcctgagaatcaggataaatgtcacccacactgttgttcaataacaagcaccaaccctgagtattccatggaggtcaaactcaggaaagggatggaagcccagatcttggtggtgtccactgtgggctggcccagcgggaaatgagttcccagtcccttgaggggttcagtggtggttggattagccacccaggctccatctggagctcctgtgacaggcgggctgccacccctaccatcaccactgccatgcccccctcactaccatcattacttttttttttttgagatggagtctcactgtgtcacccaggctggagtgcagtggcacaatctcagctcactgcaacctctgcctcctgggttcaactgattctcctgcctcagcctcccaagtagctgagattacaggcacatgccaccacgcccagctaatttttgtatttttagcagagaccgggtttcaccatgttggccagaatggtctcaatctcttgatctcatgatctgcctgccttggcctcccaaagtgctgggattacagctgtgagccactgtgcccggccatcattgcttttctatacctgccacgctctgggagaagtgtgacatatactgtgtcagtttcctagggcagccataacaaagtaccacaaaccaggtggcttaaaacagcagacatttattctctcgcaattatggaggccagaagtctgaaatcaagatgttgtcagggtaggatgtcctccctcatgtctcctcctctaggggaggggtcttcctgcctcctccagcttctggtggtggctgtcagtccttggtgttcttggcttgtggccacatctctccagtctctgcctctgtcatcacatggcctcctccctctgtctgtttctgtgtctgtttcctcttctaataaggaggtgagccatattggattaaggaggggctcaccataatccatgatgacctcatctgagctagtatctgcaaagacccttatttccaaatgagatcatgttctgaagtttgtggtagatatgaactttgggggaccctcttcagtcccgtgcacacacatgattgcaggggatgttccctgttatttatgttccttccaattgcatgcctcacctctcctggctgcaaagcatagaggatccctttggggaatcctgacctggggtgtttctcctgagacccacacaaatgccaactctcaaggccacgtggagaccagagggtggggaggaggatagggacaggttgtggtcgctgaaaggcaccctgcccagggtcccctgctgtgtactcacccaggcctggcatgcgtgttcaacaccacccctccttctcctgttgctcttttctaagatgatctccggccccgcagcttcgtctgccctgtcagtgcatctttcctcaactctccactgcctgattttgtatgtttattttggggttttcagaaacgggaaggcctgctgcattccagccacatctcggaggagctgaccacaactacagagtaagtggacccctgtcttgcccttccaggccctgctgccccgagtgagtgggaccccaggctgccacttcagccagggacaccagcgcccatggggctgctcccgctccacaccccttctctgtagcatgtgattctcatgctggttcccaccccagctctcctccctctgcacactttcttcagagtttttaacattagaactgagttaccttccacagactttgaattttttcattcctatcttaaaaggtgagctgtaagaacattgcaaagtggggcaggcagagagagttcaggatggttagagagaaccattgtctcagttcatttatccatctacattagccccatcagaggtgggagctacatctttaaaccagaactttcctttgacagacactactaagccatctgttatctcctagagaaagccagagggcaggtgttcagaagtctaaaaggcttcaaatctattgaaaatagcaaatcaaacagtatctgtggtatgtggttttaaggactccttgtgataacctgctaagaatctttagaattcactgcatttgtgcctcttgactaaacctgtttcagatgaaacagaacatttaaaaattgattgtctcagctaatccatcagctaagttcacagagtgattaattactgtgttgtgaattcatggatggtatttcaaaaattggagctgacacaggaaaccactcgtggcttgcaagctctcagggaagatgatgggacagtggagtgcaggctgatgcatgtgcagaggcccatgaagaggcctcccagtctgccccaggcccacgaagggaacagggagagctggaaaaggggaggatgagaatgtggttctttgcccagcacagtgggcctttggcagcagctctgcctattcagcagtaggagaagggctgctcgtggggaactgggattgggctggtgtcttagttgtttattgttgtgtaacaaatcacccccaaagtcaagtggcttaaaacaacatctgtttcatttgctgctcacaattctgtgggtcagcaatttaggctgggctcagctgggcggttgttcagccagtctcgcctggggttgctcatatgatgcagacatctgaaggctggatggaggctggggaggctgagatgggctccccctacctctggtggttggtgttggcctcccctgggtctctttcctcctcacagtgctgggcatcttcccagggtgctctcagggtcctgagagagtgagaatgcagctgcagtccccttgaggccttgtcttggacatccatacctatgtcctcaattctgtgagtcaaagtgagtcacaggtcatcctggatcaaggtgcaggaaacagactctgcctccttgtgcaggaatggcctgtgcacattgttgggtggtgggcatgctgtgataggagttcccctctaggtgagggggtcccatatgaggacagcaaggaggagctgggccccctgccataaaactagaatggtccagagacagagaatgagcaagtgggtgggagaattgtctcagctattcatcagcagtaagtggccccaaggacctgctgcatgccagcctccttgctggatcaacagagacactgagaggtgggctgagtgcagttcttttcctccagggcgacccatcctgctgatgagaaaggatgcatccacagacatgtacagtctaacacaggggcttgtgggaagtgcctcggggccctaagggaatttccaggaggaggggagcaccccaaagtcagggaaggggagatttcagtgaaagccacctcaatcagatatcagatggccctgagcagtgaggaagggagttgggattttctagcctgagtcagtgtccctctgccagccagggtcagggtaaaggagaggctgggtcacctctccaggatgatgccccaggtaggttctcctcagggctggtcatcccatccttgtctcctgttccttcccctccccgtggctgcggaggctctgacggaacatttgaatcattggatgtctgctgaaaaccagcggcccaaagatccacattcagtttcctaaggcagcattgccacctcctatccagtctcagtgttcccctttctctttcaagaggtggctatgaggtcaccccttccaggaagccctcctgtctgccaagcaggagtgcttggcttcctgttagttcccttagcctctggacacatgtggccaacattgaaatattggcttatgaggtctgtcactcccaggcatcctgagggcagggccacatagtgtttatctccaggggatgttaatttctgtatctgcacagcctgcacatagtaggtactcaagtaagtgcttgttaaataagatggagccaaaggacttgagcctagagggatttggggacaaagtaaagacttccttgcctctcaggaaggcagtgcatggaaaggatctgtgcactcactcactgggaatctttgaggagaagctgctcaccactcccgtctcccccattgcttccgctgccgcctgcctgagatcagggcctggcctcgtggttctccaggatcctttagttccacaagtcctgcaagtacattgtgtttactcctggaaacatgagtaacctgcaaccttgtgtgtgtgtttgtttgtttatttatttatttgagacagggtcttgctctgttgcccaggctggagtacagtggtgcgatcccagctcagtgcagtcttgacctcccaggctctagcgatcctcccacctcagcacctgagtagctgggactagagcgcacgccatgacacccagctaattttgtatttttcttagaggaggttttgccactttggccaggctcgtctccagccttgcatttttttattgttttgtttgtttgtttgtttgttttttgagacagagtttcactcttgttgcccaggctggagtgcaatggtgcaatctctgctcactgcaacctccacctcctgggttcaagtgattctcctgactcagcctcccaagtagctgggattacaggtgcctgccaccatgcccggctaatttttgcatttttagcagagatggggtttcgccattttggccaggctggtctcgaactcctgacctcaagtgattgacccgattctgcccctcaaagtgctgggattacaggcatgagcccctgtgcccggcccagcctgtgttttgagcgttccacggctgctggaagacctgttgtctgctgaaatcttcatattaaccactcttctgatttaagtacctcccctccaaacaacattaccagggtggttaatgtgcaaatagagatggtgatttgctgctgaccttgtgcaaacattaataattcacacaagcacctctcgtttataattagagcaggctggaacacagcaccatgtgacttgcgttcttatcagtaggcctttacctgggcagcgagggcccagctttctggctggctctgtccctcatcctccattgtgctgcttgtgaaactgtgttctgagtgacccatctcatggctctctctgtgttcttgtttgcaggatgatgatgggccggttcggtaagtaaccccagggaaagtggggagatggaggcatgttagggctcccccaggaagctcccagagagtgtacatggttatctggagggagtgggaaactagatgggtctcactgcccccatagttctggaatcctagagaaagtgcacagcccacccccacctttctgtataatgggcttgtttctcagagctgagagtggctgggttgtgctaggaggagtggggtggaaggctgggtgaccagctaggggagcaggaggggcctgggatgtaacactggctggaactgtcaggggctggagcaagagtggttgagggtaaaagggagggaggagaggcagccagcacatggagcgtcgttagctggctggaagagagtggctcagctctgtggatgtccttccatgtgtattatttcctcctggaaaccactggtttagcagacttccttagagtcaggcagccagggctcattcctggctggtggcttgtggcctgccccttcctctctctgctcctcatccgtgaaatgggagtgtaaaaggctctccccaggcaggggctgctgtgagtattgggtgagatcacaggtgagtgccctgcttggccgggggacagccctctatgtgggctggttttattagtgttggttttcagtggctcttcccaaagagagagaggtaatcactctctcttccctcatgaaagcctgagacctcatcttcatctcggtgagggatggtaacgtttcaaccctcagtaccaggataccccggccctcggcctggccagcctcagtgctttgggaagcatttcaaaagagaaacctcttgacccccagataccctgttctccagtgagcagggaggggagaacagctcttaaaaggaaaaatggaaaccagatagaagtctcccacctgcctctctagcggagctgatatctgtcttttgggggccctctgggtgggggtgccaccccctgagtcctatacaatgagggctgggccagcttggccatggggctctgtaacctcaagttattatggggaccagctaggatgccattgctgcttatctattgtattagggttctctagagggacagaagtaatacgatagatagatatatataaaggggagtttactaagggtattaactcacacgatcacaaggtcccacaatagtccttctgcaagctgaggagcagggaagccagtttgagtcccaaagctgtagaacctggagtttgatgttcgaaggcaggaagcatccagtatgggagaaagatggaggctgggagactaagccagtctagtcttttcatgttcttctgcctgctttttattttggctgtgctggcagctgattaggtggtgcccacctggattaagggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaagagaaacatcctgtatatagttgctgagggaggcgaaaccgcagtggggtcacagctcatgggaccggggtgaggcgtctccccaccctgcgtctaggtagaggcgcgttttgggggcccagtgcccccctctgtcacctcttctccatcttttcttcctggaggaggctcagaacccctttggaattgtagaggcctaaagatgaggagagggccgggcgcggtggctcatgcctttaatctcagcactttgagaggccgaggtggatggatcatgaggtcatgagatcgagaccagcctggctaacatggtgaaaccccgtcactactaaaaatacaaaaaaattagccgggcgtggtggcgggcacctgtagtcccagctactcgggaggctgatgcaggagaatcgcttgaacccaggaggtggaggttgcagtgagccgagattgcgccactgcactccagcctgagtgacagagcaagactctgtctcaaaaaaaaaaaaaaaaaaaaaaaaaaaaaaaaaaaaagatgacagtgggcccctcaagcatttttgagtctttttgttttttttgtggcgctgtcacttttgtgtttggttcgggccttgttggaggtttagggaaaagacagtctgttcagttcagttgggagcacatgggcctcaggctgtgtatagcaccctgtggcccgagggcccagaagcctggccccggagcccctgccaccccatgaatgagctttagggtctgatggctggggcagtggctccctaggtaagagccaggtgtcacatgtgaaaagtggacccagctgccactccaggggtgggaggactgtggaatcgcaagaccatgtacaagaggccgatggaattgttctcgttactttgtaggctttatgtgctgtgcttgagaaaatgcaaacaggctattagtcggtgacaggcaattagttccacccccggccttgctgcttctgctgacgcaggttccgaagtctcctggttacccagcctggcaccctcaggcacagcagggtgtctggcccggcacccgcccctgtgggggcagcagcacgccttgtcttcgcttccctgccatgccattcccctccttcagcccccgagagcaccccagggtgctccctcctccagcaaccttcacctgaatgctctccctctagattaccccatggctcactctttcagctctgccagctcttggttcaaatgtcactgatcagggaggccctctctgactccactgccccaaactggcctccactggctctcctccccacccctgccttagttctttctgtactcatgtgacacaccaagcagcactcagctcatggggatggcctggctcctcttccctgtgccagtgtttacacaacgaagcttgcacgtgtctggcagacactggtgccagcaaactttcaggggcacccacagcccctgcctttctcctttcacacatggctccttgacccagaggtgctctgtgggctggagctgacctttcctcggggtgcaccccaccccctgccaaagcagccagccctggccacagtctgcacgcagctgggggcagatgttttaggagcttctggaaggccgggcagaccctccttggctaatgtgctgggctttgccaggagtggtcttctgggcctcagtttccccacgagtaccctgagccagggagggatggggactccattctgcccactccccatcattccggggagggaggtggctccacaggtcctcgctgcctcctgacagcatcactgtcctggatgaggtgggtgaggaggcttctctccacggaaacaagtctcaggggttccagggaggttgcagcctggtctccatggcaatgggtgagctggtgcggcttctccgcgggcggcccttccccctcctgggcctgccctgggctggaggctctttctgaggcagaggggaaagaagggggatgtgccttcctcactctcttccccctcattgtaactcctagtaattccccttcacgtctctcccatttctgccaacagggcttgttccaaaacctctggctccatcccatcacccgtggctcctgactgtgccctccataactcccacgttgcaggccacagcccctgttaacccctctcacagtccacccggctcttgaacctgcgctgggctttctggcatctctctctccttgtgcctgctggtccctcggtggagcgcctttcctcctcctcttgccccagcaagcctggcttgaaccccaggactgctttgtgaagccttcctcaggtccccccagcccttggttcatgggtcccagactcaggtgtctccagggaccaggctgataatataaaagaggagagtgtctagattatgcaatgataatgtcatctgccccttcaccccagggctgggtggcagtggggagtggtggggtctggcgcaagctggagagtccacacccccatccccaggggcagcttattgctgccaggtgggagtgcaggctcactgttgccacagcctccagttcttcaagagaagccagaagttaagaacttttggacaaactttccaatttaagaactgttcgctctcgccgggtaccgtggctcacacctgtagtcccagcactttgggaggctgaggcgggtggattacttgaggtcaggagttcaagaccagccttaccaacatggcgaaaccccgtctctactaaaaatacaaaaattagccaggtgtggtggtgcatgcctgtagtcccagctattcaggaggttgaggcagaattgcttgaacccgggaggcagatgttgcagtgagctgagatcatgccactgcactccagcctgggtgacagagtgagactctgtctcaaaaagcctaaagaccaaaacaaaacaaaagaaaacaaaacaaatgaaaactgttgactcaaatcaaaacattacagcgaccaagctgagcattcctgcagattgagcttgggcagccctggcatatggtcaggtcggttggccccccgtctggcttcgtcttttctgacactaacagggttgcactatcatagtttactccctctccaggccctcccccaagtctgtgcctcttccaagagaggagtccctccttgtttatctctgtgatgtccccagagcctgcggaggctctgggggacaggacgagcgggagctgtaaggactgaggaccgacaatgctcctgccaggctccatgctcctgcctctactcactgccccacttagttccacaccaagagcgaggcaggggctgtgagaatgctgcctttatggaggaagaaagggggtcggagagggaaggatttgcccagtcatggggtgtgaagtggggcagctagaacaaaataggatctattttcgttcccaaggccaagcacatcacaggggtgcagtatgctctctctgtctctctctctcccctaggtcagggtggtccctggggaggcccctgggttaccccaagacaggtgggaggagcttcctacccgaccctcttcctgtcaacctgggctctgcggctcccagggctgctccttgtattggggccccagcctggctggtaacagagggtccctccactgggctcagtcttctgagcatgctctgcccccaggaacctggaggatggaagttgggggccctgggtcccttccaaatgcccttgggtcctgtgcctggtccccagtgcccattttcagagcccctggcccctccctgccttgtggactgtgtgacgtgatgccagtcccctgggtccaggggcatggcagccggcggagaggcctctgcggccccgatgtctccttgagtggcttgactctgccagcccagcggtggcccagctaaatataccctggctgacgtcaagcactcttctgctcctggggtttttcttaagctgcatttatagtttgcgtattgctttgtaaagatgtaaaaatttcactttttttttttgttttgccccttagcagactgtcttattgagtgtagtcttagatgattatgaaaatcatttacagctgccgcattaggaagctggcgtgtgtgcagaggcagggcattttggtcaatgttggtctttaggtgaagaaaacttccctcccttcccccagtcacgcacatgctcacacacgcacacatgcgctcacacaggcacacacacgctcacacgtgctcacacatgcacacacgtgctcacacgtgtacacacgctcacaccgcacacacgcacacccgtgctcacacgcacacatgctcacacatggacacacgctcacacacgcgctcacacgtacacacgctcacagcacacacacatgttcacacacaacctcacacgcacacacgtgctcacacacgcacacatgtgctcacgtgcacacaggtgctcacacacacacatgcacacacgtgctcgcacacgcacacatgctcacacacgcaaacacgtgcccacaatgcacacacatgctcacacgcgcacacacacgtacacatacactttccttctctcctttcctctttgtttctcaccacctccacaaggccacggaaggggctacttgggctgggctgggcaggggggtgtgagctgcctcctggggcccagcctgggaggaagggtcagcatgcttcctctgggaggaggcttggccaacttctctccgtaggtctctggcttacctgggcctaatcccttctttctttttctgggctctctttgtctctctcctaggccagggcggtccctgaggaggctcccctaggccacccactagacgggtgggaggagcttcctaccccactctctccctgtcaagctgggctccgcagctcccagggctgctccttgggttggggccccagcctggctggtaaaagagggtctctctgctgggcttggtcctctgaacatgctctgcctccaggaacctggaggatggaagttggggggccctgggccccttccaaatgccctcctccctgtcttttctgccctggcagtgatgccccacagctctgtgtctacctggagacctcagccctctgcttggggtccaagtctctgttccatatgcccctatggaactcccccctccatggcagcaggagcaaaggctctgaggcaagtgtgcaccagtgtcagcaggagcagctgggaggccggttggtggagtgaagtcagggagggtgcatgtaggaggataacgctgagtctgagtgtcccatggcacgtgggagagaggatggattttatctgagtgtcccatggctcgcaggagagaagatagattttattctaagcatgataagaagcagttggagggttttagttgtggtgggagtggaggggggaaacaaatgatcctgtttgcacttggaagggctcactctgcctgctggggagaagggctcaggggccaggagtggagtaggaggctgcagctgctcccaggcgaggggcagtgaggcgtgagcaggacatggccaccgtcgcgggggaagtggttggattcacaggtgacatttgccagtagacaaggagtgtgggaacagggagaattcaggacgcctcaagtcctaggacgtggcaggtgcagatgccagatgccatctatgtgtttcatatgagaaggtaaaaagcaggtggaagggaccctctgcagcctctagtccacgctgttctggttgttcccaagcgctcttgctcgccttggtttggccgggactgatcatcagggtcagccctttcattctggtaggaattggaaggattctaggcaggtgtgggagttgaggctgaacctcctgagggatcagaagctggcagggccctggattagggcagcaccacgggtttccataaacgctccttcgtgtctctctttgcatgtcctcagagcgggatgccttcgacacgctgttcgaccacgccccggataagctcagcgtggtgaagaaggtgagctattggtgggatgttggatgtgctctcccctggctcgcggctttttgacagcacaaacgccccgctgggaagaaggtgggaaaatgtttggaatctcagaaatgtttgccacatggattgaaatgtaattacagtcaaaaacctaaccacagtgcataaaatcagcgccttttaactcaacctcgctgctccctgggtgtcttcctgcccgcccgctccgcttctgttaagtgaattacccagcccccatttctttctgactcgagaccttttttcaatgtggaaatgtttttaagcatgtcagcctgctgctctcgctggcctcatttaccatctacagcctgcccagtaaacacgcaggcctgtgcggctgagctgtgccatacatggatttggcccgtttccctccagacagagaatgggccctcactagcccaggcagcctgctggtcaatctgtggatggaaaaatctccgaggctctggagttgggggctgggtgtgatcagcttctgggggatctgccagggaggcttgttcccgtcaaaaggaactggagcccactggctgctcattaacttatccgagtgcctgcaggcatcccattcaggaggctgctgcatccctccttcccataacatcggaggagcgctcatttcaacccatggtgcaggcaagagagttctcctttgtctaggacagcttacccaaacagctttcttagtgcaagacttgtcagaacctttaataggctgacctatactgtacttctccaagagggagcttggtaggaagcatttttcaaacttgtttgtttatagtgggatttatttatctatcaattttggggtaagacgcattgtattttagtggaacccacttttggaaaatgttggcctgggtttggacgatgagatcattcatttttggaagcattttgcaaaaggctgttggaaccgtgctaatggtccttctgggacaaagccttcctagcactcttgggtggtgagggatatacttggagcatcagagtcccccacctccacctcgtcacatgtggcccccagggaccctgacagaaccggttcagggaatgaatcaaatccagcttccccacttatcagctgtgtgacttctggcgaagggcgagattataccccccagcctcagtttccccatctgtcaagtggggacagagatgttacccacctctcagggcactgtgaggataaactgggattctctctgtgcatgggcttagccggcagcgtatagtcactggtagcattgagaatggtgtggcctgagattgctttcatctctcggtagataccatgttaattcattctgcgaaagacacattttcggcactggagccaccagcaaggaagaagacagaatcctttgatttgcctggtagcttcccactccagcctgtcccttcctcacctccacattgcaagtttaggtgtctgtagctctctgtgccccagaatgaagtcaggggcccctgcccacctctgcaggtttctccctgggtcgtcccctcctactccttcccatcccacccacatccagccacagcctgaagaccccaaagggtttgcagatgtgtctgggtgcccactcggctcactctcaccttgcactggcccaccctcaggcccagctccaatgctccctctccatggtcttaacgggggtccgcacacccattaatggctcatgaaatctcccttgcattgcgtgtttccctgtagtgccctatctcttgacttctccgtcccaccactacacgcatatggagaattacatcacaggccctttggcgggggccaggggtggagctctctgtgtttgtgtccttagcaccaagcagcatgcctggcacatagtagctgctcagtaaatttgagcagaatgggtaagaaatcatatcatgggcaggctgggcgcggtggctcacgcctgtaatcctagcactttggaaggccgaggtgggtggatcacaaggtcaggagatcgagaccatcctggctaacatggcaaaaacccgtctctactaaaaaatacaaaaaaattaggtgggcatggtggtgggcacccttagtcccagctactcgggaggctgaggcaggagaatggcgtgaacccgggaggtggagcttgcagtgagccgagattgcgccactgcactccagcctgggcaacagagcgagactccatctcaaaacaaaacgaaacaaaacaaaacaaaacaaaacaaaacaaagaaatcatgtcatgggcagtggtggatgatattgagtttctatcaaagttggctttggtcactgaggaattacaggtgacaggttttaagcttgtgccggagagaagccagtgccccttggtacttacataatagggctcagagagatcaccctgggtggatctccccatgtattgcaaatcgataggcaggctgggcgctgtggctcacacctgtaatttcagcactttgggaggccaaagtgggtggatcacctgaggtctggagttcgagaccagcctgatcagcatggggaaactccatttctactaaaaatacaaaattagccgggcttggtgacgggtgcttgtaatcccaactactcgggaggctgaggcaggagaatcgcttgaacctgggaggtggaggttgcagtgagctgggatcatgccattgcactctagccggggcaccaaaagctcggatgatcctcagtggtctggggtgcaggcttcaaacctgtagctgtctagtgacagagtggttcaattccacctttgtaggcccggcgcagtggctcacgcctataatcccagcactttgggaggccaaggcgggtggatcacgaggtcaggagatcgagaccatcctggctaacacagtgaaaccccatctctactaaaaatacaaaaaaattagctgggcgtggtggcaggcgcctgtagtcccagctactcgggaggctgaggcaggagaatgatgtgaacccggtgaacccgggaggcggagcttgcaatgagccgagatcacgccactgcactccagcctgggcgacagagtgagactgtctcaaaaaaaaaaaaaaaaaaaaaaaaaaaattcagtaggtgtggctcaaggcagcactttcctcagtcttctgagtatgccgtttattgttccaggtcacacctaagatacatttgcaaatgtaatgatcctcccctggcagtttcatctttcttaagagcacagggtgctctccagtatgattgttaaatatgtcatgcgtgcacggattggcatatgtgtgcatgggttggtgagcagagacgtgtagccaggatagatgtgggcattatgccatgaaaactaggggctactgtcaggatattgagtttgaaacatgggctttttattttagcaaacaggagatgatgaaagcgtttcacagagctggggctggcaaatgtcaagcctgcccctccagatgggacctgcatgcgggccattcatggctcctgtgtctcttttattcttggcagtctctcatcacttttgtgaacaagcacctgaacaagctgaatttggaggtgacggaactggagacccaggtatgtgctgctttggcttgaaggatcctttgtccaccgccattttcagtcagtgttttgatcccaggtggggcgcgtgaacaaagctggcgccattttgttcatctcacaaggaactcccgtggtgcaggcagaaataaccaccgtggccttctcagcccctctgtcttcctttcctggggctgctgccacaaagcaccacaaacctagtggctgaaacaacagacctttgtgtcctcgaagtgctggaggcctgaagtccaaaatcaagatggggcctgggtgggttccctccaaggctgtgagggaggagctgttcctggcctccctcccagcttctgtggttttgccaggatctttagcattccttggcttgtacacacatcactcccttctttgccttcatcttcatgtggtgtcgtccttgtgtgtgtgtctctgtgtccaaatgtcccccttttatcaggacgtggtcatgttggattagagcccacccatggcttcatcccaacctgactgcatctatgtaaaccctgtttccagatacggtcacattcagaggtcctggtgattagggttccactgtatcctttttctttctttttttttttttttaaagacagagtctcgctctgtcacccaggctggagtgcagtggtgtgatctcggctcactgcaacctccacctcccgggttccaaccattctcctgcctcagcctcccgagtagctgggactacaggtacatcccaccatgcccagctaatttttgtatttttagtaaagacggggtttcaccgtgttggccaggatggtctcgatctcctggcctcatgatctgcctgcctcagcctcccaaccactgtatctttttttgggagacacaaaaccccaaaacacctgagtggtgttattcaacccataacacactccagggctccaccccagcccaacacagggcctttgcacacgcagttcctctgtctagaacgtgctggccccttcagcctctgctcagtgctgctgtcacactgtggccaggacctagcaaatgtccccctggtaggtatgtacaacacatttcttctgcaataagtatatcaagtctacttccccagccccgacccctactcaaagctaaaggagcatccttaaattatatttttgggcactccgagagcattaaagacaaaatatgattttcccaggattagcagggtgcttgaatgcggaggtttttgagctcttggtacagacatccctaatgcacagctgatccttcttaaaccccaaggtgaatgcattcattcccttctctttctttaactttcctcatttgcttttctaattaaaaaactaattcaggttcattgtagaaatgtctgaaaatgcagataagcaaaacaaataaaaatcacccataatcccgtcacccggagatgaatgcacagagggttttgttcaggccttttctctacacatatagcgagtcatggacagtgtgggtctgtatataaaagcatcacggtctgtttttaatgtatatatttatttgtgtatcgttggccaacacatttcttattttccgcagtttacaaatgttgcacatttagcctcagattattttctgtttgagacgttagcaccccagaagccactgaggtgaaaagtaaaaatcttcctttctctttttctggagacctcccccttcagactctccaggggcagctaactgcagttcatggttggatgtgtatttttctagatattttctttttctttctttctttttttttgagacagagtctcattctgtcccccaggctggagtgcagtgacacaatctcagctcactgcaacctccacctcctgggttcaagcaattctcctccctcagcctcctgagtagctgggactacaggtgcgcctcaccatgcctggctaatttttttgtatttttagtagagatggggtttcaccatgttggtcaggctggtctcgaactcctgaccttgtgatccacctgcctcagcctcccaaagtgttgggattacaggtgtgagccacattttctatgcacaaaggtatttttctaaataacagtggatcttaccgcccactgttttgtaatgtgttttgtgtcactaaatacactgtgggcatcttttggtgtaagagaaagtgtgtgtgtgtgtttctatctgatcctttttcccttgctcgatctatcggtctgtctatattttgtcacttttaatgggaagtgtatctcatcagcgggaaggctgcactgcacctcattaaaccagtgcctcacgactggatgtttttctgctcctgtaaacagcagtgcagagagcagctttgtgcacggctgtctgtgctcgtgcctgcttcctcggaataaaagcctagaagtggagtcattagagcgaagcctgcaccgcacactttgaaggctcaggaagatttgctgtgtgggggcccctggtactgtcatggggcgtgtgaggggcactgctcccccacatccataccagctgtccccacagcccttctcagaggtgtctgcacatcagtattagcagctgagcctcttacattgagactctaaaattaaatttgcatttgtttttatttactcaatatcttcatttttttccccccgattaatcgtactatatagagtcttaaaagtacatttaaccactggtcccccagaaaaggtcgctggttacagaaatgcagggatttttgttttgttttgttgcaaaggaatttgggtatttttataaataccatatatcatttatgaagactgtaaatcattaacgtcttgatgccctaggagtcggagaggccctggtttaatttcttcaatttctatttgtgtgtgggtgagtgtggtttatgtagtctggtatgtgtggtttatgcagtctgttgggggtgtgtgtgtgtgtgtggtttatgtagtctggtgggtgtgtgtgtgtgtgtgtgtgtggtttatgtagtctggtgtgtgtgtgtgtggtttatgtagtctggtgtgtgtgtgtggtttatgtagtctgtgtggtgtgtgtgtgtatttgtggtttacgtagtctgtgtggtgtgtggtgtgtgtggttttcgttgtctgtgtggtgtgtgtgtgtggttaagtagtctgtgtggtgtgtgtgtggtttatgcagtctgtgtggtgtgtgtgtggtttatgtagtctgtgtggtgtgatgtgtgtgtgtagtttttgtagtctgtgtggtgtgtgttgtgtgtgtggtttatgcagtctgtggtgggggtgtgtgtgtgtggtttttgtagtctgtgtagtgtgtggtgtgtgtgtggtttatgcagtctgtgtggtgtgatgtgtgtgtgtgtgtgtggtttttgtagtctgtgtggtgtgtgtgtggtttttgtagtctgtgtggtgtgtgtgtgtggtttttgtagtctgtgtggtgtgtgtgtgtgtgtgtgtgtggtttttgtagtctgtgtggtgtgtgtgtggtgtaggtgtgtgttttccctccttttccaaaccattcttacattgcggacagcgtcccagctctgtgatggtgagtgaactcctcagcctccctgagcttctgtccacagaattaaactggaggcgatgggcagtgtgaggactgggtgagatggcgcactgagatcaagtgggcagggctcggcaggggttagcactgcggatgaggaggcggtggtggggcctctgggcctccgtggggattctgctccctgctgagctagacagcaggttgtggagagagggcaccacgctgggtgcttgtgaaagtggagggtcacccgctcgcagctgggccccccagccctgccctctccttgtggccgtccctccctccttcctgtgagcccgtgtgctgggacagtgaggagacaccacggaaggaagaaaagactcagcaggctcagggcctgcgggagcagcggcgtggccaccccagacctcctggggagaggtgtgggttggtgccttcattcacgtggcagcttccattccctggaagttagtccatggagacgtgggcatggcagctcaatgttgttctgctgggaaggtgccagcacgcttaaccagggtgctgtgggcatgaagcttccatgtggagacacacttaaaagaattcttcaaacccgtctgatctccttaatgataggagtggctggctgctttgtggtgtggaaggctgagggcatgtgacatggaggccaagtgccatttgcccatcaactgacagcgtgttgaatttccaggcgcagtggctcatgcctgcaatcctagcactttgggtggccgaggtgggtggatcatgaggtcaggagttcaagaccagcctgaccaacatggtgaaaccccatctctactaaaaatacaaaaattggcgggtatggtggcacgcgcctgtaatcccagctactcaggaggcggaggcagaagaattgcttgaacccaggaggcagaggttgctgtgagccgaggttgcagtgagccgagatcgcaccactgcactccagcagggcccagaccctgtcctgagtcccttaagggactgttgcccactggcactagctttatgctttacagctctagctgcagctctccctgctaaaggtcagggcttctgatattggatgtttgtgattttgacttttcatctttttttttttttttttttgagacagtttcactcctgttacccaggccggagtacagtggcgcgatcgcggctcactgcaacctctgccttccgggttaaagcgattctcctgcctcaacctcccgagtagctgggattacaggcatgcaccaccacacccgctaatttttgtatttttactagagacggggtttcaccctgttggtcaggctggtcttgaactcctgaccttgtgatccacccaccttggccacccaaagtgctaggattacaggcgtgagccactgcgcctagaagtttttacttttaatttttttaaaaattcaaatttaagaattctggagattgtttgtacaataacgtgaatgcacctaacatgattgaactggacagttaaaagtagttaagatggtaaatgttatggtatattttatggtatattttaccacaatttaaattaattaaagagaaaggttagcataagcgagacacaaaagataaatggatatgcgattccacttacgtgagatacccagaggagtcaaattcatagagacagagagcagaatgattggtggttctcaggggctggggggaaggtagaatagagaattgggggacagagtgtcactttggtaacatgaagaagttctggagatgggtggtggtgagggtgacccaacaatgaggatgtacttaatgctactggcctgtgcgcttacacacggttaagatggtacatttcagcttatgtatattttatcacaataaaaaataagttagcaacattcaaacaaaaacattttaatttaaatagctgcatgtggccattggctaccatgttgaatagcagctccagaggccccctggagaatggggccacagtcactgtggtctctgctgcaagacagagtggtgagggccaccaggtcccagctctgcaccctgcagatttgaatgaatccttccagcagctgatgctgatggagcactcacgtgtgccaggtgctccctcccagccgtctcgctgtgtcttcacgacagccctgaatgatgggagtcactactatccctggggtcaggagtgggggacagttccagaggcacggtcctagccaggcagctgcactcagctccaaacactcatcatatttggtctttgcagagccccatgtgttagagccccctccccttttgcttttttctaggttaggagccaggtctcaaaagacttcacattcaggccttcacttgattccagattctcctgcctaaagtgagaggagggatggattgctttactttaaaatatttccagctgggtacagtggctcccacccgtaatcccagcactttgggaggctgaggcaagtagatcacttgagcccaggaatttgagaccagcctgggcaacatggtgaaaccctgtctctacaaaaaatacaaaaattagccgggcatggtggtgcgtgcctgtagtcccagctacttgggaggctgaggtgggagaatcgcctcagggaggatcacctgagcctgggaggccgagctgcagtgagccttgattgcatcagtgcactccagcctgggtgacagagtgagaccctgtctcagaagaaaaaatatgccccccttaagtttgtgcaaagcatttgccaactccttaccctgcccggaaacatcacaagtctttctctgcagtttgcagatggcgtgtacctggttctgctcatgggccttctggaagactactttgttcctctccaccacttctacctgactccggaaagcttcgatcagaaggtatgtgcatggtctccatccttggtaggggctcaagaaatgctcattgaaatgcagagcatagactatcccggcagctcttcctgcagcctggctgcattcttcagaaagtaaaaaatgcacaagtgatattgcaattagatgtaactctcagcaaaagaaataagaagcccatcagccgtccacaacgcatccgagttttgtttgccacattttctttgcggtcttttccatgggaccgtgtagtttttaataattgtgatcacatctcggtagagttgtaaacccttcccccattctgctgcagctccaccacctgtggttttccctgctgcttcccaagctttccaaataccatctccagtggtggcacgaagtcccaaggatggctctgttaccagcgtctttccattccccattcttgggcagtcaacttgaacatgtttctattgtttttccctactgaaacaacagagcatctttttgatacagattttttttttcattcctgtggattgttttcttaggaaaatttctcaaatagggtcaaatttggggcattcctttcaatctgggctggcccacgccacccggtcccgctgtcactgccctcgtgcgtgggcctctccctgctgtctgccctctgtccagggcttcccgcagccaagcctctcacagcagtatttagcacattgcctttaaaaacttggccatggatggtctatgttgctttggattcatgggcatctgtcattttattttcccaaagtgttagacccatgagtcagggaggcagacaatgtaagctggtggcgacagccagagaaatagcagaaatggggccagtgtttatcaatctgcccacttctggcacgttgcagtctgtttgcttgtggccaaatgttgttcctatcttgcctgctgagatggaatcaggacagattagagaggtcttggcacatggagtccatgttgaatcgagagagagagagcgagcgagcgagcaagagggagtgcagagggaatgagcagaattgtgcagaactcaccaggaaactcaccaggtgcctgtgctgtcatcctggaaatgaaaggtcagaccatccagcgaagaagcgcatgcatttccaggccccgatatggctggttgcagacacattgttttggagagatcttttctttcttcaaactagtaagaatgctggcgagaacagtgagtttagccaggagacctagggctggtttctttccaagacaaggctttgtacaaatgtcagaggcatcatctcctgggccctggccttcttccctttgaaactgggatgaaagtctttgacaattgctgccctggcctgcgaggcttgaggaggcttgagtcatctgccttcccctctgaatcggagcgaggaagggaaggctattttcaggtatagcatgcagcacaccattcatcctgttcactcaggagaaagggagcctggggtggcggtgtggctctgcgggtggctggaacactctccttcggaggatgggaggctgtcagtagttcctcctccagcccctgccttttttccctttctcctcatggcagctgctggcaaggtcttcatgagcccatagtatttattatctaccttgtagtcttcgtgaatcctggacaggtgggtggtccctgctgtggaggactcacccacttcaggctgggcccaacacccgtgtactcaaaactgcttgcggatgggatgttgatggcatcccttgctaatgtctcctgtgggctgagaccccgaggtgcgtttgctctggccctgggaatcctgacagctgctccacatttttgggaggagggactgaggttcagtgagcaaaaccagagatgcgtcatgagctgctgtccccgagggtagtaatgacttatggtttaaaacaattgcattggatttaaaaaatatcacactggacagctcagagcctgtaggctcgtgccccatgagctatctcagaggcatgagtgtggccttcagtttttttgttgcaaagccactgtttgagccttaccctgcactggccacgtgctgagcaccttgcacccattggtcatcattttgggagactctgcaggctccctctctctgtcgagtggggtgcatcctggagacgtggagatctttcctagaagaagacacgagttgcttccccctcagcattactggatgaggacagggaatctcaggaaggcttagagaccagcccagggttgcacggccagcaagggcagagccaggagggtcgactcctattccagaaccctctattctttcctcacctggccaagttgattaaaaccttttgaattgcagagagaaaggatttctgcccatgtggctggctcgaagcaggtgtgtatatggcctggtctctgctgggccttggggcctcctactgcagtcacagctggggtgagcggtccccaggcctctccgggatccatgtgctgggtatccagggatctaggctcaggggacacttctctgcctggcatgaaagagggctgggggaggaggcatggccttgagagataacaggcatgggagggtggcaatttcctgcctggcatttcctcagcctgagaagaaagcagaaggaaaatctcacttcaaaaccacttactgtggggccgagcggctgcagagcaatgaggcttggaaggggctttgctctccccttaaactgttctctcatggtgtaggggtgaccacctcgtcacccgatcacactctccagccgtctctgagtgtctccacgtgtcatgcatctcatccccagcccctcctgagcatccactccctcagcgtggaagaggattcctcaggcttaagaggtgcacgggagaggcacgtgaaaagaccggtccaaattggtgctgacttttacaatggagaagaatcttttcttaaaagaaaaatcttttctcgctattccctctctttgctatcctgtctccatctcgatttggggtcaagcctgttgtgtgtgtgtgtgtgtgcacgtgtgcatgtgcatacgtgtgtgtgagctcatttgatgatatggacggtggtcagctaaagggacctgtgttgctaggggagtggaggtgggaggctcttggaggagaacgggcacagattctacgtttcagtcctggttccatgcctgtgagccccgtgccttgtttttcttttcttttttttttttttttggaggcggggaaggaatctcactctctcacccaggctggagtgcagtggcacgatctcggctcactgcaacccccgcctcctgggttcaagcgattcttctgcctcagcctccttagtagctgggattacaggcacatgccaccatgcctggctaatttttgtatttttagtagagacggggttttaccatgttggccaggctggtcttgaactccagacctcatgatccacccgcctcagcctcccaaagtgctgggattacaggcgtgagccactacatccagctgccccatgcctttttagggcaccgatgtcctagcccatctcagcccagcaccaccctcctttgtgaaggaagatgatattcacctcgtacagggctgggaggggaaagggaacctgtatggaatacactgaccccatggtggatgcacagcacccgcaggtcgctccctgctctctccttaggggaactgcgttctgcaccctccgcacgggccgtcctcactcctcccccattgccagtgtttggccatcctcaggcccagccctggtgcagcactcccgcatctccaggcaggctgtcctgcagggttggggtgtctgccatgtggcccagtgttcccattggcagtttctgagttggcctctggagcagggtctccgtctgctgcacccccgcccctgggtggacatggcctgccctcctgccgggctgtgtcttccccactgaccctatgactagccagaccctcttgcggttggtgctggcaggtcattcgcccctttgcttctccgagcacaggccgtgtgcactgtggaagcttttccaaagcaccccacactgttttccagtgttgttcgtttgattaactcagggaagcctctttttcctggttaattattaaattacattgcaagtaaaattgttcttgtttctgattcattggcctcaaaatcatgaaaatatgatcgttgaaaggattttttgtttgtttgtttgcttgtttttttgagacagagtgttgctctgtcacccaggctggagtgcagtggcacaatctcagctcactgcaacctccgcctcctgggttcaagcgattctcatgcctcagccacccaaatagctgggattacaggtgtgcaccaccatgcccggctaatttttgtatttttagtagagatggggtttcacccattggtcaggctggtctcgaatgcctgacttcaactgatccacctgcctcggcctcacaaagtgctgggattacaggtgtgagctaccacgcccagccaggatgtttgattactaagagccctgaagtcccttgcactgtgacatctgtgcttgtttgctgtttgtttgtttgatgtcccctcctcccatcagccttggcttgcggcaggtgggtggctggatgtaatctggttcattgccggcatccctctgagtggtctttaaacacagcccagaaggcttttattttaaacctgttcagccatcattagcaggataaaagcttcaggtacatttgggggctgaggagtaatagaccctttaatttcaggggaagtcacggtagggcggaggtggccacgtttctgtagcatctaacaggaccaaggtcctgcaggctgacgcttgcagccaccatcgatctgacttccgttctgactggtccactgtccctactcagtgctaaggccctccctcccctgagggcaccccatcctgcagagacacagcctcacgtgcaggtctttacagcccttcctggggcagtgccaggcctgcgtgcctctgcacgggactcatcctttctgggcctcagtttccctgtctgtgaaatggggtcactgtgggccaggcgcagcggctcacgcctgtaattccagcactttgggaggctgaggcgggtggatcatttgagcccaagagttagagactagcctgaccaacatggcaaaacccgtctctaaaaaaaataataataatacaaaaattagccgggcacagtgatgcgtgcctgtagtcccaactactggggaagctgaggcaggaagatggcttgagcctgggaggtggaggttgcagtgagctgagatctcgccactgtgcactagcctgcgctctagaccctgtctcaaaaaacgtaaataaataaataaacaaagaaataataaataaaatggggcccctgtgacttctcatcaggtggctggcatctggggcagagcaggctcttggtggccgtgagccctcgagagcaggccgggcacctcatccttccatctctcagcccagatcactggtgtgaggggtgagaaccacctagtaagcgcacatggccctccgcagacttcctcacccgtgtctgcccaccctgtggcccgccccgggctcactgggtccttgtggacgtcagcgttgcagaggctcggtcctgtccatgccggctgtcctccagcagtgggccgtgtgtgggaacgactgttggaccctaacgctgacccaccccccttccttggcaggtccacaatgtgtccttcgcctttgagctgatgctggacggaggcctcaagaaacccaaggctcgtcctgaaggtaatgcccctggctcaggttcccccgggagaggtgcgcacggaggggaagaaaaacgggtcctagaagtggctggaaggctggcatgttgttccccagatgggccccacgtctctggctctggggcaagggtctgccaaccccagctcctcagtctcctcattttgggaaccaggaggacttcgctggtggagctggcagtgccggttctttaataaccacttgactttgaaggacgtggcctctgcccacagacctcaggattaagtgcgtctctagctggccactcaggctggaaatgcagcttcgtgccctgagaagaaattaaaggcttactcaactgtaatgactgttgggctggaggtcccctgatgctcagccaaaggcagtacttggtagcagggacttggcatgctctgcgtgggtcggagctggaggcaggaggccagcagagctggggcgggcggttgcttccctgtcccccccccggctcctgtgccaagttacctataggaggactctctaacctgagtgagcatcacagttccccaaacacacttcctaggtgtttggggacagccaggctcagcagaacatgggtggcactgcctgtgaaccctgctggaaagttacagggcagagctgaacattaaaggctttgacaagtcctatatgaagacatctgtttgcctccatcaaaacctttgccatgcaggaggagcccacagaactcagacactgtggtttagtgccctgggcccccactttgaccgtggccccctacctagccctgctccctctcctgagtcccccatggtgctatatgagttgggagcccatgatgcttcctacacctgttgccagcatccgctcaacggcgggctttgtagagtctccaaaatagctagaaaatggatcctgtcccttccatctacccactgcagccaccgcttcctgccagtccacgcggaaggttcctggccggtcccttcctgcctgttcatcctcctcttggggtttcacaggacaatttcacaccctcctgtctcgtgtgtatggctgtttattcttttttgttttgagacagggtctcactctgttgcccaggctggagtgcagtggtatgatcacagctcactgcaacctcttcctcttgggttcacagcatcctcccacctcagtctgtcgagtaactgggactaaggcgcataccaccatgcccggctaatgttttaacttttcttttttgtagagacaaggtctcactatgttgcccagactggtctcgaacttctgggctcaagcgattcgcccattacaggcacgagcccccatgcctggccttgtttattttttattgtccctccctccccactagaacagaagcctcaagggagcagggctttgtcccctgcatgccggtgctgagaatggtgcctggcctggaaactgctcgacagcacggatcaaagcacatgtccagcagggagtgtggcgagctgctgcctgtagataccggcccggcctgggtctctgggacccctcgttgctgctgccctgcagcccttttgttgctgtgaggcagggccatgagggagtggctagaggcccgagggatgctgctttgcctctccccagctgtgcatccttgaacaggttactttgcctttctgtgccagggcctcctcctctgttgaggggagtgatgatggcacctgcctccacgcgtcatggggtcgctggatggggggcggatgttcatcacacaggacttgtcagagccttcactgttcaactctgccctgtaactttccagcagggcccacgggcagtgccaccacgtgctgctgagcctgactgctcctgagcacctattacgctcaagtgagctgctcccatgagcactggaagagggtcctgcccacagaacacaccaggtccctgctgatggtggctgctagctcggcgttagtgtctggtgggtcgcacactgtcagggaggagaaatccttgctcatgtccactgtgggcttggctggggcttcctttagtttcctgtagcccaaagcctgggccctatctgcagcatggggtgcttcccccgtaccctcagaagagcccctggtggccctttgcctctgagctgctgagggagccctgcttctttgtcctcccgaacccacgactttttttttctgagacagagtcttactttgtcacccaggctggagtgcagtggcgcgatcccagctcactgcaatctccgcctcctaggttcaagcaactctcttgcctcagcctcacaagtagctgggattacaggcacccgccaccatgcctggctaatttttctatttttagtagagatggggtttcaccatgttggccaggctggtcttgaactcctgacctcaggtgatccacctgccttgccctcccaaagagctggggttacaggtgtgagccaccacacctggccctttgtcccgtttttgaggagtgaggcaggagcctgtccagaggccaggatatcctctgacaggccggcctcctaggagggtgtttgcccctgagcccggatgtgtttcctactcatctgccgctggacggcacgttagggaacccaccacggacgtgtggaaaccaggccagaggcagaggcactggtccagggcaaatagcaagttctgcagcctcccaggcagggtcccttgggtgtcccagggcctctgtccagcccaggcagggggcagagctggtctgcagtgctcattagcaccttcgctgggccagcactgggcaggggccaagccgcagagatttatgagatggggtccctgctgggcctctttattttgtggctgatgcaatgaatgagagacttttccttcttcattcaaaatcagctggggagcaagaatcaggaggtaacagagataagaatgacacggagaatggggtgcagtggctgcggtctccctgacaccctcctctgagctaggcagacttacccgggtacccagggctggtggggagggaggcagtggctgtggcctcccctgcaggcctgagactgccctgttggtccccacccggaggaagcagagcagtctcacaccccctgcacgtgggcgggtctgaagagccaggcctgcacctggttccctaggcccccagcaatgatgggcatcctggccccctgcccccttgtggggacctggcggagactccagtggggtccccgaccctgctcttaaggaggccccttgcctgggagaaaggcttgtggctcgctccaaattcacagagccgagtgcggagctcgatggtggggtgggtgtttggggagcacagagggactgaggttcatgggtcacagaaggtgattcctatccctgggcgcaggtgctaaggggtggctgtggttagcaggtctggcaggggtgtgagggttaagttctgtttgtccagcgaggctgtctggaagttctcagagctcagacctgggggctgctgcgtgggggcatcggtgtcaggctgctgctctggtctccctgtgagtccaccatgggagtggagtcagagggggccaggaggtgatggcccccacccctgggagctcctctgtccttgctgcccccctcgccttggccacctccaactccatggccgccattctccctcccctgcctccactgggctgttgggagctggggtggactcttcaggtcagggggagaccctgggatccctgacagagccccgggtgtgtccccaagcccgccgagccgagttccccgacagagccccgggtgtgtccccaagcccaccgagctgagttcagccctgcttttgctctgacagcacactcgtgggcaggtcatttctccatgtgagtcttggtcctctttgtaaaacgagagggaaggaaaggaggctgtgcaggctctgatgagggtgtgtgagtcgagaaactccatgcccagtgacaaggacagttgctgattcttagcatccaccccacctgctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaa

SEQ ID NO: 2140 - DNA, 170023 bp, Homo sapiens
gcaaaggccctacactttgacgtcctccccatctccggcagctccttaaactaagaactcattttaatttctgaattctccctttttaaagaccagataaatttacctttgggacagttagatgtgcacaaatgcaccatgtgtttaaagatcaccaaagaggagagaaaaggggattccttagtccagagaacaaaaactggtgagctgtgatttaaacaaaacgaatgttgttaaaatcaggttgtactcagaagtccaaatttctagcttctcttgagaaactggatccgacaaacaaaaaatgttcattcctacctgcagcaggaggctggagctgagacgtgggtgttcctgcagctggggcctgtgctcccaggcactcatggcttctctggctggttcacttctccctggctcagacagatcaggagtggaaacatctgaatatgctcaaggaggaggtaagttttgggggaaaaactgtcagaaagtggatgagggctgggtgcagtggctcatgcctgtaaccctagcactttgggaggctgaggagggaggattgttgcttgagcccaggaatttgagactactctgcacaacatagtgaaaacccatctatatgaaaaaaaaaaaaaaaaaaaaaaaacagctgggtgtggtggcatgcatctgtggtctcatctacttgggagacttaggtgggaggatcacttgagcccaggaggttaaggctgcagtgagccgtgattgcaccactgcactccagctggggtgacagagcgagaccctgtcacaaaaaaaaagaaagaaagtggactagcagtgagcccagggtcaggggccctggctcttgccctgttggggctgtttaccaaatccactcactgctttcctcaggtttttcttctaccaaaggagaagatcttggtgtattcagcaatagattccactcttagtggatgccactcatgagctttctagggctttctacccccaaggtaaaggctagatgatttttaacaccagagattgattgttttgcctgtctgaggacattatgtacaaggagttgaacagtggctctttgattgtgattcagactggaggtgaatcccagctctgtggttgaccagccgtatgaccttgagcatgttctcatgtgggttcaaatactgggccactgtgaatatgaggcacagtcccctgtttcccagtgaagaaaagccaggtggaggagagtggccaacctgagtaaataacttttagaaatacagatgaaataggccgggcgtggtggctcacgcctgtaaaattttgcagatcttttaatatctgtcttcaaaaccagagggattcttgcatctggttctgcattcagtttgttgcatttgaagttgttcgattgacgcatatgaagaaaatgtgttttcacatagatacgtatttggaaaagagagtattttagtagccttttcagataactgtgaacattctttgatacttcaccaaaactcaactaatgaacggttttgaaaggttagttgcagtgtggaatctgaaaccccgtctatgtctttttcacactctgttccattaagatcccctggtctacctggcactgtgattggattgtttacccaggcatgcttttgtaacatcatatgctagtcatttgcaaaatactggttccctgaattaggcacatcttccaaatgtcaacatgtcttcattatgcaaaacagaagatcacatttggccaggtgcggtggcccatgcctgtaatcccagcactttgggaggcccaggtgggcggatcacctgaggtcaggagttcgagacaagcctggctaacacagtgaaaccctgtctctactgaaaatacaaaaaattagctgggcgtggtggtgggcgcctgtagtcccagctactcaggaggctgaggcaggagaatggcgtgaacccgggaggcggagcttgcagtgagccgagatcacgccactgcactccagcctgggtgacagagcgagactccatctcagaaaaatcaatcaatcaatcaataaaagatcacattcattaatatcagcacccgttggatcaggaaaatctaagtacagatgctcgttgacttacatttgataaacccgttgtaattcaaaaatattgtaaattgaaaatgcattaagtacacctaacctactggacatcgtggcttagcccagcctccctggaacatgctcagaacacttatattagcctacagttgggaaaaatctaaaacaaagcttattttataagaaagtattgaagatcttgtgcagtttgttgaataccgtacatgacatagaaattgcaaccatttcacgctgttgtaaaagtcagtacatcggaagtgggaccattagaagttagggaggtattgggaagctgccaagctcatggtgctggatccaagtttccaaaaattccagttttcacttgaagcccgcattttaccattggcagcaaacacttgaagctcactttgtccatttccaaggaaatgtctgccagatacccacgtctgaatcaccatagtttgttagtcgctcttccagggaaaaacaatgttccatgaacacagcggcaattcaggcctggacccaatcacccagggctttccttgagacatatgagcccctgtgagcagcagaagtgttctctgcttaggatgtttgaacacagggtaaaagcgctgagatgtaatgacagggagcattttgctgcttcattcatgagcgaaactggcatttgtgtttccctccccaagcacagtggcgaagaatacaatggccataggggtgtgttgcctctgccattctctgccagggtgcaggcactttcacccacagctgcttttgcatcgtgagtgcaaatgtcaacccagtgaaccaagtaactaagtaatgtctttgcattattataaatatagttttaacccaatggactccctggaggagtctcaggatctccagggggccgtggaccacgcttcgggaaccactgatctatcgttgtccaaagctaattttttcagctttcggggtcctccccaggtgacttgcaatagagtaattgtgagaatgcccataagggctaagctgggacttaagcaccctccttttattttcagatgtaaatcatattcacctccctgccgcagatcctttgtgaaatggggtagtcgagcctatcagtatcgagagaaacaaaagcgaagtgcctggcacgtggtaggaactcagaagtggcaggagggggcagtgggtgttggtggaggggcagaggcgggtgcgtggtctctgcgctccgtggggtgggtaagaacctgccaatcccagtgggttctagtaggagggatgtctttcctgcgtggctgtacacaggagaacactgtaaagagcaaggactggcattaaattctgcattaaacgtgaggcctgtttttacatttacacatacagatttcagtttgcgtagtgaaccgtgggaggctgtctcagtcgtgccttcctggggtcaaaccagttggcctgttttcaagaatgaaaaatgctttgcccgaaagtggggcgaatggtaatcacagacacacacgtctcggtgccagagttgtagctttatacatagtgccttcctgacaagtaaattactggattcctttgccaaatcattagataacttttaagagcaacaaacattcatgcaaaaggagattcagcattatcttgttagaaaaatagtcatgatttttgaaaagcaaggacattctgtgaagtttgaccaactgtgaaaattacagcctttcttccccgtacttcccccgtgcttttcaatcaatcagtttctaatggatgaagcattccctacatttgtcactagatggatgtgccggtcaattaaaatattctgacttcgcagggttgagataatagccagcctggatccatccgttactgtgaaatagaaggtgaccttcctgtattgagtcagagacccaaatacaattgctttgatcttattatcatagccagaaattaccgttcatctaaacgtaatttccctgaaatactgagcgggcagagctactgctggaaataccagaacatcataaagagactgtgatgtggccttggggatgaaaggtgacatcttgacttgacatccattccacctgactgcagaaatcaagtggaatggaatttcctgggatgttctgtatctagtaaaggctaagtaggattcatcaccaaaccttaacccagagagattaagccctgttataatgtgctgcggcagccacgccaggactggactccctggaatctgaccctttctttccattcccacactcccaggccagggtcctagcctttcctgtctgtctgaaaactgctcttccaggggtggggagcaggaaaccttgtgttggggtggaaagagcctgtgtttaggagttggagctggctttggattctcacttcctttgttcgcttattcgttcctccaacatggacattgggccaggtgcagggtgttgtacaggtggctcttctggcaactgccgtcaggtttaccctcctctttagccccagaggtcccacagcctcctgtgtctgcccatcccttacctccgatgtccccttccctgaagttgttccaaatgacctgtagttgccgctgctgggcctggcttctgcagggctggccactccccttctccagggagcccctagttctgtttggagaactttgccaggtgctggcccttccccactcttgggatggaagcctctagaacaggatggagaggggtgtatccatctgcatgtcattctctggtcagagaaaataagttccaccttttctgagcttgagtgagaaaaaaacaatcaaactagatgtttgccaaagacatcacagcagacacgaagtagcagagccatgggcacagaaaagggagcctgggtaccccctgctggcagaggtgctggggcaggagcaggcgctccaggtcgcgcgcgaagtcagtgaggacccttttgagctccccgcaactgaagaaggaattaataaaatcaactataacctaacagtagtagtaatagaaattttaaaatcctctcaaagttgctgcaaagtgtgaccccccccttactctcaagttaaaagagaatattaacagtctgtcttctctctgtggacagtggaccttatctatactccccaactccacattcctcaaagtttgttacaggcccagcgagttcctgcttacctccctagcatggctgcagggtcacaagaccaataagtttaggtggcaagacatgtttctctcaagatataagaaatgtaatgctgtctttgtttcttgcttctgtaacttgcttcccgcctcacgtagttcctgccttaagatgtttacaagtagaaaaagccctttgttcggggctcaaactttctggacctatgtccggctgagctggtgatcaccttaatttaataaactctcctgaaccttttccgtctctccagtctttgattgtcctgcaacacaacgtccggtttgtgagcatgcactgcttttgtcttctgggctaagccagaacaggcaatagggttaagcacctgaagtacattttaaggagaattaggagccattgttccaaaaagattctaaaaatggatgattgatttaaaaggttctcagggacagtgctgtgtactcaacagactcctgaccgacctgcttatgagccttgaaaacagaaaatctttattttgcaataaaggtgggaaaaatacaacagctctttaaaaatcaatgattaaaaaaattttatagttttatttatttatttttgagagagggtttcactctgtcacccaggctggagtgcagtggcacaatcacggctcactgcagcttcaacctcttggacttaagcaatcatcctgcttcagcctcccaagtaactgagactataggcgtgtgccaccgtgcccagctaattttttctattttttttttttttttctgtagagacagggtgttgctatattgcctaggctggtgtcaaactcctgggctcaagcagtcctcctgccttgaactcccaaagtgctgagattacatgtatgaggtaccacgcctggccgtttttttttttttctttttacacaaataatagcatactgtagttcctgttacatgcttttctctttcttttctttaattttttcagagacaaggtcttgctctgtcacctaggctggagtgcagtggtgctgaggcaggagaatgggttctggaggcagggtacctaaggctgatttgcactgatttcctagagctgaatcaaaaggaaaaccccacctctccacacccaagtaacgaaaggatcagaggctactcaaccctcccacctttccactgcatggcagatgaaaaatgggaagttcctctgattggtcccctcccacaaccaatcagactggtcgcaggccacttcttcatttacatcggttgtaatcaagtaacaacctagagggtatttaaaccccagacaattctgtaaccagggctctcagccactgctagagcctgctcccactttgaggagtgtacttctgtttcaatatatctgtgcttccgttgcttcattctattgtttctttgtttgtgcgttttgcccaattctttgttcaaaacgccaagactcataatcaagaccctccactggtaacagcgctatcatagctcactgcagtctcaactccctggctcaagggatcctcccacctcagtctctggaatagctgggaccacaggcgcatgccaccatgcccagctattttaaaagtattttttatagaggcagggtcttgctatgtttcccaggatggtcttgaacttctgggctcaagtgatgctcctgcctcagcctcagcctcccaaccctctgggattacaggcacaaggcaccacaccaggcccatggaatgctttcaatagtgtatatcctagcatcttacgccactccaagtgtagtgcaggaatctgacgatacattagaaatgcagagtcctggccagatgccgtgtctcatgcctgtaatcccagcactttgggaggccaaggtgggcagatcacggggtcaggagattgagaccatcctaaccaaaatagtgaaacgctgtctctaactaaaatacagaaaatcagtcgggcgtggtggcatgcgcctgtagtcccagctacttgggaggctgaggcaggggaatcacttgagcccagaaggcagaggttgcagtgagccgagatcgtgccactgcactacagcctggtgacagagcgagactacatctcggaaaagaaaaaaagaaaaagaaatgcagagttccaggccctgcccagcccaccctgtggttttgcaagattcccaggtggcctgtgtgtgcagtcaggattgaggagcaccctctaggtttgaactcagcacacttccataccttcagccctctcctctcataggtaactcagctcccacctgccacgtggcaggatctcctggacaggcagccagaaagctagtaacagcaaagctttgttacctaacatttccttctatttgtgtgcagtacctccccctgtcatgccccgtgtgagggcaaatcaccttcatcgctgaatctttcacctgggcaagtgcaggaggggagccccagatcagctgctcccatccatgtgagttctgctgcgcggatgcaaaaggcacaaagatcccagggacccataggaagcttcacaatggttaccatccacctactgtcagtggccactaccttccgttcattcaaccgtttgggggacagcgatcaagctcttagtgtgtgcgaggctgcgtttgcgggtacagcgggcggagatgacacttcaggtctagtggggaagaacaggtcagcagggggtacccaggaaagatggggagggggtgcccagctccgcctatgggaggaaggtgggctggggggagtggagtctcctccgagaagcccatcctttcccgtgctgctttgcagtttagcatggggcctgcatcaggctctgcactcccacgctggaggccagagattcatgtgaatttccagtcgtgggtcatggccagagcatcctttattctctttcccaaggtcgggctctctgttcaccctcttctgcctctgggagcctctggactcatttcttccctcctgcgctcctcagcgggaagtctccatctccttccttcctgtagattcctcttctccacgagaaagttttagaggcttttccaatcccccaaggcaagactttgaattacctttagttttaggccctgatttatgtgggtttgacaacaggctttaaaaaagtttttttttggtaaaatgcacataaaatgtaccatttgaggtctacagttccgtggcttaaatccatttacactgttgagcaaccatcaccaccacccatctccagaactctttcattccgaagctgaacctgcacccattaggcactcactcccaattcggtccttcccagcccctgcagccactgttctacttcctgtcgctattaatttgactcctctaggtgcctcatctaagcaggatcatacagtatgtgtccttttgtgactggcatatcacactagcatcatgtcctcaaagttcatctgcgttgtaggctgagtcagaatttcatgtatatacgcatgcatacaccacattttctttatcccttcatgtgtcagtggacgtttgggttgtttctacctttagagacaggttttttttgttgttgttgttgttttgtttttgagacagagtcttgctctgtcacccaggctggagcacagttgcatgatctcggctcactgcaacctccgcctcccaggttcaagcaattctcctgccttagcacccccgcccgcctccgagtagctgggattacaggcgcgcatcaccacgcccaactgatttttgtattttagtagagatggggtttcacatgttggccaggttggtctcaaactcttgacctcaagtgatccacccacctcaacctcccagcatgctgggatttcaggcgtgagccaccacgcgcggtctagagacaggattttatgattgagtgaatatacctggatgcctactatgtgcaaggaaagcatgcttctgagaaaaaaagattcattttgcatttttcttttagattttgagaaaaccataccatttagttatagaaaagtatttatcttttgcagcatactttggctgactttgataacactcagactgtattagagatagatgcttgggtctgccactctgaggacacggatccaagagtgctgccacaacctgcctgtctttcttgcttgcttataaaaatagagatgacaggctgggcatggtggcttatgcctgtaatcccagcgctttgagaggccgaggcaggcggatcacgaggtcaggaaatcgagatcatcatggctaacacgaggaaaccccatctctactaaaagtacaaaaaaaaaattagctgggtgtgggggtgggtgcctgtagtcccagctactcgggaggctgaggcaggagaatggcgtgaacccgggaggcagagcttgcagtgagccgagatcgcaccactgtgctccagcctgggcgacagaacgagactccatcttaaaaataaataagtaaataaataaataaagctccatattttaaaagctcattatagtatttaagtagcagtgatgtttgaatagtcttttcatgccttcccttttactgatttccttgcgaatttgaaattttgactgtcttaagataatttagcacacagaattgagctttacattttaatattttcctgatttaagaggataatttgcttacagctgttcagacctctgatctcaattggtaatgagctacagtaggtatgctatgtggatgagcatgggacagattttaacatacaagttgcaaacccaaacccatgaaagtttctatcacttttatgtcagactgagtttttaactgatgataatgcctgtctgagtattcattttctcaatcaaaatgtattctaatcagttttgaaatcagttttgaaatcagttctatttgctctaaataacatcaacttgttatttttttgtacggacagatacaaaggcagagttcaaatcagcaattccccattgacaaagtattaaggtaaagtggcattctgccataaaggtttatatatatatgtaaaaacctatatatatacacacatatgtatgtaatatataatatatgtgatatatgtaatatgtttattacatatatataaaataggttttaaaacctattatataaactctcttgttaatatataaaccattatttaaccctttaaaaaccctcttttatataataaacattatatatgtaaaaacctatatatacacatatatatgctcatatatgcatacacatgtgtgcatatgaatctttttttttttttttttgagacggagtttttctctgtcactgaggctggagtgcggcggcgtgatctcagctcactgcaacctctgcctcctgggttcaagcaattctctgcctcagcctctcgagtagctgggattacaggtgcccacctccacgcccagctaattttttgtatttttagtagagacagggtttcaccatcttggccaggctgatcttgaacttctgacctcgtgatccaccctcctcggcctcccaatgtgctggaattacaggcatgagccactgcgcccgtccccatatgaatctttaaaattgcaaatgtaattcccattagaatgtaagctccgcagaggaggtcttgttcattttgttcacgagtgcaccccacggcctggaatcacacataaactggcactcagtatttgtggaatgaatgaatccatgagtgtgcaaaggagaaagcacaagttgcttttctgcttaaccccatgtgatgaatggcaccacgtcccactaagatcactctgccctttcccctgccagggtgtctcataatgttccctggggcggctgcactgtcctataatttgtgtaatcaaacaggcacatttaggtgatccccattcccctatatgacaagcagtcctgcagtgtgctcatacctttgtataattgtgcagaaactttcatggaataaatgatgagaagtggagttgttactgacgcacttttggaagtactgtgctgatgcattcctaatgaagctcccttagagttcagaacaacagaatctgaatcactgttgttttcaaacatcggtttttggtggtaccatcagcatcaccactattaggactttcaggtaaaatgtgcagtaaatgaattgaattttggttgctctctgctcccgaatctgcatagtatctgattttgtatggcctgcgagtgaaggatgagtttacgttttaaatgtttgggaccaaaaaaatcaaaaattttacgacatatgaaaattatgtgaaattcacatttctgtgttcttaaaaaaaagttttattggaattaggcaccatgcctattttttttttttttttttttgagatggagtctcgctctgtcgcccaggctagagtgcagtggcgcaatctcagctcactgtcatctctgcctcctgggttcacgtcattctcctgcctcagagacagggtttcactgtgttagccaggatggtctcgatctcctgacctcgtgatcctcccgcctcggcctcccaaagtgctgcgattacaggcgtgagccactgcgcccggccatgcctgactaattttttaaaaatatttttcatagagatggactcttgctgtgttgcccaggttgttctcgaactccagggctcaagtgatcctcctgcctcagcctcccaaagccctgggatgaaggtgggagctgcacgcacctggcctgcttacacatcatctgtggctgctttcaagctacaatagcaaaattgggtccttgtagccaggcacggcggctcacgcctataatcccagcactttgggaggctgaggcaggtggatcacttgaggtcaggcgtttgagaccagcctggccaacatgatgaaaccctgtctctactttatacaaaagttagccaggcgtggtggtgcatgcctgtaatcccagctgctcgggaggctgaggcaagaacattgtaagcctgctggtgcttgaacctgggaggcagaggttgcagtgagccaagatcacaccactgccctccagcctgggtgacagagtgagatgctgtctcagtaaataaataaataaataaaatttaaaaaattgagtccttgcatcagagtctgtctggccccttacacacccctgccgtagaccactgtgtcttccctggccacagcaatgttctcatgatgtgctatggccgccacatccttagctccagcatcgtagagcaagttccctcccacaaagccctacacttcagttctcccctacccccgtcatcattctctccttcatccaaaacaccactctcatcccctcactgctctcaaattgggtgggaggagaaaataaaaacctttcattttgcaagcaggtgatacctggatggcaaatgaatggcaaaagaaattcagactaaggtgtgaatgtctaatagacttggcctttgttctcccacccacctaagaggtcctggcatgtttcaaggagcttgctcatcccccattttctcatagctggtcagaggggagtctttttttaaagggggcataatctttgggggactttcccagttttcccccatggaagactaggaaccaataacttggtaccatgttatttattccttcttcatctataaaatatttaagggaacaaaacgcatatgtggtttactctgcctggtatgcaaaaagagaactcggaggaattgctaataaatgaaaatccaacttcccttgtctcagagtttgctgatgcttccaaaatcatttgagtgaaagacggttgatcagtgtagttggtgattcatgttctgctcacacgtggcatgggcagaagtgtttccatcacagttttaaaattctaggcaagtctggtcatctcctcctgctcttagtatttactgtgaacatcgcaggttactctcttgccagatcactaaattagcagactgattaaataacaccatttcaaaatgctagtttagatattatggttacagcgtgcttgaaaaccctaccccaaagtgcagtaagattgcctcaaaagtataacctgggggaaataaggcattttctccatcgcacatcaattaaatatttccatcacttctctacacacttctaactcgcctaaaattgcttggaggtctgaaaatgaacaacacaagaagacatttcacagtcttaagtattccctggaatgagttcccttttctctcccaaagagctacaggcggtttttatttatttatttattttgagaaatatcagcttctttttagttctattaaagagaagtgaaagaaagctgacaagctttatttatttaactttttttttttttaacttttttgagacagtctcgctctgtcacccaggctggagtgcagttgcgcgatgtcagcttactgcaacctccacctcccgggttcaggcgattctcgtgcctcagcctcccaagtagctaagactacaggcacgcaccaccacgcccggttaatttttttgtagttttagtagataaaggtttcaccacgttggccaggctgatctcaaactcttgacttcaggtgatccgtctgcctcggcctcccaaagtgctgggattacaggcgtgagtcaccgtgcctgaccgcttgcagcttttaagaccctctttaagcacttagagtgctgccatgttatccagaaggaaactcacacatgtaaagaatccaaattatcccatccaggggtatcacgtattgactttcttttccccaagaatttattgtggtctaatttatatagagggaaatgcacacgtttcagtggaacgtctgttgacttttcacgtttgtgtacactgtgtgactaccaccagatcaggctgcacatcacccagccagcctgctggtgcccatatgcaggggagatcctcagtgcccctcaccacgccggcgaagccactatcaacacagaacagaggtcgcctgctcttgaacttcaaataagtggattcacgcagtctgtgctcttttgcatctgtctggcctctttcattcaacataatgttttggagatacactacattgttctttttttttctggatggagtctcactctgtctcccaggctggagtgcagtggtgcgatctcggctcactgcaacctccacctcctgggttcaagcgattctcctgcctcagcctcctgagtagctgggattacaggtgcccgccaccatgctcagctaatttttgtatttttggtagagacagggtttcgccatgttggccaggctgctctcgaactcctgacctcaagtgatctgcccacctcggcctcccaacgtgctgggattacaggtgtaagccaccatgcctggctcggtgtaacttctattgaaaaagatttttctcagcactctgggaggctaatgtgggtggatagcttgaggccagcagtttaagaccaacctgggcaacatagcaagacctccatctctgtttgaaaaagaaaagaagagaaaaagatccacatgtaagtggacctgcacagttccagcatgtattgttcaagggtcctgtgtttgggtactatacacagaggaacaatgtttccgtttgttcaaacacactggactcaggtccctctttctgcaggcccagattctccaaggcaagagtgtgggtaagggaggttgactgagatcacacagtgcagcccccagcatggggcacagagtgcatgcagcaccagctcaggaaatgtttcctccttgtccttaattaagattatatggaactggcctcttcagaagccacagttcaaaagcaaaccaaatggttttctttaataggggcagctgcatgtaatctgattttcataatcattctccaagtgtacaatgtatgcatagccctggcacgaggcatatgtggggagcatattaagaagcaaagacggcattgatggagaaggagctaagttcatatttctgcatctcattaaattctctctttttattagaaagtggcactttccaatcttgaagttaatatttatgtttgctgctctgcaaagcaatttggaaagtagttttagtgagattaccccagagagaaagctagttatgtaaactccacaggagccaggccaggaaggaggaaagtttttccggtttgatcattgtccttccttcctctcaccttgaaaagaaatacaacttagtccacagccatcaagccagttcttgattgtcatctgtagcacatacaagacaaaaaaatcattacaacagacacaacaattttttttttttttgagacggaatctcactctgttgcacaggctggagtgaagtggtgcaatctcagctcactgcaacctccgcaccctgggttcaagcaactctcctccctcagcattctgagtagctgggattgtaggtgcccgccaccatgcctggctaatttttgtatttttagtagagatggggtttcaccatgttggccaggctggtctgaaactcctggcctcaaatgattggcctgccttggcctcccaaactgctgggattacaggcgcgagccactgcgcctggcccagacacagcaattaaaaaaaaaaaaaagttctaacctgcatttaataatgatacaggagatagaaagaaattatttagacagatagtgagggtgaaagagtccttgacaagatctctcttctaataaaaagcagcccccaaaattattttttttctaacaaagagcagcctgaaaaatcaagctgcaaacatagataaacatgctaaaaacttacatgggtgaatgcagacagctgtgccaatagaaaagggctacctggggccaggcgtacccaacatgaagactccatctttccttttctgttgttaccacgtatacaataaagaaacgaacaacatgacactggccagacagagaatccatctacataatacataggattggggctgggcgcggtgactcatgcctgtaatcccagcactttgggaggctggggcgggcagatcacctgaggtcaggagtttgagaccagcctggccaacatggtgaaaccccatctctactaaaaatacagaaattagctgtgggtgatgatgcacacctgtagtcccagctacttgggaggttgaagcaggataatcatttgaacccaggagacggaggtttcagtgagccaagattgtgccactgcactctagtctgggcaacaagagcaaaactctgtctcacaaaaacaaacaaacaaaaaaagattagggtgcagacagccaacttttaacaccttatacaaatgatacacctagctctaaccagtttttcacgccttatacaaatggcacacctggcccaaccaatcgtttgtgccctatgcaaatcagacaccaccttctcaaactaatctgtaaaatcccctgacatttcaccatggaaccaacaacgcatttttttgggatttctctctgggcagagagctcttctctgtctttttctttttctttctttctttctttttttttttttttgagatggagtctcgctctgtcgcccaggctggagtgcagtggcgtgatctcggctcactgcaagctccacctcccaggtttacgcaattctcctgcctcagcctcccgagtagctgggactacaggcacctgccaccaggcccagctaattttttgtatttttagtagagacggggtttcaccgtgttagccaggatggtctcgatctcctgacttcgtgatccgcccgcctcagcctcccaaagtgctgggattacaggcatgagccactgtgcctggcctagctcttctctttcacctattaacttccactctaaacctcactctctgtgtgtccatgtcttagttttctgtggctgtgagacaatgaatctcgggtatcaccccagacaaatgaggccacttcaataacacatcatcctatccaagtgtaaacatgaaattcgcttatgtttcatatacaccttgtacacagagtctgaaggtaattttatacaatattttaaataattttgtgcgtgaaacaaagtttatgtacaagagatattacagctgaagggggctggaagggtcttttttcccctggggctgctgaataaactgtgtgttatgtgcctggtgcttcaactgtaacctgtcatgtgaggtcaggtgtggaattttccacttttggcatcacgtcagtgctcagaaatgttcagattttgaaccatttcattagggatgttcgacctgtggctgtttttacttccccattttattttattttattttttttgagatggagtttcactcttgttgcccaggctggagtacaatggcatgatcttagctcactgcaacctctgcctcctgggttcaagtgattcttctgcctcagcctcccgagtagctgggattacaggtgtgcactgccatgtccagctaattttgtatttttagtagagatggggtttcgccctgttggccaggctggtctcgaactcctgacctctggtgatctgcctgcctcagcctcccaaagtgctgggattacaagtgtgagccaccgtgcctggccaccttccccatttgagatgtgagaggtaatccaccctaaccataaattagtttttcatagtgttaaataagaaataaatcatcttagtctctagacaaagaggtgcaaggaaaattgagtgaatgaatgcagtgctttgggtctgagaatacaaaaggtgaacgatgataaactttaccaagaaggccctatttacatgggatttcttagtagcgagtaccacgcttgcatttaacataggattccatctgtatacaaattaggtctataaaatgccaggaaccctccagtaacgcaaagcccaagacagttcctcttacaattaagcaccacttggttgtcactagttctgcttgaaatgtggggccactgttctttcacactgtaatggcatattcaaactgtctctgccatgttcaaattagcaataaccaaatgaaaattgtaaattctgtgtgttcactggcaagccggaaccactgacgaaagcttcaaaaatccattatttcctgggcactcaccagaccccccacagatgcatctctgtgtcttcagcctctggacctcggcttttgcccattcacatcccccatgaggatggctcttgtccattttctctcccagttggtgtttcttctccccttgctctctcctggttagaggctcttcactgggggtccgtggggtgccaagggcagtaggggtgtcaggggggccttccaaagcaggctattgtttgagaatgatgttgcatgtcacgtgtcacacatgtgacattgtgtgtgcttctccagactagagggtctgtcccatgcaccagattctcaaagaggccagagacccctgccctagatgacagtctcaccccaggatacagagagtacccggatctctgttcagccctgctatgtcacaatcccactgagatgtcaataaccacatctcggccaggcacagtggctcacacctatactcccagcattttgggaggctgaggcgggtggatcacctgaggtcaggagtttgagaccagcctggccaacatggtgaaaccctgtctctactaaaattacaaaaattagctgggtttggtggtgggcatctgtaatcccagctacttgggaggctgaggcaggagaatcacctgaacccaggaggcggaggttgcagtgagctgaggtcttgccattgcactccagcctgggcgacaagaatgaaactccatctcaaacaaacaaacaaaaaactaaccacatgctcgatgtttctgtgtcttccctgctggttagtgacatccaaggcaggccacatgagtaagaaccctctgagatcttccacccttcacttccctaacctggaatccagtcattctccaggttttggggctcccaactccaaatgttcattcctctttgtcccccacttccatgtgacactgcctgggtgtgtagcctcagcaccccttttgtcgaattggtctctggctctggggtttcctcgcttggtcctccacactgggtcagttctctcaatggccacctccttccttgcacaagatcaagtgcagactcctgacctgggtgctggagggcagtcctttccatcgcccccgttctcctcacccagattctcaggccacatgggcgggcttgccatggttatggttgactcgtgcgctgcccccatcttggtccatttgcattgctataaaggaacgcctggagctggttaattttttatttttattatttatttatttagagacaaagtctcgctcttgtcccccaggctggagtgcaatggcatgatcttggctcactgcaacctccacctccaggttcaagcgattctcctgcctcagcctccccagtagctgggattataggcgcctgccaccatacctggctaatttttgtatttttagtagagacagggttccaccatgttggccaggctggtctcgaacttgtgacctcaggtgatctgcccgcctcggcctcccaaagtgctgggattacaggcgtgagccaccacgcctggcctatttttatttttttatttttgagatggagtctttctctgttgcccaggctggagtgcaatggcatgatcttggctaactgcaacctccgcctgccgggttcaggtgattctcctgcctcagcctcccgagtagctgggattacaggcatgcatcatgacacccagataatttttgtatttttagtagagacagggtttcaccatgttggccagtctagcctcaaactgctgacatcaggtggactgctggcctcggcctctcaaagtgctgggattgcaggcatgagccaccgtgcccggctgaagctggtaattaataaagaaaagaggttttgtcgctcacggctctgcaggctgcacaagcagcatggcacagcatctgcacgggtgagggccgcaggctgcttctcctggcaaaaggagcaatggagccacatgcacagagattacagggcaagagaggaagcaagaaagtgcgggggacggccagctctcaagggagctaacagagtgcaaactcactcattactatgaggatggcacaaaaccatgagggatcctccccaggacccacacaccccccatcaggcccgactcccaacacgggattgaatttcaatatggggtttagatatttggagtcaaatatccaatacatagcactcccaaaagatgctgaaatcctaatccccagtactgtgactgggacattatttggaggtagggttgtatggaaaaatcaaactgcctttcctcttctctcacaccacaagtgtcaacactcctgtgactcctgtgatgaacgggctgaggatttctccccgccagcaagtcggcactcagttctgcagcggcgccagctgggtgtcccccagtccagttcaattccagcatggtccatctgcagacagcacaagatcccacagggtgagggctcagtcccacaagacagtcaccacttttttttttttttttttgaggcagggtctggctctgttgcccaggctggagtacagtggcatgatcatggctcactgcaacctcgacctcctgggctcaagtgatcctcctagctcagcctcctgagtagctgggaccccaggcatatgccattacacccagctaattttttattttgtacagagggggtcttgccatattgcccaggctggtctcgaattcttagcctcaagtgattctctggcctcagtctcccatagtgttgggctctcaggcatgagccattgcatccagccacctgccaccacttctgatgccagtcacaagccccagctagttctgcctgtgcttctgactggctataaattgagattcttacccccctcaggtttgattagctggagtggctcacaaaactcagggcaacactgacattttctggatgattacaaagggtgttacaaaggcttctgatgaacaccagaggaagagactggtagggcaaggatggaggaggggcattaagcttccttgccctccccaggtgcaccaccctcaggaacctccatgtgtttagctatttggaagcttctccaactctgtcctttcttttttttttttgagactgagtctcactctgtcgaccaggctggagtgcagtggcgtgatctcggctcactgcaacctccacctcctgggttcaagcgattctcctgcctcagcctcccaagtagctgggattacagacatgcaccaccatacctggctaatttttgtatttttagtagtgacggggtttcaccatgttggccaggctgactcctccaactcctgacctcaagcgatccacccaccttggcctcccaaactgctgggattatagacgtgagccaccacgcctggccccccttttgggtttttatggagccttcattggctaagcacaattgaagctggacaaccatgtcgaagtgtgattggacaaaaacagtatgactcaacaccatcagtcagagtggtgaagccccgcaaggcctgtctgtatagcatttcttcctcctgggcgggaggctggactcctcctgaaatgggggtcccgtgaccctcagtcagacaaggcaggtcagagaatttctccacggccagctccaagatggaaaggtgggggaagattcaagtatattttcattttctatggcctgacttggggagaaaaaggagcaggtgaaaggagggaaggagaaagaaggtcagaaagagagagaaactacacctgaagcctgcttccaaagatccaacatgataacacaggactatcgttcccctttattgctctgaagctgtttccacactgcttcaggaaccaaggaaaaaagaacaaatattgtaacaaaagatctgcttattgctatagtcactgaggaaataacaagggtgatgggaattatgagccaggcatggtggaggaaaaccaatgcataaatatcatcatctcacagggtctttgcagatgatgaggtgaagatgaatcaccaggatgggctctaatccaacatgactgtgtccctgtaaagtctagactcacacacacacacacacacacacacacacacacacacacacacacacacacacacacagggcctagtagagacggaggcagagacggggcaatgcttctacaggccgaggaacatggaagatttgctggcaaaccccaggagcctggagagatgcagggaacagatttgcccgtgcagcctccaaatggaaatgaacctagcctacaccttgatttggatttctggcctcctgctgaaatcctaatccccagtacacaggggtattacaaggacacggtcatcttggattacagcccactctggtgacttcatcttcacttgatcatctgcaaagacccttgtgagatgatgatatttatcaattggttttcctccaccgtgcctgcctcataattcccgtagaccttgttatttctctccaaactgtgagagaagacgtttctgttgttctgagccctccagctcatggaactttgtgctggcagccccaagacaccccagtgtcctctccctgtctcttctgcctggtgggtcttctcctcctttactgaaaggaaaagggcatttgatccttgttccaggtcaaatgtcccttccctgcaagcctcctctgcccacagcacttctcccccaccccatccacatggtccctgtccctcctccatgctggccacgctacacggccactgtgtcctgtgcccacgttctccttgaccacaaactcctggaggacaaagctctgtgcccttggtcttcacgcccctggctgaggactgggcctggcaccaacttgaccaacagaaacatgtactgcactggggggactggggggcagccagcacaaagggagacagaaaaaccatctcaacccacacacccagagctgaacccacttctccccaggtgccgtcctctgctgagtgatccaccatggcctggcaggacacccagccttcactcctcctacttctttttttttattttttattttttttttatttttggagacagagtctcgctctgtcacccaggctggagtgcagtagcatgatctctgcccactgcaacttccacctcccgagttcaagcgatccttgtgcctcagcctcccaagtagcagggattacaggcatccaccaccatgccccgataatttttgtatttttagtagagatggggtttcaccatgttggccaggctggtcttgaactcttgacctcaggtgatctgcctgctttggcctcccaaagtgttgggattacaggtgcgagccactgcacctggcctactcctcctacttcttcaaggctggggcttctggctgtgagcatctcagaaatctgtttgcttttctcctaagtcaccgtccgcctgcctgtgccttctctgtctccagcacctgctgagcagccatcagccagaggcaacatctgtgacatcacagctcaaagccctgcctgggtatctaggctgggcatggtggctcacacctataatcccagcactttgggaggccgaggcaggcggatcacctgaggtcaggggttcgagaccagcctggccaacatggcaaaaccgcatctctactaaaaatacaaaaattacccggtcgtggtggcgtgcacctgtaatcccagctactcaggaggctgagacaggagaatcgctttaactcaggaggtggaggttgcagtgagccgagattgtgccactgcactccagcctgggcaacaaagcaagactacgtctaaaaaaataaaataaaataaaacaaaacaaaataaaataaaataaaataaaataaaataaaataaaataaaataaaataaaataaaataaaataaaaatagccctgtctggcagtcctcgggatgaagccgtttcctctgcttccaacacatgcgaggcctgtctcccctcctctcccctccctggcaccccacactgtccccagggcctgctcttctgctcacctcatggtaccggcctgcaagccatttcctggggcctccccgtcgcctcttccagaaacaactcctggaactccccttggaggtcaggccaatgacctgtgccccgcattgccctccatcctctaagcttcccgtgggtagggacaattcccagttctgaagggctccccctgccccgggcctggctcttggcagaagcttaacaacagaccggccacgttcgtgtgacctgattctctccggctttcaggacgtcctgaggctgcacccacgtggcaatggtgtctgtcgcgctgtcgcctggatccggcaccactagcggagccgagcagagcccagggctccaacgcgtagggaaaaggctgcgccgctcccggggtggccccacgccccttctctgagcttgagcggcggcgcgggacggggacggctctggccgggaccagcaggcctcgggcatccgggacgccggggccgcgctccaggccaggggcgggggcgggaccggggcgggggccggcggcggggccgcgccctcggcctctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgagggtgagtgcgcgcccgcgcccgccgacccccggggacctgcccggcggtgcccgccctcggccctagagccccacgaggccgcccccgccctcccccacgcaccccgcccggcccacgcggctgcgcgaccttcgggacaggccaggcctttgacccaggacccgtaaacaacggccgggacctggcgcgtggggccgcggtggcctccggagtctgccaaacgcgcgtgcgggcgcctgcgcggcggggacctcgggccaccgtgcggggcccgcgcctgctctgcctgccgggtgttcagctcttccctgggccagcggcatagccagccgcgcggggtgaccgttcattccatgagcagtgacgctcacgtgtgcagggcactctgggcagacacggcctgggggacccactactgggtgttgcgcgggcgccctgcagggtgcggggctcagggcgtgcagggctgaggcctgggaggcctgcgagcaagaattgcagagatcccattaaaaatttttttttttaaattttttactgcgtgtgctcacgaaacactaccaacctcgtacgttttaaagattgttagagttgcaagggatagtctggtgtctttaagtgtaccgcttgcccagggcctcctgggagatacattctggaattttctgcttgggtggggaggttctgccccgggaccatgccctatagtgagatttcggattggtgagaggtgaggggagctgctgtggaaaggcagatggagaaaggccggcctcaggtgggtccccgggaaggagccctcccatagcgggtatgcagtacggtttccttaaaccacctgggcctgacatatcccctgggaactcttcctgtgcctccagggattagtgtaccccgggatgcaggtcccccattcatttcttccctgggactcttgtattcctagggatgtgtgtgccccgggaagacatatgacagatttgcctctaggcatgtgtgtgcccccatgcacctgctccccaggatttttgtacagtgcagggaacgcttggttccccagacattttctcccagggatgcctgtgcccccagggatgcgtgtcttcccacccgtgatcctgttccaagagggcagggtcttgtccccttcagtaggtctcctggcggataggtcactcttctctcaagccttacactggaggacccactgtagcttgtattggtcggtgttggtcacgtctcctaaatgacatgattagtggctgtcacccttctatcatccccactgttcttccatgcagtcatcagcaccctcaccagaaatcatttcggttcctctttatggcttgcaacgattatagacgcaagtgacgctcccctcccaattcagcccacagcctgtggagcgcccgccatgggccaggtgctgcttagaccccaggaagaaaagagcgggggcggggtgcttgctttcgtggaacggggaatgaatacatagacaactggcgctgtgatgacgtgccccggagcacatagaacagggcgatcagagccaggggaggcctctgaggaggggacacttgagtggaggccagaaggaaccagaggaaaaagtctttcatagaatggcaaggaaccggaatgttctgggctattgcagctttttctaggtgccgtttacgctctcggaataggaagaacacacacccaaagtaatggactgggcccaaattccaaagtacgcagtgcttctcctccttgcctgtatgaattgatgtgtgtctagaaaattcaggcccagcctggtttaattcaaatgcaccaagaattccggtagcaggaagcatcctgtgctgaatagaacgggcgtggaggcaggaggaggagcaggacgccgggcactgctgatgctgctttcgctgggggtgagctgggcgccctgcctcggttctcagggttggggtgcctggcaaacagagggccacaaaccctccttggatctaggcacaggaattgagggacaggctggattgggaagggtttagcggcttctgtgtggtctcctgggaagtggaagagtcaggaagactggataatgagggcttgaataattgagagtcgctggtatttccgcaagcccatttgccttggcaacatgcgcttctgccactccagggtggagcagcccctggccctgactttgggccgtcagagctatgctcggttgcctaccagggagtgacagggcgcttgggaggtttccacgaccctgcctgctgcaccgtcggcttcatttcctcctttgttagaaagttgagggtggatttgggagaacggatgtggctccgacatgttcctgagttgaggactctaagggaggagggggaagctgggggaaggggcgggctcatcggtgaggttccagattcaggcaggggtgtgacaaggcacggagggacttttgggagggatggttgggatgagtgacgtggcctgttccagaggagaggggttaggaaatgtggggccctggggtttggaggaagcagtgcaggaagtgtctgagaatgagcttcacggtgggcgtgattaaggctgatgtgctacgggaggcgtgtcacgtggtggcctgggtcagaaaagggaactgtgaccaactgtgggcattcagaaaatggaaaggaacgccggaaacccccagggctccccacagaagctctggggacgtgaaaggacagcgtgtttcaaacttgggttcagctttactggggcttggaggagcccgtgtgcagagaagaccaacaacacacagggttccccactgtgaccatgtgatgagaggccctgtaggtccagtgggccaggatggaggtcggggacagcccagctgctgctggaagtcctcagaggcggatggccggccctggccagtgtggaagaggtcgggtggagtgctccacacatttgccacaagaggcctgttctgtgctgcaccaggcactggacctcaggcgccactgcccagtggccagggtcaggtttctcagagacagctgaaggcagcggggcgagagcagccagtctggaggttctgtccctcttttctgagcaacacattcaggaagtttctatcccctgattaccttaaaaaatatgtatgtgtgggccaggtgaggtggctcacgcctgtaatcccagcactctgggaggccgaggtgggtggatcacctgaggtcgggaattcgagaccagcctggtcaacatggtgaaaccccatctccagtaaaaacgcaaaaattagccgggcatggtggcgtgtgcctgtaatcccagctacttgggaagctgaggcaggagaatcgcttgaacctgggaggtggaggttgcagtgagctgagattgcctcactgcgctgcaggctggtcaacagagtgagactccatatcaaatagaaaaaaaaaccatatatatatatatatatatatatattcatgtgtgtgtatatatattcacatatatatattgacgtatatttttaaagcagttttaggtttacagcgaaatctagcaaagaatacaaagtgtccccacctatcccttctcacctccatcagtgccccccggctgtgtggtagagtcgtgagccaacgctgagacatcattatctccgcaagctcatagtttacattaggggttgctcttgccgttggacattctgtggctctggatggatgtagagtgacatggacccaccattacagtcacctctggagcagcgtcactgaccccagaatcctctttctgctgcctatgcatccctccgtttccccaaatccctggcaaccacggatcatttttttgttttgtttttttggtttttgtttttgttttttttactgtatctgtgtttttgccttttccagactatcatctagttgtgatcataaagtgtacagtagcgttttcagattggcttcttccactcaatgatatacattgaaggcccttccatgtcttctcagggcttggtagctcattccttttttgactgaataatattccgttgtctggatgtgccagtttgttgatccattcacctgctgaaggacatcttggttgcttccaagttttggcagttatgaataaagctgctgtgtacatctacgtgtaggtttttgtgtggagataaggttttaattcatttgagctcaattgctggatcgtatggtaagagtgtgtctcgttttggaagaaactgccaaactctcttccaaagtggctgtgccacatttattcaccggtggcgaacgagagtcctggctgctctgcatcctcaccagtatttggtggtgtcagtgttctggattttggaattctgttaggtgtattgtggtgtcttgttgctgtttcaattcgcatttccctgatgaggtatgaagtggagcatctcttcagatgcttatttgccatctgtgtatcttcttcagtgaagtgtctattaaggtcattggctcatttgtattttatttatttttatttttattttatttttgagatagggtctcactgtagcccaggctggagtgcagtggcacgatcctggctcactgcagcctcaatctcctggggctcaagtgatcctcatgcctcagcttctggagtagttgggactacaggcacataccaccatgcccagctaatttttctattttttgtagagatggggtctcgctatgttacccaggctgctctcaaactcctggactcaggagatccacctgccttggcctcccaaagtgctaggattacatgcgtgagccacagtgcccggccttggcctatttttaaatctgcttgtttgtttccttactgttgagttggaagtgttcttcatatattttggatacaagtcatgtgttttgcaaatattttctcccagccagcggcttgtcttccctgtctcttgatcctgatatctcctaagcatttgatgtagagttaatgattaatgagcaagatattgagacctcatcaactagatctaaagaaatcactaggccagacacataatcccagcactttgggaggctgaggcaggtggatcacctaaggccaggagtttgagaccagcctggccaacgtggggaaacccggtctctactaaaaatagaaaaattagccaggcgtggtggctcacgcctgtaatcccagcactttgggaggctgaagcggcagatcacctgaggtcaggagtttgagaccagcctggccaacgtggtgaaaccccatctctactaaaaatacaaaaattagccgggcgtggtggcacacacctgtaatcccagctactcaggaggctgaggcaggagaatcactcgaacccgggaagcagaggttgcagtgagctgagatcgcgccactgcactccagcctgggagacaaagcgagactctgcctcaaaaaaaaaaaagaaaagaaaagaaatcactaggtagctgcgacattgaactgaaggttgaaagtattaagtttctttgtggactttaaataaccttcaggagagaaatctcaaagctctaaaccagcaaccgagaatttccttcagggcatccatcttttacacggagccatcagttgtgtagatgatgggttgccccaaaacactaagacgcaccagtgaagggaggggagctgtggcaggggggcctgcactgcccccgcctttccccccagcaacgcctgggctgggagctgggggtgggtgagaccctggctcaggccccactcaggacagtttgagggacaggcagatggggggactgagccatgggggtctcaccacccagacttggggttttgggcctccctggaggaagtggtcctggctgaatgtctaggatggatgtaaattagcccagggagggggagggggctcctgaggagacccccaggcaggctcccagtggctgagcaacggtgcagcctgtgggctgtggccagccctggtcgggggctggagaggtgagcagccctggcgtcccacaaacacaggagcttggaacccttgctggggcttggcaggggtggccgatttcagtggtgctttggggagtggggaatggacggaatgggggaacggcggggaggcaggctggcaggaatgtggcacggggcacaggcagtgccccgaggaggtggcgtgggtgggcgcaggcgtggctgtgatttccacgctgttttctagcgggctgcagcccctctgatgctgaaatgaaaaaggacccagatccttgtttgtgggaggggtgggaaaggatttgcaaggagtgtggtctcttttggacgatttttcagacttcttctcgtttccaggccctctgtgctcacgtgacccctctgatagcgtcagggcccgtagaaaagtggctgtggcatgttgggaaggccagcgggcctcctagccaacgaaaagggggagtggctggtccgaagttgggggatatagacaggtgagggaccagggccatagtcactgtggtttctatggggaagaggggatggtggaggtcctatttggagctgttgtgttgtgaggctctttacagaccctgccaacaaagagaaagacaattccacactgttatctctaaacccaaacctccttcgagcagaggccgtctccgtttggggatggacagctgttggtccaagaaggaaaggcacagtgaggtcactgcgacgctgcccagcaccttcatgggaaacgctcctcagggtggtgagtggaactccctggagaccattttccagtgagggcctatctctttcctcttgggctgagaggaagtgggtggctcagctacatttcctttgattattattctgactataatcttcaaaccctacatttctcattgtgtgttccgcccatgcgttctgttgtccggggcagcaaagtcgacctgcaccacgtgggtgtttttgttttcttttgttttgttttgttttcttgaaggcctactaagagctgtcggaaactctgcttctgtagaaaaggtaaaggcactgcttggccacaagtgatgactcttccctgcctttcggggcttggggaggaagggcaggttctcggtggttctcctagcaccttggttacaaacctcccagcagagtcagatcaccttggcaaccccacactcatcaaagggactctgccttgattccctccccaccgctgtggaattaatatcgattgcacatcctgaaattgcttaccctcgcgctccctgtccagtcgtcagaataattaaggggtgtttattggatgtaagtgggttcatccctgctgcgagtatggattttaagtgctccgttggattgattcctccctgctgtggttggcacagggcaggtacctttaccgagctgttttcttcttttcgaacatgcggttccatcacataaaagacataccctatgaaaatgtctctgccttagctgtacatgttacactttaggtttcaggtgaaaaattggtttatctcctaatatgtctgctatttgttacatcacatagaggctgcaaaacagattaataagctttggaggatattataagcatacgttggcccaatggtattaatttgcttatccatactaattgctgtcttggtaaaagaaggcggacacaatgcaatcaatcctagaagtgttctgtggctttgcaactttgagatacctcaggctgacatattcaaatgagagccttctctctggttacaagaaaaaaatggaatgagcagcagttttggcctcgtccagtctctagggctcccagcatctgggtagtaacatgatcagccctgggaaaccagcggagtcttttacctcctctgatgttctgactaagagtgtctgggccgtggggactgaacgcaccctttgaggctatgtgtgttaaagtttgggggcccatttcttcatttctaatatggggcagtgtgggcagatcccagctctgcgtttctgagctgctgagtttgccctggttctgagaatgcccgtcgcggtggtgcagtccgcctccttgcactggatctgttgcttcttctctctaagcctctgttcctgatggtcccttgtggagcaaagcagcacttgtggtgtaaggaaggaaagcctcatcagcaattgagtgagcgctcaatcagaattcgttatggatgaatgtggatgactggaggcattgacgcagacaccagagtccagagctggtacgtggtacagcagaagtggcaagtcagctcagtttaggacaagtacctaaccctgtgttgagaaggattctgtggctgagtctgggcttagggaaaaagaatgctgggaccagtcagccacactaccagtgtgtatggagggttagttgctgagtggctgtcacccccagaacaggagccttttccagctctagtgctgtgtcatttcagcagcactggctgctttattcccattgagtgccgtgcaacagctagttggctgttggtaacaaaagttgtgtgaatcgtttaagatattgcagtgagaatgttggtatcttaactcttcccctagctgtctgtggctaggaagcatctccagtgctattgtttttttcttgagacagagtcctgctctgttgcctaggctggactgcagtggcatgatctcggctcactgcagcctctgcctcctgggttcaagcgagcacatccagctaattttttatatttttagtaaagacaggatttcatcatgttggccaggctgatctcaaactcctgacctcaactgatccgcccacctcggcctcccaaagtgctgggattacaggagtgagccaccactcccggcccccaatacttttttgaggtatacttggctgagtaactgtttagcgtgtgcagagaagcaggtgtttctgagctggaattccttgtacccagaaatgtgagggcaactcacatgggcaccaggaggcatttttgccttcctcaccagcctacggcatcagagaacatttggcagtctctgagtgggagttctttacgcttgcctgatagtagttggaggcctgctcctttaagctttgccacttgaagtgatgagcttggttttggcctttgaacctttacctgccagccacccacaatcagtcggtaatgttggtttccccaagcaacgccatcttaggaatttctttgcttgttctcttacaaagtcatgcattattatacgtgttttcatttgaaaaattacagttccacaggatctagacttgaatgttaagctattaaaaagttaaagagggagtgaaaatgttagcactcctagggcctgcgtacgttgcttgctcaaatccagacgctcctggaagcagctgtctcagcggagccctgtctgcccttgttgttttctgcttctcaagttactccagactccagggaactagaactgaccaggccccactttaaacatgtggatggagtgcccctgacaaggctggagaaagggggaggtccggggcggggcctcatgcgcatatggtattcagagtttatttttgctataaatggaatttgaagaatatatatatatatatgaacatacaaataaaaatatataaagaatatatgtataaagaatataaagaataattttggaattcattgcattgtgtctgcattcttttactgcaacagcaattataattataattatattataaagaatatatattctttatacatatatatttgagatgggtgtctttatacatatatatgtttgagatgggtgtctttatacatatatatgtttgagatgggtgtctttatacatatatatgtttgagatgggggtctttatacatatatatttgagatgggggtctttatacatatatatatgtttgagatgggggtcttgctgtgttgcccaggctggagtgcagtggctgttcacaggccagatcatcagacactgtagccttgaactcctggcctcaagggatcctcctgccttagcctcctgagtagctgaaacaataggtgcacaccaccatgcccagctcttgagaagcatctggcccatagcttaatttgaagtgtcttcatccctgtcttttttctttttgttttaaaattaatagaattgacccttgaacagcacagggggaaagaggcactgacccccatgcagtcagaaatccacgtgtaacttttttttttttttttttttttgagacggagtttcgctcttgtcactaggctggagtgcagtggtgcaatcttggctcactgcaacccctgcctcccaggttcaagtgattctcctgcctcagcttcccgagtagctgggattacaggcgtgcaccaccacacccagctaatttttgtattattagtagagacagagtttcaccatgttggccaggctggtctcaaactcctggcctcagttgatccgctcacctcagccttccaaagtactggtattacaggcatgaacaactgcacccggccaccatgtgtaacttttgactcccacaaaacttaactagtgatagcctgctgttgactggaagcctcactgataacataaacaattaacaatattttgtatgttctatgcattatgtgctgtattcttactacaaagtgagcctgaggaaagaaaatgttattaggaaaatcataaggaagagaatatgcatttatagtactgtgctgtgtttattgatgctgcacgtttacaacatgcgtttacaagatgaatgctctgaagtggccggcaactgcagctgcagacctcaccctaccatacaacatctcaagctattcagcttcttggaatgtcacgcttttcttcttttctttttccttttttttttttttttttttgagacggagtctcgctctgttgcccaggctggagtgcaatggtgcgatctcggctcactgcagcctccgcctcctgggttcaagcgattctcctgcctcagcctcccaagtagctgggattacaggcatgtgccaccgtgcccggctgatttttttgtatttttagtagaaatggggtttcaccgtggtggccaggatggtctcgatctcctgaccttgtgatccgcctgcctcagcctcccaaagtgctgggattacgggtgtgagccaccgcgcccgtccgtcaaggcttcttgggagcacttacagcaacacaagtggtgctttgtatgagtcccatagtgttattcagggtttacggtattgcactaaacatgatgaaaaatacgtgggaacccaaacagatcacttttttttttttttactatgatatggaatttactggagcggtgaactgctcaagtggagataattaacatcaaataatgttctaagcaatgcaatagcaacaggaggcggctactattacagtggtgcagtatggactgcagttaattttatgcagttattattgaatactgcatcttggctgggtgcagtggctcacgcctgtaatcccagcactttgggaggccgaggcgggcggatcacttaaggtcaggagttcgacaccagcctggccaaatggtgaaaccttgtctctactaaaaagataaaaattaaccaggcgtggtggtgggcacctgtaatcccagctactcaggaagctgaggcaggagaatcacttgaacccaggaggcagacattgcagtgagccaaaatcatgccactgcactccagcctgggtgacagaatgagactgtctcaaaaaaataaaataaatacaataaaataaataaatacataagtactgcatctttacatttgtttacatttctctcaactgtgaacacagtctgtgtgtgtgtgtaagttttgatacattttaactttttatagtagatttgtatgtattttatggtggtaaatgataaaacagatgagtatctacatatattttatgcatttgtcgcatatctaactttttcttaatttttaaaaatatttctgggctacgtggtttgcagttttttcaaattgtcacaaatctccaaaaaattttccaatatgtttattggaaaaaatctgcatgtaagtggactcatataattcaaacctgtgtttttcaagagtcaactgtaatgtctttcaaagtaaaatctaaatgagtttatacttgatatatataagtttaatagaaggagtgcgttggctcatgcctgtaatcccatttctctgcgaggctgagatgggcggatcacttgagctcaggagttcaagaccagcctgggcaacatagagagaacccctttttattaaaaattaaaaaaaaaatcaatcaggcgtggtggtgcacgtctgtggtcccagctacttgggaggctcaggtgggaggctcaggtgggaggctggcttgagcccaggagatcagggctgcagtgaaccatgattgcgccactgcactgcagctgtgtgacagagtgaggccctgcatcaaaataataatcataataaagataatctgagaagtgagggtaaaagttaaaggaagattaaaaacaaaaaaaaaatgcttataatcccagtactttgggaggccaaggcaggaggatcgcttgagcccaggagtttgagactagcctgggcaatatagtgagacctcgtctctgcaaaagaaaacaaaacaacaacaaaaaaagaaaaaacagctgagcatggtggcacatgcctgtagtcccagcctggccaacatggtgaaaccttgtctctaccaaaaatacaaaaattagccaggcatggtggcttttgcttgtagtcccagctactcgggaggctgaggtgggaggatcgcttgagcctgggaggtggaggttgcggtgagctgagatcgtgccactttgctccagcctggatgacagactgagaccctgtctcaaaaaaacaaaaacaaaaacaaatcagaatggagcttataataatcacaccgtagctaagacttgggcactgctgatgtcccaggtgctgtgctagatgcttcctgcattattaccttgtttactcctcacaccaagctgggaagtcggtgttatgtggttattcccattttgcagatgggcaaacacaggcttagagaggatcgaggtcatcctgccagcaggtgagatttaactccaggcagtgtggctcttcattgccgctgaccctgcttaaactggaagaatgattcagatgggagtcatcttcccagctggctcctagtaagctgatgtcattcctggcatttaagctgcacccagccccagtgttaggaagacgcgctagaggagacacattagatcctttttgtgctgaatgaacttgttggtgtttataagaagaagacagaaccctagtggcttcatgctactccaggaccaagtccagattctcgccagccacccagcgcctgtccagcccagcccagcccagctccagctccagctcccaggtcttctcccttggcctggccatggggtcttcgtttgctttctgtgggtcccatgatcttccttggctgaaagccctcacgtcccctgttctctctgatctgacaactctctgccctgttgacttaaatgttgcacctccagcagggtgggggcccctctttgcccattggcaccatcatgtccctgcattcctgtttcaggttgttggcacagttcctgtcttcctggggtgtggtgcattcccatttcactgggagataatgatgaccatttacagtgatctttgtgtatttgcccagcaagcaagaggcagtctagtgtagtggttagggtgactgctcttgaggccagactgcatgggcttgaactgatctttctgggccctggagctgtgaccctggggaaggtacttccccacgctgtgcctcagtttcttcttctgtaaagcctacttaactcatagggtcattagagaattgagtgagttattaaatgaaatgatgtacttaaaactggacctggggccgggcgtggtggctcacacctgtaatcccagcactttggaaggctgaggtgggcggatcacttgaagtcaggagttcaagaccagcttggccaacatggcaaaaccccatctctactaaaaaatacaaaaattagctgggcgtgatggtgtacgcctgtaatcccagctactcgggaggctgaggcaggagaatagcttgaacccaggaggtggacgttgcagtgagctgagatcacgccactgcactccagcctgggcgacagagtgagactccatctcaaaaaccaaaaaccaaaaaacaaaaaagctggacctggtcaagccatcgagtgggagaaaatgtttgcaaaacacatgtttgataaaagactggggtccaggagatggagagaacttccgcaactcaagaataaaaacacagtcaacgcagtaaaagaatagatagataaagggtttgaacagacacgtcaccaaagaagattgacagatagccaatatgcatctggaaaagtgctccccgtcaccagccacctgggaaatgcacatgagaagaacagggaatgccccgcagacccatgggaaaggctggaagatgtggtgagaataggacagctgctactcactcaggctggagggatgtgcagtggtgtggcccctcaggaaatcagcttggtagtttcttttaaaatcaagtaaccatccttcctatgacccagcaattccagtaaatcttagatagatttgctcaacagaagtaggaatctgtggctgagcacggtggctcattcctgtaatcccagcactctgggaggctgaggcggacagatcacctgagctcaggagttcaagaccagtctggccaacatgacgaaacctaaaaatataaaaattagctgggcgtggtggtgcatgcctgtaatcccagctacttgggaggctgaggcaggagaatcacttgaacccgggaggtggaggttgcagtggcagtcaatatcgtgccactgcactccagcctaagcaacagagtgatactctgtcaaaaagaaagaaaaaaaaaaagtaggaatctgtaagaagactcttgtacaggaatgttcatagcagcttcattcataagagctggtacttggaaacagcttggggaccatcagtaggtgaatggatacacggacagcagtaattgacaggacggaatgatcctgggcagtgtcaaggaacaaggtgccggtacaggaaatcacccgagactctcaaaaccactatgctgagcaaaccaagacagaccaaaagagtacacactgtgtgatttcatttcatttcatttttttcaaagatgagatctcactctgatgcccaggctgaagtgcagtggtgcagtcatagctcactgcagcctcgaactcctggcctccagtgatccttctgcctcagcctcccaaggagcgaggaccacaggtgtgtaccactacaccccgctaatttcacttttacaatgttctacagcagacagagctaatctgtggtggttgcctctggggctgtgggcaggagttgcttggggaggagcaggagggattttctgttgttatgaaaatattctttacagtgagagtggtttgagatacgcaggtgcagcatttgtcaaaactctgcatgtgtactttaaatttgtgcatttcatggcatgtaccttttaactccaaggaaataaaagaactataaataaatactgaactctaattagtgatgtgtgtgattagagggaaaagtactgatgtctgcaacttactttgaaatgtgttaaaaaaagatgatatggtagactgaatagtagtaccaaaaatgtctatattccaatacctggaaactgagaatatgttctcttatgtggtcaaagggaatttgcaggtgtgattaagttaagaaccttgagatggaattagcctgggttatttgggtgggcccagcgtgattaccagggtccttatgagaaggaggcaggagggtcagagtcagagagaagtgaccatggaggtggaagttgcaatgatgtggggccaggagccaaggaatgtgagcagcctctgaaagctgcaaaagccaggaaattgatttcctcctggagcttctagagggaatgcagccctgctgacaccttgattttagccagtgagacccattttggagtcctggcatccggaaccacaagatagaaatttgtgtcgtatggaggccgggcgcggtggctcacgcctgtaatcccagcactttgggaggccgaggtggacggatcatgaggtcaggagatcgagaccacggtgaaaccccgtctctactaaaaatacaaaaaattagccgggcgtggtggcaggcgcctgtagtcccagctactcgagaggctgaggcaggagaatggtgtgaacccggaaggcagagcttgcagtgagccgagatcacgccactgcactccagcctgggcgacagagcaagactctgtctcaaaaaataaaaaaaaaaagaaagaaatttgtgtcgtatgaagtcccacagtttgtgggaattatttccagctgcaattggaaatgaatgctgatggattgctggatagatagagggatggacggatgtggaataaaacaagtatagacaaaggtgggtggtggactgtaggctgtgggtatacaagtgttcacttcaaactttacttggctgggagtgggggcccatgcctgtaatctcagcactttgggaggccgaggcgggtggatcacttgaggtcaggagttcgagaccagtcttgccaacatggtgaaactccatctctacaaaaatacaaaaaattagctgagcacagtgacatatgcctgtggtctcagccacttgggaggctgaggcaggagaatcgcttgaacccgggaggtggaggttgcagtgaactgaaattgtgccactgcactccggccagggtgacagagcaagactccctctcaaaaaataaaataaaataaagttctttagatgtttctatgtgtttgaaacttttaataatgaaatactggggggaaatgactgggcctgatacataataaaagccctacaggccaggcacagtggttcacgcctgtaatctcagcactttaggaggctaaggcaggaggattgcttgagcccaggagtttgagaccagcctaggctacatagtgagaccccctctctaccaaaaaatagaaaaaaatagccaggcgtggtggcccatgcctgtggtcccagctaccccggaggctgagggggagaatggcttgagcatggaaggctgaggctgcagtgagtcgagattgcaccactacattccagcctgggtgacagagcgagaccctgcctcaaaaataaataaataaataaatacatacatacattcatacataccctacataggtgtcagcctttgttctcattggcatctcatctccattcttattgccaccacggccactcccccactttatccatcaggtggagaagaggcctgggaagagaagagaccaggggctgggttggtggtgagcagacgaaataataaacatacaatgaggccatatgacatattgggagaattgctttcacttaagaaaatctaggctgggcgcggtggctcatgcctgtaatcccagcacttttggaggccgaggcaggtggattgcctgaggtcaggagtttgagaccagcctggccaacaagtgaaaccctgtctctactaaaaatacaaaaattagccaggcctggtggtgggtgcctgtaatcccagctgctcaggaggctgaggtgggagaatcgcttgaacccgggtggcggaggttgcggtgagccgagattgtgccacttcactccagcctgggtgacagagcgagactccgaagtgaaggggctggggctttggaactgtagaggctcatctccccagtaagctgtcacttgtgatgtggttacagctgtaggcatttgcagagatgggacgagaagacacgccaccctgggaactggcccgtgtcttcacacgtcctgcactgctgctgctgagaacgtctgcactttgttaggggaagagagtgttttagttaaatttatctggaaaacatattattagtataatgagattttaatgatttgaaattttgttggagcagcgcagggagaatttcaatcttaactgtgtgtgcagctgggcattgtttctattttattttgtttctttgcttgggcctcattgcaaggacatgtttctacaattattatttagtttttctttcctagagccctgctttgttacagctcttaattttcttgtgtagaagatctgctggagaaaaaagaatatcctttttgtaaatacttagctggcttgatcagaaccagagaatgagcgttgttaccgaaggagacttgtgtttgtttaaggtttactggcgcactctgtggttgccgtggagtggacccaacccagatgtccgttaactgatgagtggataagcaaactatgctccatccatacgatagaatactattcagcaacgaaaaggaatgacatatggatccatgctacaacatgggtgaatctggaaaacaggctcagtgagggaagccatttgcaaaaggataaatactgtgtgattccatttatttgaatatctagaataggcaaattgatagagacagaaagtaagattagtggttcccaaagcctggggaaggtacagtgacccctcatgggtacagggattattttgggggtgacgaaaatgttcttacattgacaatggtgatggttacacagctctgtgaatttactaaaaatcattgaattgtacacttatttatttatttatttatttattttgagacggagtcttgctctgtcgcccatgctggagtgcagtggtgcgatctcagctcactgcaagctccgcctcccgggatcacgccattctcctccttggccacccgagtagctgggactacaggtgcccgccaccacgcctggctaattttttgtatttttcgtagagacagggtttcaccatgttggccaggatggtctcaatctcctgaccccgtgatccgtctgcctcagcctcccaaagtgctgggattacaggcgtaagccactgcgcccagccgaattgtacactttaaaacggcaaattgtatggaatgtgaattctgtctcaataaagctggtaaaaaaaatagcgtggtactgagaggcagcgctcagagcttgtgagatgtttttctccagttggtattcgttgcatgtttccaaggtgagatctttcaccttggggtgagggcgggtggatccgggacagacatggaattttcagtcttcctcctcctcctcatcttcctgttcattgcccctgcagtggtggcagctgtcccatatcaaggtctcacactggccaggggctgggcttggtgctgtacgcagattgtcttattaggactatgaggcttttgagataggtatgataatatgtcctcattgagcaagtgacaataggaaacccccagaaattgtgtgcactgttttgcctgatctcacacactttggacagagactttgatcacattcttaggggcccacaaatggtcaaaaacctctgaactgagacagcagcattttttgtggtttttttttttttttttgagatggagtctcgctctgttgtcaaggctggagtgcaatggcccgatctcggctcactgtaagctctgcctcctgggttcacgccattcttctgcctcagcctcccgagtagctgggactacaggcacccgccacagtgcctggctaattttttgtgtttttagtagagacagggtttcaccgtgttagccaggatggtctcgatctcctgacctcgtgatccgcccgcctaggcctcccaaagtgctgggattacaggcgtgagccaccacgcccggcctgttttgtatttttgagatggaatctcgctctgtcgcccaggctggagtgcagtggcatgatcttggctcactgcaacctctgcctcccgggttcaagtgattttcatgcctcagcctctagagtagcttggactacaggcatgcaccaccacacccagctgatttttgtatttttagtagagacggggttttaccatgttggccaggtgggtctcaaactcctgacctcaagtgatccacctgccttggcctcccaatgtgctgggattacaggcatgagccactgtgcttggcttgggagagcaacttttaaactctctttttattttggatccatggtaagaaatatatttccataaaaaccccagttcaagcatacatttacctatatccatgaataaaagtttcatgaaatgatatcttcctataagcacactgacgtttgctactctactgttctttcatttcattaaagaaacgtgctgtccaggcaatctcagtactttgggaggccgaggcaggaggattgcttgagcccggtggtttgagaccagcctggtcaacatagcaagaccccatctctacaaaaaataaaattagtctggcgttgtgttgtgtgcctgtggtcccagccacaggtgcccctgcaggggcagggggctttcaggtgggaggatcgcttgagcccaggagtttgaggctgcagtgagttatgattgcaccactgcactccagcctgggtgacaaagagagagtctctgtctaaataaataaataaatacatacatacataaaatatgctagtcacagtttcctaaatggattttatgactcattgagtcaaaatgatagttttaaaatgttgctaagagagatgtaaggaggaaaatgtgttggtgagtgttgaggagcccaacttcttttgagaaatcattgttggatctggtgtctcatgtgttaccctggggtttcaactcctgtttgctcattcagttattcattgatcaccctgtcttccaggcatgcagtcattcattcaaggtgattattgagctccccttgagagcaggtatggggctgggggttggagatccagtgagtggtcctgcttgagagactggccctgcccacatggcactagtgggctgggactctcccatcactcttgtctccatcttgttgtgcactgttgatgctccattgaatgatcttggcatctttgctgaaaatcagttgatcatcaatgtatggatttatttctgagctttcaattctattatgttgatcaacaggtctgtctttatgttagtactacactgtctctatcactgtagctttgcagtacgttttgaaattggcaaatatgacacttcccactttgttcttcaaccttgtgttggctatttgggatccctcgagattccgtatgagttttagggcgtgattttctatttctgcaacgagccaccattggaattttgggaggaattgtactgaatttgagaattgctttgggtagtatctttaacaacacgaagtctgccagtccatgaacataggatgtctttccacttccttaagtcttctttaatttcccttcgcaatgttttgtggttttcagggtacgagtctcttgcctctccaggcagatttatccctgggtggcttatgctttcggatgctgttgtcagtgggattgttgtccttgccagtggtcgctgagcccagctgcagccttgtcttgcactgcagggtgtctgtgtcacctacttgcctagttctggccacttttcttgcaggaagtcagaagtgtactgatctggagtaggacccttagcacaacagagctgctccttggtgctaggagatgcgtcctgaggctggccatccatgtcagaggacctggcgcctcaccctcatcatgggatatcactgaccaccagtgggggatgcatctctgctgggcttggcctgcaaggtaggagctgactgcaggagtgggaaagagcccatggcccctgagggggcctacagttggctctcctgtggttacttggcatgtttgatagacgcctgggtctggcacagagaacactgcccgctgacaatcattgagcctcggcaggctggccccgatgacatgttatctccccacacagtccctggacacacttgattaaaggtgcttattactttcatagtgttggctggagtgatgtgataactccacaaaaggttctggcagaatcccagaccttggggtgttcccaccagtgtctctgtgttcaaagttcagcacagtgtggggtggcaggagatgggaacttggagactgaggccagagtctgctgacttgagcctctgctgaggtccttatcagtgccgggagagcagcagcctaatctcaagatggtttagaggatttagcgggggcgtgcatgcagagttgagaactggctcctgggtcggtgtgcggggggtggggatggcccgggggccgtagctacagtttgtcttccttcccccaccggcagaggtgaagagaggtgttttgtcctggagccaccaggcctatccatggaggagcagagcttcacatggagcctgtgccccgtcttagtctatttcgtgttgctataaaggaacactaaggctggctaatgcataaagaaaagaggtttacttggctcctgtttctgcaggctgtacgtggcactggcatctggttctggggaggcctcaggggcttctcctcatagtggaaggtgaagagggagcaagaaagggagaggaaggaggtgccatgctcttttctaagaaaacagaaacacagctgcattattttaagcaaaacacatattggcttaggtcgctgtattcatctcccagggctgtggcaccaaggcaccagacactgggtggctctttgggaggccaaggcaggcagatcacttgaggtcaggagttggaggccaggctggtcaacatggcgaaaccccatctctactgaaaataccaaaattagccgggcatggtggcatgaacctgtaatcccagctatttgggaggctgaggcaggagaatcacttgaacccaggaggcggagtttgcagtgagctgaaattgtactattgcactccagcttgggcaactgagccagactccatctaaaaaaaataaaaaataaaaaacccagcagaagtggattctctcacagttatggaagccacaagcttctaggggttagaattccaacatatctttttttggggaaagaggggcataattccccatagaagagcctgtaatctcagggagccttgacccaggtatttgacgttggtgtaatctacttgtgtatgtgtattggtggacaaaggggatggcctcacatcccttcagcatcttgggggtgggcggtgcctcccctccggctcccctgagtcagccccggggaagaccaattgtggggctggatggtgtgggaacccccagctccgtcctgtctccagccatcagtgaggtgtgcttggccattccccacaggaccagtgggcgggatggggcagctttgcagttggagaggatgggggttcaggcaggcagaacagatgcgcggacacagaagagctgtgcagaatgtggagttgagcttcctggaaggcccataggagaggcgagactgaaatcttcttgatactttttcactggggcctgaaagcctggtgcagaatgaaactgaaagcacttgtctcgttgagcaaatcattcaactttgttatttctgtaattgaaataattcctggcattaattatgtggagagcactcatgaccatgtggacatatcttttgggggcacatgaactgagggtaataatttcgctcgaattttttttttgagatggagtcctgctgtgtcgcccaggctggagtgcagtggcgtgatctcggctcactgcaacctccacctcctgggttccagcaattttcctgctctagcttccccagtagctgggattacaggtgcccaccaccatgcccggataatttttatattttttaattttatttttatttatttattttttgagacggagtcttgctctgtcactcaggctggagtgcagtggcacaatctcagctcactgtaacctccgcctccaggcttcaagcgattctcctgcctcagcctcccaagtagctgggatgacaggagtccgccaccatgcctggctaatctttgtatttttagtagagacagggtttcaccatgttggtcaggctggtctcaaactcctgacctcatgatccgcctgcctcggcctctcaaagtgctgggattacaggcatgagccactgtgcctggcctaatttttgtactttaggtgggatttcatcatgttggccaggctagtctcgagctactgatctcaggtgatctgtccactttggcctcctaaaatgctgggattacaggtgtgaaccactgcgcctggcctatttcactccattttgccgaggagggaacagaagtgtggagtcctcccagccacatggcctcggatccgggctgcaggtccaggctttccggctccagggctggtgccctctgtcctgtgccacttcccctgcaaaatgagatgaaaatgagtctcattttacgatgaggaaactgaggccctgagagagggtgagaaaccaggtctctggctgaatgcacctctcactgaagacatctccgggtggaaatgttctgagagctgctgtgtgtgctggtgtcagaatgaacaatacccatagtgcttggcgtagacaatcagcaaagctagggacccgttttctcctcccagccccctttctcacttcaggccctagacaagaatcggaggtccgtttctcaagtttagctcctgtctgattaaatttgaggttcgtttctcaagtttagctcttgtctgattaaatttggatttgctccactctttttcacgggcataaaaatatctgcggagtgaaaatgtgtgcagaggatgcactgcgtgcaggctgcggctcgaggtcaatcagattcctccagcgataaaaggcctgctgaggaagcggccccactcccagcacagccccattgattggcttttattttcctctgttgctggagtgatccaatttgaagccctgtttctgagcatgttgcaaggaaccctaggggctgccatagccctggagatactggctggaaatcaaattcaaattggtgctttcttcctattaaagcaggagacctctgcccgggaacgggccatttgggggctcagccatctggcacatggagtgagtaggttttattgccaaagccgtcccggccttggcctcagcctctgtgtggctctggtggggagtgtgtctcgatgttgtactgtgaataagccccatgcctacttgagtttggggtttctgttttacctacacttccatattgtgggcatgtggctgcggaaatgtgcctgcacctggactcgctgtcactcactggcttctcgtggtacagcctagggagggttgccccagccgtatttagttcttcctgcctcagatgaacgggcctcctctcccagctcctaatcaggagggcagagtctcgttggcggctctcctgtcctgctgccactgcctttacacttcttcagatatgcggccgtcttaaggtgtaaatgccttcctctgtttcccagtggttatctaaagcaaggattggcaaacagaatccacaccatagatttgaggtatgtttgttgtcctctttccttcttaaactgttagtaaacaagacattcctacaggtgacccctttcggcctttttttttttttaagactgagtttcgctcttgttgcccaggctggagtgcaatggcgccatctcagctcactgcaacctccgcctcccgggttcaagtgattctcctgcctcagcttcccaagtagctgggattacaggtgcctgccaccatgctaattttgtatttttagtagagatggggtttctccatgttggtcaggctggtctcgaactcctgaccccaggtgatcctcccacctcagcctcctaaagtgctgggactacaggtgtgagccactgcgcctggccagtcctgcactcttcaagtttctatgtgttgcagactggtggggtagcaatatcagttagagagacaggactggggtcacttgtcccctgttagctcagtgaccttgagctcagcttagacacattgtctctgaacactgtgctgatggcaacacctctctcacctgtcttgcagtcttatttgaggaattaaatgcaataacctgggagaaagtgcaggtatgaagtcagggcacacagcccgtcaccaggagcttgaaggaggagaagagtgggtggggatgtgagcacagaagctgaggcgggggctgagccgggtgtgtatttctgcctgtgccacagggacacccctttcaggcactgggcgcctagctcctgttgtctcatctcctaagagagtctcgggaggcctgagactccctcactgctgcgggcttcaagagcagcatctgtgctgagtaacagccatgggggcagaagcagagatctcccgtgacagagtagttaggcagccgtaaaaatcctaccaccagctcgtggaaaaggtctcatttgacaggtgccatgccgtcaaagacttgtgctctgcagctgcaaattcccaactgaaaaatatcaacaattcttacgaagagagaaggggagccctgcaaagctgttgtgtcaccccgtctgtttgtaggcgctggggggattgatgatgaggtggggactgttcggctggccacactgccattgtagatagcctgtgactctgtggctggcgcctggctggcctcagtgaagcccttcagtcccagctctgaccatgtctctgtggagagacaagcaggtgatagtgttgggtgggcaaggctgtgctggtggcctgcttagcaacagcaggaaaaggaaggagataaccaccccaacctttcttgctggaaggagcccttcctgttgtcggcgctgtgtgtaaccaatgaggcgaatgccgggaagcgcttggtttgtgtcaatgaggggagaggattgtgcagaagtgcaggaagggaccatgggaggaaattgagtgaaggtctctgttaggggtttgtgttcccctaaaaggtatgtccaggtcctagtctccagcccttgggactgtcaccttatttggaaatagggtctttgcagatgtgcttaagacgaggcctgtctgaagtagggtgggcccctaattcaatgtgactggggcctttatggggagaggaggcaggacacagacagacacgggacacagaggctggacagagattggagagatgctgccacaagccaagatgcaccgaggactgatggccaccaccagaaactgggaagaggccaggacggatcctcgcctggagccctcagtgagagcacggctctgccgacaccttgatctcagacttctggcctccagaactgggagagaatcgacgtctgttgttttaagctgccagtttgaggtactttgttaaggtggccacaggatgcgaatacagtcaccatctggcctttgatcttctaattgcctcggcggttctcctgccagtaagggttgtgagtgaaacttgaaggtcacagttggaaatcaagttaaaagaattaagctggaagtgcaacatgagagtccgtcaccctgagaggcggtgtgaatgccaaacacaggcaggcagggctggacctgcataaattgtggttcgacagcaccgggagaaagaaggcccgggcctgctctcctcacctgattctgggaatgccgaacctacctgtgttcctgatatcaccccagtgctaacttcccaccccttgaaaatgtcaaaacattgtgttatgaatgttcttcattgagcaactgcgatctctttctgtaaagatccagagaatatttcagcctctgtgagccatcctgcctctgtaggaatgaatcaactctgccttggaagcatgaaagcccctatagacagttcataagcatagccgtggctgcgtccccctgaagctacaaaagtaggtggggggctgggtgtggtggctcatgcctgtaatcccagcactttgggaggctgaggcaggcggattgcttgagcccaggagttcaagaccagcctgagcaacatagcaagaccctgtctctacaacaaatacaaaaattagttgggtgtgttggtgctcacctgtagtctcagctacttgggaggctgaggtgggaagatcccttgagctcaggaggttgaggccacagtgaactgtgattgtgccactgcaccccagcctgggagacagagcaaagccctatctcaaaaaacaaaacaaaacaaaacaaaacacccaaaaagacaggtggtgggccagatttgctcactggctgcagtttgccaatctatggtttaaaccaacaatttaaataacacacacacatctttgtatgatgttacacatcttttttttttttttttttgagatggagtcttgctctgtctcccaggctggagtgcattagtgtgatctcggctcactgcaacctctgcctcctgggttcaagcaattccccttcctcagcctcccgagtagctgggattagaggcatacaccacctcgcccagctaatttttgtatttttagtagagacagggtttcaccatgttggccaggatggtctcgaactcctgccctcatgatccgccctccttggcttcccaaagtgctgggattacaggcatgagccaccgcgcccagcctgatgttacattttctagaagttctcagtgatgggcatttaaaggattcggctgctgctccctgtggctttcacagcgctgccctgaatgggtgttagggcaccgtacaggtagcggggatgcctgggaaagcccagactcacagcaacacaacaacagttaacagactccagtgaccaaatgtgtgggtttttcctgcaccaactggcggataccagctggatgtcccctagttcaattcaattcagttctgactccacctacctggagatggcatcagatcccacagggtgagggctcagtctcccaagactctgaacagtggctgtaagtcagggttcccacagccccatctttgggttcaattaatttgctagggtgactcacagaactcggggaaacatttacttatatttcctggtttattataaaggatattacaaaggatacagatgaggagatacatagggtgaggtgtagggaaaggggtgcagagcttccatgccctctctgggcgtgccactttgccaaaaccaagcatccagtctctggaagctccctgaatcctgccttcctgggccttttatggagcctcattggatatgcacgattgacagccatgtagaaataggattggacagcaagggtgtgatctaacactaacagatggactggggaggccctgcaagacctatctgtgcagccttccttcctccaaggtgtgggggcccctctctggagtgagggtctcattacttacaatctgatgagagtcctgccttgggcaggtgaaaggagggcagaaggttagagagattctgttttctgaggctaaagtgccccaacatcttttattattattattatttttgagacagggctggagtacagtgatgcaatcttggctcactgcaacctcacctctcgggctcaagtgatcctcccacctcagcctccctagtagcaggcactacagccgcgcactacaacgcttggctaacttttaaattcttttgtaaacacaaggtcttgctatgttgcccaggctggtctcgaactcctgggctcaagcaatcctcccgccttggcctcccaaagtgctcagattacagcatgagctcctcagctagaagagttaaactcatagagagaggaagtggaatggcagttgccaggggcaggggttgggggctgggcagggaggggacagggagttagtgtttctgccttgcaagaagaaaagagtttggcggataacagcgatggtggcacagcagtgaatgtccttagtgccactgaaccgtacacttaaaaatggttaaagtagccgggtgcggtggctcacacctgtaatcccagcactttgggaagtcgaggtgggcaggtcacctgaggtcaggagtcttgagaccagcctggccaacatggtgaaactccctctctactaaaactacaaaaattagccgggtgtggtggtgggcgcctgtaatcccagctgctcgggaggctgaggcaggagaatcacttgaacccaggaggcagaggttgccgtgagccgagattgcgccattgcactccagcctgggcgacaagagtgaaactccatctcaaaaaaaaaaaaaaaaaaaaaaggttaaagtgagaaattttatgtattttatgttaaatgtaccttactacaattgaaagaatgaaaaaaaaatactgggaaatacattacacatacaaaagagtgtacatatgtatagtttactgactaatattaaggaagtacccacgttcctgctatccagcttaagaaataacattacctgttccccgagccatatgccccgtacctcctgtgcgcctccctccccaccagaggtgaccagtgccgccttgaacgttgcatttagcatgttgtattagttagagttctctggagaaacagaaccaatgggagatatgtagctctctctgtctctttttttttttgagacagagtctcactctgtcgccaggctggaatggtgtgatctcggctcagtgcaacctctgactccctggttcaagcagttctcctgcctcagcctccccagtagctgagattacaggcactggccaccacacccggctaatttttgtatttttagtagacacggggtttcaccatgttggccaggatgatctcgatctcctgacctcgtgatccgcccgcctcggcctcccaaagtgctgggattacaggcgtgagccaccgcgcccagcctgtctctctgtctgtctctatccatctctctctctctctctctctctatatatatatatatttgaagagattgattataagttattggctcatgtggttacgagactgagaaatcccaggatcttcaagctggagacccaggagggccaatggcgtcagcccaagtgcgggaggagacccacgtcccagctgagtgaatccccttaccctgcctttcggtctattcaggtgtcaaatggattggccgaggcctatccgcactggggagggccatctgttgtacccagtctaccgattcgaatgctaacctcatctagaaacaccttcacaggcacgcccagaataatggttagccaagcaccaggccgctccccacccagtccaggcagctagtcagcaggccctgccccacttgcttgtctttccttgcgttttgcacacgcatgcatctctgtccctcactttctttagttttgcccgactttgaccccaatatgacgggagccccaccgtgcgtgctgtcctatgactcgagtttacgcagtagcctagctttggggcacagccccatttacttggggcaccgctgcctctgctgtgtggccgtgtgggatcccacaccaggagcaccgtccctttgtcacctgggaggggtgattctgtgcctgagttgcatgtggatttcctcctgctgagttttaattaagaggcagggagcaggtgggtgaagggcacacacacggatgcagcgttgcccgggttcgaattctgcctgcgccatttcctgcctgctgaaccagatcggacaaattactctacctctctgtgccacagattttttgttgttgttgttgttttgttttcattttgtctcgttttgtttttgtttttgagacaggttctccctctgtcacccaggctggtgtacagtggtgcaatcacggctcactatagcctcgaccctgtgggcttaagcaatcctcccacctcagcctcctgagtagctgggacgacaggcgtgcacagccacacctggctaattttttaattatttgttgagatggggtttcactatgttgcccagggtggcctcgaacccctgggctcaagtgatcctcctgcctcagcttcccaaagtgctgggattaagtgtgagccacctcatctggcctttgtgccccagttttctcaatcaggtaatgatgatagctctcaggtggtgagggtgactgtataaaatgtctggaaatggcacctgctctgtgcccaggggttagaggcttgggaccgagctgggggctgagctgggggtggagctgggggctgagctgggggtggagctgggggctgagctgggggtggagctgggggctgagctgggggtggagctgggggctgagctgggggcgtttttgttccaaggctttcttgctgataagtttctctttctctctctctcttttttttttgtcctgcgtgtctcaacctgacaaaaatgctcagtttagaagcgtgtcgttccatttgtgggaaaattaaacacatttaagagtaaattaaattaggggacttgtgatcattagctaagtaaattattttttaaaaatgtgatgtaccaagcatagcacatgtggcacgctcaataaatatttgttagaatgaatgataattttatgagccagtcgagtcatatataatgggattatttggttctagaactaatgaagtgactgtagagcaataaagcttctaaaaagaatctccgtgctcgcaaaaaatccaaaagtgggggaagaggctcatgctggatttcacccaagagcgaggcccgaggagagctgggacgctgtgtcctgagagctgtccaaggggggcccttgtgacttggcaggggtggttttggagcctgagtttatccgcactctgggtggactgggtctcgggggaggcctgccttaggtcagctcaggagaccagtggatatagcaggaggcccacttgcagttcacggtttgtcttgccagatgtgcagggggcccggtgtctcagcacttggcacctgtgggactgagagaggagtcagtctagcaccagacacccgcttggtgggggaggggagtggaagaggagggagaggagagagagggggctggagccccagtcccacagcttaggtcctgggaagccctgtgggttcatgcttgccttgaggggaggttggacggctcaagcagggaccaggagcctcccagtgtggcatgagctttgctggaagcctgggctctttgagaggggtggggctgagagccgctagacctggcttcatcctcctgcctgctttcctgtctggggtgtaccctgggaagggacataacttccctgaacctcggttgcctcccctgtccagtggaggaaaggaaggcacctgcctaactgggctcttgaaaataataaattgagataatacaaaatctgcattaatttcctaggcctgacataaaagagtaccccacactggctggcttacagagcagaagtttattctctcccagctctgaagaccagaagtccaagatcaaggtgtcagcagggccttgctccatctaaagtctccagggagggatccttcctgactctcttggcttctggggacggtgggcagtcctggcatatcttgatttgtggccatgtcactccagtcagcctccattgtcacaggtgtcccccttcatgcccctctgtgtcttcctatggtcttctctctgcatgtcagcatccaaatttctctctcccatgtggacaccagctgggcccaccgcagtccagtatgacctcatccgaacttgattacatctgcaaagaccctgtttccaaataaggcacattctccagttgtccaattccaggtggacgtggatttttttttttttttttttttttgagatggagtctcactctgtagcccaggctggagtgcaatggcacgatcttggctccctgcaacctcctcctcccgagttcaagcgactctcctgcctcagcctcctgagtagctgggattacaggcacctgccaccacacctggctaatttttgtatttttagtaaaaatggggtttcactctgttgcgcagggtggtcttgaacccctgagctcaggcaatccacctgcctcagcctcccaaagtgctgggattacaggcatgagcctctgcgcccatcggacgtggattttggatgagacaccattcaacccacagtacctggtgctcagttagtgactaaaacccactagttatggtcactcagtcacccttcttgttattactttcatagatgagggtgtgatgggggggggaaacagaagcagagttgattgtatcttcttagttctgcacaccctgtggcttttttttttttttttttttttctgagagggagtcttgctgtgttgcccaggctggagtgcagtggcacgatctcaggtcactacaacctctgcttctcacatttaagcgattcttctgcctcagcctcctgaatagcgggcattacagacatccgccaccacacccagctaatttttgtatgtttagtagagacggggtttcacaatgttggccaggctggtcacgaactcctggcatcaagtgatccacccacctcagcctcccaaagtgctgggattacagacatgagcctctgtgcccagccccgtggctagttattagactgttctaggtcttgatgggaaaggggaggaggacttgttcttctctttggattaataaaacaccgtgaggcttgtgtttgcacagtgcccacagcttgcacactgacaagcccttttaggttgacttctgctgagtcatttcatcctgttccatttgtcagccataaggtaaggagcagtttttctgatgtactccttttgcataaatgctactctccatcagcctcgagaagtagaaggcaccggtatggtatcccaagctcattcacaggggagaagagatgcctgttgccacaaaatgtgaatgttgggtgtacattcaggtgtcacgtacgtggtgttgattgtctcagcttaataaagaaagatgccgtacacattttcctttaaaaagtctcacttggcttgtttgacaggcacagaagatgtgttattaaacacttgcaaagcctgctgtcatttggttttaaacagcactcgtcgtctttggcggggcgtgtttgctcagcatcatggaagggggatgtgaggtacccaggtggcagtttctctaccacgatgctttctctgcttgctatcgggagaaatgttctttcctatgttgtgggaaggcggaaagggcactctgaaatgtaaggtggccttttgtattagaatttcatggctgagaccaggcgtgggggctcatgtctgtcatcctagcactttggaaggccaaggcaggtggatcacctgaggtcaggagtttgagaccagcctggccaacatggtaaaatgccatctctactaaaaatacaaaaaattagctgggtgtggtggcagccacctgtaatcccagctacttgggaggctgaggcaggagaatcacttgaacccaggaggtggaggttgcagtgagctgagattctgccactgcactccagcctgggcaacagagagagactctttctaaaaaaaagaaaagaaaagaatttcatggttgattgtcacaggaccatctttagtcccaagatctgaggcaagggaatcgttttcaataggaaacttttaaatgtttgagcagcagaaagggagattgagccagaagaacttgctggtggaaagatggtggaagctgggagctttgaggttctaaaaatcctggtgtgtcaggtcaggtagtggggcaaccggagcttagggtgagttatacctgatgggacttaactgggtaaatgtcatctagtaacccaactacattcggcattaatatctggacaaaaggtggaatacacccgggttctttgggcacaggcgaaggagaggtctcatagtttgatgttgctcaagaagggaaaacaagcaggatgggaagaggtctaatcagccggctggagtggggtgctgggtttagttcattccttcttaaactcagccagttctcattattcatggtggttttgatctataaagttgccacaaaccccaagttagccaatactgagccatcactcctagggcagtacagcgctcggttcctgcgagcctctggtcacaacattttcagcaacagatccatacataactttttcttatatatgtttctttttaaagatacgttatttaaaatgtattgttgattgattaacattgagctcacggccaacagcagtataagtgctgcctgaatgaagcttctctgacctgtgcgttctctgcaaggcatacctcagccttcttgcacttgggaacactaggagtacccctcgccacgcgtggggacccattttaaacagcaaagttggctgggcacggtgactcatgcctgtaatcccagcactttgggaggccgaggcaggcagatcacctgaggtcaggagttcgagaccagcctagctaacatggggaagcccagtctctactaaaagtacaaaaaaattagctgggcatggtggtgtgcttctgtaatcccacctattcaggaggctgaggctggagaattgcttgaacccaggaggcagaggttgcagtgagccgaagtcacgtcactgtactccagcctgggcatcagagcaagacttcatctcaaaaacaaaacaaaacaaaacaaaacaaaacaaaccaaaacagtgaagtcaccaacaaatagcagaaaaatgtgaaaaacatggcattaaatagaccatgaaatggacacttgtttatgatgtgagacctcagacaagaaggcagagcgccccgtgtttgacctcaggtggggacacatccggcaactcagattcttttttttttgagtggagtctcactgcgtcacccaggctggagtgcagtggtgcaatctcggctcactgcaacctctgcctcctgggttcaagcaattctccagcctcagcctcccgagtagctgagactataggtgcgcactaccacacccagctaatttttgtatctttagtagagacggggtttcaccatattggtcaggctggtctcgaactcctgacctcaggcgatccacccgctttggcctcccgaagtgctgggattacaggtgtgagccaccacacccagtcagattctttgcttctgtgtgcaggtctgtgaatgaatgtaggccaagagtattgattctgagcttacaaattttagccagtagacacatttacacatacagaatccatgaatcaaggcgattgactgtactttgacaattatttgtttagcactgtaggaggaacctgcaaactgttccttccctctgctcacatactgcccagggtaagacttctgacaccagaggtgcagggatgcttcctgccgcacctggcagttctccagcagacaccagctgggtgtcctgcagttcagttcaattctgacaccatcgacctggagagagcctcagaccccacaggtgagggctcagccccacgagactgcaccccaaatcagggtccccacgactgcttcctcggttttgattaatttgctgggactcagaacttggaaatgggccaggcacggtggctcaagcctgtaaccccagcactttgggaggccaaggcaggtggattgcttgaggtcaggagttcgagaccaaccgggccaacatagtgaaaccccatctctactaaaaatacaaaaattggttgggcatggtggtgggcactgtaatcccagctactcgggagactgaggcaggagaattgcttgaacctgggaggtggtgattgcagtgagctgagatcgcaccactgcactccagcctgagcaacaagagcaaaaccctgtctggaaaaaaaaaaaaaagaactcagggaaacactgcatttgtgctccctggtctattataaaggagatgataaagggtgcaggtgagcagaacaggaggaggcacacagggtgaggcctgggagggcccccagcacaggagcttctgttgccctggagttggggtgtgccaccctcctggcacctggatgtgtttacccacccggaagctctctgcaccctgtagttcagggatttttacggaggcttcatcatgtaggcatgtctggttattagttcaatctccagcccctctcccctttctggagggtggggttggggggtgtggagctgaaagctccaggcttctaattgtgtctgggtctttctggtgctcagcccccacccaggagccaccaagagtcacctcattagaataaaacatccttttatctccctggaaattccaagggattaggaactttgtgtcaggaaccagggtcaaagactaaatattagaacaaaagattgtcctggcacctggaaattacaaggttcttaggatctgtgtgccagggactggtggcagagaccaatatgaatatttcttttcttttctttttttttttttgagatggagtctcggtctgtcacccaggctggagtgcagtggtgtgatctcagcttactgcaacctccgcctcccgggttcaagtgattctcctgcctcagcctcctgagtagctgggactacaggtgtgcaccatcatgctgggctaatttttgtatttttattagagacggggtttcactatgttggccaggctggtctcaaactcctgacctcaggtgatccacctgtcttggcctcccaaagtactgggattacaggcgtgagccaccgcgcctggcccaatatgaatatttcttattattttacaagcacttgcggtgtgtcctgtggtctccgtcctcagcgtcgtggtttagagggtgcctgacaggcagggtgtggggttagtggggttggggagtgatttccggggcacagtgatccccagagtatgtgtggttgtccagttcactcactcctcgtggcctgctcggtgctgggggtccacactcacagagggcatggtctgtgccccttgggatcaggcagctgctcctggtacagatgagttgggagatgacttcctccagggcatgtgagaagctctcaatgaccaggccagctcggattcccagttctggccgagccgatgtgctctctgttgccacattccgtgtcacttcccaggcctccccggcttcccattctcggggccaggtgttccgtggatggggtgcggtgcggcctttgataccagaggcctgggatcgctttcctcctcggtttctgtgtggtcagtggcgccttcacctgtctcatgccctgccatgctgccatgcaagggcagagggctggtgttggggtggtgctggggcctggggagtggaatatcctgctctgttaagatgctggggatcgcatgtgtgatgctggccacgtcagccagtcttccttcctgccgagaccaccagccctcggtgcagccagccgtatcacctggttatagtcacgccgaaacccagctgtttggaagcgtggccgtggggccttggatcccttttcctttccacgtgttttgtggagacgaataacacaggcatgcgccgtgcccaggtggaggcaatgttaggaaagcaggaaggagctcagagcaggaaatgtgtgtggactcgcgtttgttgaagggcctggccgagttccccagaggctggggtcagtgttcaagttctgatgcttcacgtccttggaggccaaaggacgtgaccttgaagaaggggcagttctcacctgtgggcctaggagaggtcgttggccttaagacattactccaggtaattatatgtggttcctacctataatcccagcactttgggaggcagaggctggaggatcgcttgagcccaggatttggagaccaccctgggcaacaaagtgagactcctgtctctacaaacaaaaacaaaaacaaaaacaaacagttggctggatatgatggcatgcacctgtagtctcagctactcaggaggctgaggtgggaggatcacttgagcccgggaggtggaggccacagcaagctgtgatggcactaatgcacttcagcctgggtgacagagtgagaccctgtctaacagcaacaacagcagcagaacattaatccggatagttctaggatgagggttctcagagctagatgggcctttgcaagttctttccactgatccccaggtttggttgattgtatgaaaccaagaggaaatgtacagggtttttgtgaagaaaggaaagtgtcatttctttgggttttactttgaatggcattggatgaggtcctcagagcttatgtggggccagcccagcctgccccatgtgccccactgagaccctggaaacttggctttctcccactgctcccccagtgctcactgactagttttggggttttgtggggaccctttgtctatctgcttcgtcttccccagatgaatcaggggacgtggtggtaccatagtggtgctgagggcagcttctgggtgggggttctcagaaggagaagtctgtccaggaagattatattttattaccttctccctcatcttatttattttctgtttttttagaggctgggtctctatgttgcccaagctggtctcgaactcctgggctcaagcgatcctcctgcctcggcctcccaaagtgctgggatgcaggtgtgagccactacgcccagcctcccacctctttcttatttctttattgtttatttcaacaggtttttggggaacaggtgtgtttggtgacatgaataagctctttagtggtgatttgtgagattttggtgcacccatcacccgagcagtgtacactgcacccaatatgtagtctttttatccctcacctacctcccaccctttccccaagtccccaaagtccattgtatcattcttatgcctttacatcctcatagcttagctcctgcttctgagtgagaacatacgatgtttggttttctattcctgagttacttcacttagaataatggtctccagttccatttccatccaggttactgcgaatatcattattttgttcctttttatggctgattagtattccatggtgtgtgtgtgtgtgcatgtgtgtgtgtgtgtgtgtgtatacactgaaatttctttatccactcattgattgatgggcatttgattggttccatatatttgcaattgtgaattgtggtgctataaacgtgtgtgaagtatgttttttgtctgatgacttcttttcccttgggtagatacccagtagtctcctacttctttttaaaggaagccttgctctttcttaaaagctgctaaaaaggaatgagagtggcgctacagcaaacatctattgagcgcctactgtgtaccaggtgggtggctatggtggaatctaccacttcttaaaagtcaccatccaagttaccgtttttctgaaatactttgtctttcaactgagtgctttgtttttagtgatggccagtgaagggcccaattcaaacagaagcagagccgggggatactgaagggcctttctccctgtgagccccttagaactcaggcagaaatattttagcaaaaagtcgaatctgtacttctctggcttttaatgggttatattgaaaaggatatgacctgcctctaaggttgtaacttacgtttggctcagtcttaattatcttaacaaggggtgcctccccacccatcatccccataccttgtatttatgcatgtattgacttttctcccactttgatagcttgaaggcagggctgcagtgtttctcaccttggcaccccaggcttgagtgatgcctggcacacagtaggtgcacggcacacatctgagttgagatcctgatacgcaccctgtataagaccttcaacagcctgtcgaccactcactgcctccgtttcctcatctgttagatagggatgatcataagggttctttcttgcttgccttatggggccttgatgagaatcaaatgaaatgatgacatcagtcccttaattatttctcctcctcctcctcctcctcctcctcctcctcctcctcctcttcctcctccatctcctcctctcttcttcttccttttttttcttctttcttctttctttttcttcttcttaggcagggtctcactctgttgcccaggctagagtgcagtgggatggtcataggctcaagtgatcctcctgcctcagcctcctgaataactggaactacaggtatgtgccattgtatctggctaagtttttgtagagacagggtctcactatgttgcttaggctggtctccaactcctgggctcgagcggtcctcctgccttggcctcccaatgtgctgggagtacaggtgtgaaccactgtgccaggcccctttaatttattctgaaaatggcgtgtcaggagctgggtcttggctgccttgcttgcattgtgaaatccccttgcctggcaggtaggaggcagtcgatgcatacagggtgagtgaatgaaatgttagttagttgcattacattgaagtggtctaaacctgactctaagatgtgactactaggctgctgatccttttatgatttttcaagtgcgtagttattttccttttaaaagctaatcacatttcctttcctgactgatcctctgttatttctgcctcctcccccaaggggctgaccaccagccccaggcatctccttggccagctcagtggatacacacacgtcaggaagaccctcccttgccccagccttccttcgtgggtggcactggacactgggcagatggaaaggccctctccatggagcactgggctggcgagggccttcctgtctgtgccctcatgatgtcctcacttggctgtcgaggcatctcctgggccatgaagtgctgtttgctgtcctggccttggattcctgcatcaagtctcccagcaggaaaactgttaaaccaaaaccagtgttgggaactgcatcagagctggggaccacatcagtgctggggacctggatcagcattggggacctggattagccctggggacctgcattagtgctggggactcgcatcggcattgggtgtctttttgttgcttcctcaagtcctagttttgactctggatgaagcttggtttgtgccgtgggagtggagtgttgggggacaggggtgaccggcgggtgagccctcactgttgatcctggcctcgaatgggagaggggcactagtgcccctgggagtgggccaggcatgtcccagtccactgcctgccccagagccccgcctggagcacctgctgggtcgggacatgggcctcccgtgggcctcaccgcttcctgcttcagcagaactgggattgtcagttaatcgagcaacacctccaggaagccagcctcaggaaagagcttccacagggagttgggggactggtaattggaataaataaaagctaatcgtgcttcctggatgccaggaaccactgaaatttgtggattcccacagcagcacatgaggctggtcattgttaataacccctttttaccgacgaggaacccagaccagacagagagcccgcctgtgtcacctggtagggaggggctgggcctggtgttataaaccaggagagggttcaggccgaggaaagggggagcaagttgccggccaaggtaggtatcatgcgagtcctacttctcccctcattcaaggaccttcctttggggaagtgagtgctcccgagagcagcctgccgcctccgtgtcggggcagcctcagcttcttctttctgtgtccgatatttgatttctgttgtcgtggaaacggggtggcaagtgttccatgtgttagcatttggtcctcctgacgtagtcggcacacgggagatgcagctggggtggcacgtgcccacagtggtgccacctcttgccgggggtcaggcagaggagacccagctccgtgccagcttgcagacccccaatcacttctcctgtctcagggcccagagagcaaaggcagtgggaggccaatgtctgttgttcagtttagctctgagccacgtgcatcttcagtcagcccaggggcctgggcgcgcccttccttccttctttgtgcatgggggttttcctggggagcagttgccctggcccatgaggctgatgggagtcaagacagaaatagtggtctgtggtcagcaaggagctatcgctggaaacaccccggtccttccacagcctgaccctctgtgaccttcctcaaaggctccccaaagaggctttcccttgaagtgcaagtcatagtggcgcccctgccacgtccctatatgaacggggtgtgtgcccgcctgccctccgacgtccgccggctgtgctggtctgcagagctgccgccagctgcaccctcctcgccagtgagttctgttgctttcgtatcattttcagcaggagctaaacccaggccagcccttcttttcttttctgctttatggcagaattttgttttgcaagaatggaccctgggtggctgcttgacttttcccaggaaggtgatggggacgttggtgttaggacgatgggcaagggggtccaggttgtctcactgcggccccagagggatgagggtctgacttgtggagtgaaatttccagcactctgctgggggcgagtagatcattgggcccagaagaatgggatttggaacattctcaggcacatgctgcaattaagattttctttttcataggggtacctgatactgtgggtttctctctctctgtcttttttttttctctctgagatggagtcttgctcttgtcacccaggctggagtgcaatggcgcgatcttggctcactgcaacctctgcctcccaggttcaagtgatcctcctgcctcagcctcccaagtagctgggattacaggctcccgccaccgcgcctggctaatttttgtatttttagtagagacggggtttcatcatgttggccaggctggtcttgaactcctgacctcaggtgatccacccacctcggcctcccaaaatgctgggattacaggcatgagccaccgcgcccggccatgggtttctcgttagtggtcttcggttctgtgtttcccctctaagtagctgatcgtggccggtgcctggctttcccctggtcaccactagatattctgtcttgtctttgggaggcagagtcagtagaaggtgctttgcactgggcatgcctgggagtgagcccagccttgctgttattagcgcccatcgtgacggtcggccaggctgccctatgttcgatttttcctcctgtgaaatgggaacaacagtagagctgatgtgtcctgggctttctgcatcccagggactatcccagctccttaacgtgctttgctcagtgctatcctcctaaaaagttttcttttacagttgagtaagctgaagcccagagaggttaagtaacctgcccaaggtcacaccgcagatcggaatgggagtcaggagtgtacccaacagcctggctccctagtcagtgctctcaacctcagcttgaaggccgcctccctgggccctgctaggggacccagtaagatgacagttattcacattctcctttgtttctgataccaagcaaactcctggtaaatgctccttccccacttttgtggaataaagaatgcacatttttttctgagctctgcctgggtatccttaaggagagggacgctgtgcctgggacgcagatgaacaagataggagctgtttcctggaggagctcccaggctgatttttgcctttgatgttctgcatctttttcacaggctttttgtagatgtgtggggatatttctagaggagaaaccagaggtggaaggaggggcataatgaaattgaatgctgggcatctcttagctcacattatatgaggctcttcagggacaatagaccttgcaataaaaggcaaaaaggtgattgcgcacagagtgcttttcctgcacagtgctgggcgggatggggtggatggggcttggcggctggaggagggtagaccctgcccgcacctcctgggacctgtgcgggactttgctcaccttgctgtttctaaccaaggtaccagattctcttcactcaggtgtgtcagattttaacccttgaggctagaaccttgccaggcttattcgaagtcagtggttcctagtagtcacagggcccctgccctagaccccagaccaggaccccccggcccctgcccgcccgccttggcctggtggggtaggagtcactgtgaaaggggtcctggagcccagtatcactccagcgacatttcccagagagcatcctggggccagtgtggggtgtgggggaacagatactgagcgctctgtcccctccccttggagaatctcacagtacattagcagagtcaagactctgagaagtccggtaggaaaagacacctgcttagcttcccttaacttcacgactcctccacctccttgacctttgcttgattcatgtgtgacctgtgaacgtctaaactgcaggactcactttgggagatactgatggagaccaaataggtgtcctgctcatatatcctccacttcttcagttttgctcaggatccactgggcttcctaaaatgcaaacgaattgaaaagctgtgctgaatgtgtttttctctgtctgaaagtacagccacccacgaaaggaggaggtctgctaagttttcttttagaaaaggggtccccaggctctgaatgcttgaggacctcattgggatcaccccctccattgtgggctacccatcctccacccgctgtggcctattgataacctcccagccaccacctatgctcctagaggccctgactggaatccctgtcctcaccctgagtttgtcacctccttccaaacttcgtgtcctctgttgcagttgaggacctggaagtcatgattgggctgattagtgatgggtgtttattttgaattcttaactaaacaaggaggaatcacatcctagctccgtattttactagttatgggaccttgactttcccaagatctactttccttgtcagtaaaatggcaataatcggggtaacccataccctgattgctgagaacccctgtaggcgtccatgcctggcccaaagccaggacccaggaagggaggcgcagctgggcggcctcttctgcgtctctgccagttgctggcttggattctaacaccctccttccctccctccctcgctctctaccagtgggatctgagaccatgaaaacgtttgaaggtttctcaagcgtctgtgactgccccacgtctgtcgttgggtggaaaggactttgtaattgaacggagtcagttgtaatgtgaatgtcatgtggagctgcttttccttggcaagtccttgctgtgtgagccattgtttccagatctgtagaaccctccctaccctgtccccctttccgggctattgggaggctgagcgagctcatcatgaggcccctgaaagatagtttctgtgccctgtggagctgagtccccgagtctctgtccccacctcacaggccccctctcaccaccctattgggttggtaaatttcaagttgggcatcagataggacaagggaaggggactggagaaggaagagccgacagtttgccctcaggacttcagagtcactcttttttgtttggttggttttttgagatggagtcttgccctgttgcccaggctggagtgcagtggcgtgatctcatctcaccgcaacctccatctcccgggttcaagcgattctcctgccttagcctcccgagtagctgggattacaagtgcatgccatcatgcctagctaatttttgtatttttaatggagacgggggcttcaccatgttggccagacttgtctcgaactcctgacctcaagtcatccacccaccttggcctcccaaagttgctgggattacaggtgtgaaccatcgcgcctggcccagagtcaccctttctttttgtgccttattagacatcttcctgctacaggatagcccagaagaaaggaacaagtttccgtcatgaataagtcccctacctactagggatgtagggataaaggactggaactctctttcttcaccctgcagggcaaactccttcaagactcagctccaggaagcctctctggactactacactccctcctgagcccccagccttctcacatacctcccttatgtgtctcctgggtgctggagccctcagagcagggcctgtatctaagtccccctgtggcccacccagtgccccgtgccaggcctgaccatagtggatgtcactaagcagttgttcaatgagtgaatgaacaaatgcaaactaggcccaatcttatcaaattatactagaataattgtataaaaaaccagacttctttaagtggaggaaatttaaagtcagaagtgggctgggcacaatggctcacacctataatgctagcactttgggaggctgaggcgggcggatcaccggaggtcaggggttcgagaccagccagcctggccaacatagcgaaacccgtctctattaaaaataacaaaatttagctgggcgtggcggtgcatgcttgtaatcccagctactctggaagctgaggcaggagaatcacttgaacccaggaggcagaggttgcggtgagcggaggtcgcgccattacactctagcctgggcgacagagtgagagtcagtctcaaaaaaaagaagtgaatgaatacgaccatacctgcttttccagctcctgactcttaaacgtctcgaataccaatgccaaataaagggaaccgagagatgaaaggtgtcactgtcctgatcttcagatgcagaaatttctgtgtagctgaggaggtggggcccgcttgcccccctttgaattttgggttgtgcttgagcagaagcattcattgcttggagaaagcagaggagaccccagaagcacttccctctgaaagggagaagcaggtaggccaaggcagcggttctgggaccagctctggggccacctgcttttcccacactgggtctgtggtgggctcggcagctggcctgcacacaggagatcctcaaaacagatgagcgagcatgattgccatttttacactccctcatttaatccgcagcactggaggaggtgtgattatggtgtgtattttgtgcagccatttggtggacacctaccgaggacccgccgtggggcaggctgctggctgggctctgaggatgctgacgaggacccttctttgggatcctctgttcgggttgaagacagtttatgaaaacataagataacagaatggccgactctgaggcaggagccaggggtgtgtgagtgggggtcctggaaggggtctctggaaaccagaggaggagtggtcctctgaggctggccaaggctcccagcagagagacgggggcatgggcagaagcctgtcgtgccagtgagccctggcatttctgagcccctgatcggttctgttgcctgcacgacggcctgggtgagcaacactgacaggagacccctgccttagtaccatgtctcctgggctctggctagtggcgcctcctggcagcagctgcccaggccacacaggatgctggctacatgcttggctggtctggccatccctgcatggccccgctgtcactggtatctggagatcacacccagccagagcctagtgccaccctcggatgcttccttggggagggaggatgccctgtttccatggcaaccctaggtgggaggccagggcttcaggcaagctgctgagcttttcacagccctgggagtgaggagcagggcaggctgaccctggcctgtggggcagaattagtagaggaggagccccaccatccctgagaagaggaggggagtggggtggggaacattagacaatgttcactgcccctccctcagcttcccagctgcccacggcagtcccaggccaggccagtgtgggcgtggggggcagttagagcgtggccgtgtggtgtgccagcacgcagtgcaacagccaagacaatggagtcatcccctgcccctgggcccttccctccaccccacctcatgtctgcactaggtgaggaagcagaggacggaggagcccagtgggctctgggagctcctgggactcctgagtcggtggggacggggcttcccagcctcaacactgaggattcttggttgtggagctctcctgagcattgcggggtgttgagcggcatccctggcctctacacacgaggtgtcagttgtgacaacccaaagtgtctccagatgccactacgtaccctcccagtgtgggggtggaggaatcgtccccagttgagatccgctgagctgagaggctccccggaagcaggtggtgaaggaagggaaggccctgggccctggagacatggatgcctgcctgggacacacacaaacacgcacgcacatgcacgcatgcatacactcactcatatgcacacatgttcatgcatgcacccgcagtgaccctgaagggactagactatttttagagcacttttaagttcacagcagaattgagtggaaggtgcagagatttcccgtgactgcacggccccaccacgcacactatcaacatcctccccctctaacaacgtccagaccagagggtgcatctgtggtacctggtggacccacatggccatatcagggtcacccagagtccacagtttccatgaggggcccctcttggtgctggacattgtgtaaggacagggacccccatggtagcagtgacactgccctgagatccccgtgccccacctgctcatccctgtctccctctcactcctggcaacctctgctcctttcactgtctccgtagttttgcctgccccacagggtcgtgcagttgggatcacactgtctgcagccttttcagactggtttttcactcagtgagatgcatttaagtttcctccacgccttttcacagctgacggcgcgtttcttcttggttccaagtggctctttctgcattgtctggacggatccatttgttccctgtttgcctcccagaggatccgctgctcttgctgcagatgtatagcccaggtgctgtggagttgggatggagcagtcgagctgggatcagagcccaggcccctgccctgaggttggagctctctgactgcacctggcctaggcctgtgcattgtctaaactgatggccgtggggcaggggacctggagcgcaaagcaggagaggatgctgaagggggcaggtggggccgggacttgggagtgtctggaaggaggaccgcctgcctcaacccagggctggtctgtggaggccagagcgctcagcccctcaatgctaggcctgttgtgagtttctccatgaggtggccctctcagaaagagtggctccacagcagctgagttgggggccccatggcagctgagtcgtggactccatggccgctgatttgggggatgcctgtccttgtagagactgtcacctctaggaatggtgaaagggcggccacccgcagccctgtgtcctctttctagtcctctgtcttgtaagcccggtccccacagtggccccagtcctcccctgccagaaattcgttctcctcagaaatccgttctcctctctgatctttcaggcctagagacaggctcttccctccggagggtgcagcccaggggttctggtaagatacagagcccagcctcaacatagcaggaagtttttccacaaatacacagttcttcaagaccacatgcagctgtgcgtggggtgtgttttgaagggcaatggcaggagcagtgtatgcctcgtggtgcagggagcacgagttgtttataggcgtgcctgggtcctgggtctctgtgcaccctcctctagattcatggggcatctgcccaccgtgagatagataagccagggtgcctgcccctttctcaggtgagatgctgagggccagaaacatgctgctgtgtcccatggaggaggtggcctgccccaactcccctgcaccctagggagagtgcccacaggctgggggctggggctgggtcctgtgccccctccccagccctcggtatgtggctcgctgaggtgtgcgccggaatgttgggcacatcctgtctgataccagcttggctggaagtcgaattatgatcagaatatcacatgatgtgtggcctgggtccccctttggttgacactcttgagtatgggtcctgtgcctgcccggggccaagcagcaggtgcaaccgggcctgccctggggcagcatggggtgtgctagtgtcctggggccactgtaacaaagcaccacaacctgagtggcttaaacaacagaaacatagtctgtcacagttttggaggctggaagtccaagatcaaggtgtcagctgggctgtgctccctccagggctccgagaggatcccccttggcctcttccaggctgtggtggctctggtgttccctgccgtgggccacatcactccagcctctgtctccctcttcacgtgggcctccttctccgtctgtgtctctgtcctctcctcttcttgtaaggacgcctgtcattggattagggcccaccctaatgaccgaatctgcaacttgattacatctgcaaagaccctgcttccaaataaggccacagtcacaggtgttgggggccagactccagtgtgccttttaggggagatacagtgcaatacacagcacacagtgaggtcttccagatccccagacctatcttcttccagaccgccagacaacaccgataagggtgaagttggcttacgagtcctggccaggatgtgacggggagtcgccaggtgggtgccggggaggtgggaagctctgcaggggattggagaaccacacgtcattgcccacatgtgactttaaaccttagcaatgatattggagggggatagttactctttttttttcttctgagacagtgtctcattctgtcatccaggctggtgtgcaatggttctagcgattctcctgcctcagcctcccgagtagctggtattacaggcacctaccatgacactcggctaatttttgtgtttttagttgagacgggttttcaccatgttggccaggctggtttcgaactcctgacctcaagtgatccgcccacctcagcctcccgaagtgctgggattgtaggcaggggatattactctttacagctagggaaacagttgggcttggtgacatgatagagacaccaggtcccttgaggacagggggccatttgcagagccgtgtggtggaaggagcctgaatttggagccccaagctcacagcgtgggtccttgtcacatgtcctgtgagctctgtttgcatccttagctcaggcaagctactgtgttgaactggctggacacagtgtgtctgtctctccctcttccagagaagtcctcacttaaggttgtgtcactgtttttactgatgttggaattggcacttggagatgtgaactttcccaaggccacacacccagatgagtggttagacccggacctgcctaactccagcatatctttttcagggggacacaattaaatccacagcatggactgagttcccctcttctctgccaccatcctgaccttttcctggccagggttaccatgtcggggcaggcatgggggaagtggtaagggaggtatctggacctagtaaaaggctctggtcctcctgcttcctcttgtaaggaccctgtcaatcacatcgggccccctgaataaccaggctaatctcccaccccaaggtccttacctaatcacatctacaaagtccccctcttgccatgtgaagtcacaggttcctgggacttgatgtgaacatctttgcagggaccatgatccagccttccatagaggcagtgacagatggagtagaatataggtcctttgagtatttatttatttaagatggagtctcactctgtcgcccaggctggagtgcaatggcgagatctcagctcactgcagcctctgactcctgggttcaagcgattctcctgcctcagcctcccaagtaactaggattacaggcgcagaccaccaagtgcagctaatttttttgtatttttaatagagatgaggttttaccatgttggccaggctggtctcaaactcttgacctaaggtgatccacccgcctcggcctcccaaagtgctgggataacaggcgtgagccaccgcgcccggcccctgtgagtttttacaagagacactgcagtagagagaatggtagagtcctcaaaccctgattcagtcgttcatgaattcactgagcactcaacgtttcccgcaatgtgtgtcctcttctttgccagcctgctggtgtgctcctggtgcttggtccaccatagatgggtgtgcttggtccaggaggctgatggtgctgacatctgggctgatattcaccgtttttagtgacttgaatgacgtccatgcagaagagctagtgcaccatccttgtgtttgaaaatgcccgggctccagcctgagaacctggtaggccagtaattggagggacagtagcaggatcgagaagccatctgtgtcacgtgttcttggggacaaagaggagacacaggctcaaggaacagcaaggtttgtgggacacagctgtgtctgaaaacgtcaagcagttagctcatccctggctacttcctgtgaacccattaaatccccaggctgaggaggacagagggtgagggaatctgaccccttactcagccctttagccagcggctgctgtgctaagccattctgagaagccaccggtggagaactgacttcaggtcgtgctgactgtgaggccatccagttgtttttgcacattgaaaacaatacattacactttgggaggccgaggtgggtggatcacttgaggtcaggagttcgagaccagcctggccaacatggtgaaaccccgtctctactaaacatacaaaaattagccgggcatggtggtgggcgcctgtaatcccagctacttgggaggctgaggcaggaggatcgcttgaacccaggatgtggtggttgaagtgagccgagattgtgccactgcactccagcctgggggacagagcaagactccttctcaaaaaaaacattgttccggatttgctaataaggaggcaacctcctcagaccttggtgtcacaggagaatggcccgcggcagccttagggccagttgtgattttatccacagtgttggtcagatgcgtcctctgtgcttgtttaatattcattctgcttgcgtgaacaaagccatgtcagtttcagtaacgcttgtgccagggggcacccggtgtggagcagggctcagtaaaactgctgcaaagaatgttccaggctttttgaaattacgtggagttgctggggctctcttgaggctgttaatttacttagggctgctgtgacaaaataccacaaacccagtggtttaaaccaacacaaatctattattttacagttctggaggtcaggagtcccaacatcaaggtggcagcagggccggttccttccggaggctccaggggagaatcccattccttgccttttccaacttgcagaggcacctgcgttccttagtgcctggcctcttcctctgtcttcaaagccatctcccgatctttctctgtctccttcgccacacctcctctggctctggccctcctgcttcctcttgtaaggaccctgtcaatcacattgggccccctgcataatccaggctaatctcccaccccaaggtccttacctaatcacatctgcaaactccctcttgccatgcaaagtcacagtttcctgggacttgatgtggacatctttgcagggaccaagatccagccttccatagagacagtgacagatggagtagaaagtacatcctttgagtttttacaggagacactgcagtagagagaatggtagagtcccgaaaccctgattcattcattcatgaattcaccgagtgttcacggagcacctgcctcagtccaggcgtcatgttgggagcaggggagacagagcaggccatgcatctgtcctttcagagcactgtagacgcaaatcctgtagcacagatgtgccttagactaatagtgcctcgaaaggagaggaaggggaatggatgcggggagtggggaacctgacctgctttgtggggtcatggagtgactctccacctgccgtcatccctccatcccttgtttggggctgttcctccaaaggtgcagtctccagcaggggtgtggggacccctgtgggccgtgaaggcctttctccttttctgctgtgggcattgcatctgttcctgatgggtagagttgtctgtgcccggtggggcccaaggcagtgccatggtggttctttgagtatctcaggtgggaactgagctgccagcaccagaggccaatggcttccagcactccccaaatccacctgcttttggaaggggcctgtctccgaagcaggccgggtcctcctgttgggggaagctttcatggaggcatctgtgtcacttctgcaggggagacagccgctagagggcactgtccttctggcctttcccacatccccgtttccatggcaggtgcatagtaaagcctttctttttctaacgacttaatgatttaatcttcttattttctcagcagacaacgctttggacttccctggatacattgggacgttaccagtcacattaattaatacgagtttcacaacttgggaaccagcgaacgtgcttctccagacttagcttctgcacggccgtttctgctttcctttatgaagtgcgtttctctaagagcctggcagtctcatggggctcgtctgttgctggaagtgagcagcgggttccattgccccccgcctcggtggggctcattgtgcagcttgctggcaagtggctgggctcggaggggcggtgacggtgacacacgccaggggaaaggttggcatcctcttctgagaattgtttcttttgggtttcacaccctgcccccaccttctgctgcctcgaggctcttttcttcttattattagctaatgacagatttcatgaccagtgactgaaatcatttggaagtaccccctgaaagccagcgtgatgggttggagaaatgtgacagacgcagcctctgaaaatcacagaggcagaggcttgcgtcgaaggacttgctaaggaattaggatgagagtggtcaggaggcagtggctgctgggcactggagctgagggtgaggggccgagaaaacgggaggcaaatggggtagctcttttttggggcgggggaggctggctttggggatgtgtatcccactgtgcaccgcaaggtgggggcactgggcggtaggttcccgtgctccggaagggtggcaattgaagggaggaattaaagaagttggccaggtgcggtggttcgtgcctgtaatcccagcactttgggaggccgaggcaggtggatcacttgaaatcaggagttcgagatccacctggccaacatagtgaaacctcatctgtactaaaaatacaaaaattagctgggtgtggtggtgcacacttgtaatcccagctactcaggaggctgaggcaggagaatcgcttgaatctgggaggtggaggttgcagtgagccaagatcgagccactgcactccagcctgggcgacagagcaagagtccgtctcaaaaacaaaaacaaaaacaaaaaacaaaaaacaaaaactgactcatgtggctttcagtctgagaaaccaatcagatcatcattgtctctaaagaatgtgtcctcctttgtagacaagaagctcaccggcccctccatgccccggtttctcgcccaggtgggttagacggccaacctgacattttaccgtgcacctggaagtctttcttcctgttctccttcccacaaaggattcatttttctgtggttctaacattttcctgatcaccccagggacaaaggggaagaaaagaccgtgtttctgggccaagggaatcatctgtttaacatgggcttcggagctttttttacatttctatgtaagcaacttttcgtattcagaagacccagtttccctgagccagatggactccttccatctcggggtggtctgtatttcagattcctgcagcaggtggctggtcggaatgcacaccccaggaggtgaggctggggggatgttggctcctgggctgcttgtactagcaagtccctaattgcggagcggactccttcctcctgagcccatcagcctctacgtggccacatcagggtaattgggttccttgtgaaacacgactgccaggctaatgtaaaccttaatggaaaccctctttttccacccaattaagtggctggaggtgggatgctgtgtgagagccgtcagttcagttccctgactttctcttgtagaaattatctatgtagctccatttggcctacataagcttagcatttgtgttcattcattcattcattccacagatattcagagagcagttatccatgtgctgggttttatgcaggatgtgaggccatggtcatgaatgggacctggcccctgtgcactccttgcggggtcggggggtgcagggagatgagcacagtccacaatcacatgatcggggaatagggtttgtcattgtcatgtgcacggggagctgtggaaacccagaggaggggcccgaactgcacccagggatagaggatgtgcagagtgtgctttccagacggtgggaaatgggtggagctagctgacctgaagtgaagggcattgcaggttgtggggacagtcgagcagaggggcagagatatgacctacagaagtggcctggaatggcctcatcagacgatgagtgtggaagcatggtaactgcagctgtattgatgagaggaggggtctgctcattaacagtcatcgggtaccactatgaaggttttgcgttttaccctggagctggtgggagccatggggtgcactgcagcagggagtgaccaacgccagctttgtgtattggaaggatttctacatcagacaggactctcttggtttgcaaaggacagaaaacccaactcaaaatggcttaaaagcaaaacagaattcactggtacatttgacagaatggtctgtggggttggatggcctcaggtaaggcttgatccagcacatagaaggtgttgctagatcctagattctgttctccccttccccgagctctttcgatctggtgccttcatctccaggctctgtatagtggtaagatgatgggacggcttcaacctccatcctttctgggtcaaggccagtgggaaggagtgcctgtctcattctctattcctggtaaagtctcagtgcagttcattagctctaactgggccatgcccatccctgactgtgttcctgggaggccagtgtgccagctggctttgtcctgggatgcctgctccaccccagagctgaactacaaggcccgagcatggtggcaggaggggtggctctctctgagggaggctgagtcttgtttgcctgaaaggatcaatggatgctggagaagaaaagcaatggtgtccataacagtcacctccagaaggggagaggctgggctggggtgggaagagtttagggcagggcttgcaggggccaaggtggccatcctggtgagaaagccccactggccaatccaagaatagggcacgagatgtgagcctgccaagggtactcccaggtctggcatcttggttctttccgctgcgttcttggcacagacactcatgccagggcctttgctgtcacccatagtctcagagtcatgttattattctgcagtcatctgtggggatgggaccgtgcaggactttccctccccagcttcctccctccttcagggtagctcactgtgtcccccgaggcagccagtgctgccgggagaggcccgagactccttctgggtctcagagccatttctatggttgaacccagtgtgtgtccttccctgtagaattggctgccactttgtttcctttagggtccccactgcaccctgtacataaccctgccaggacatctgtttattttccattcttgtagctttatttttatttcaaaaggagtacaagaacacagtctggtggcagagcctccctctgtctcctccttaccttcagccactgggccttgcatcagtaatgctgctcttgtcattctggagcatgccctttcatttctttttctgtgaattttgatacgtacacatagaaatacatagtggtgagttttctagttgtattttttacataaatatcatgctgtatttattttaaagtgtctcaccatgttgcccaggctggacttgaacccctgggctcgagtgatcctcccaccccagctccaagtagctgggacaacagatgtacaccaccacacccagcctttgctgtattgttctgcaacatggttttctttttctttttctttttctttttaattttttgagacaagatctggctctgtcacccaggctggagtgcagtggcgtgatcttggctcactgcaacctccgcttctcggcttcaaactttcttcccagcctcctgggtagctgggactacagattcacaccaccattcctggctaatttttgtattttgtgtagagatggggttttgccttgttgccccgctggtctcgaactcctgagctcaagccatccacctacctcagcctcccaaagttctgggattataggtgtgagccactgcagctggcccaacctgcttttgcttttttaaaaaatctcaacaccatgctatgtattgcacttaattaattgtgcatcgaatccttcacgagccttctgtgccaggtgcgaggtcggctgctgggtggaagtgaccaggatacgtcttccctcggctacacgcagactctccacggtgcaagggcagggcctgcccagccccatgcccagccctttggcatccatccaccagtgttagttagatcagcaggctgtcatgcccaaggcttgctgccatctgaataggacagggtttcagcagtgagctcttgatgtggagtctgcgccacctgttgaccttctttggatttaccttattgaaatgttcacacatttcttttagcttctcaacttatttcatcttgagaaatgggctggaacctcatgccccagcacaacaagccccataaatcagatgttcaagctgagcgatccttccggtttgggccacagtcacggggctttcttactcctctagtcatgtcagcaccgttcagaaactcatccttggcttagagatgatagtgagttacatgtacataaatacaccgagctcattaccctgggccggcatcctgcatgacaagggcccacatccatttctcggcaaaaacaaactacatctgccacttgaaacgtcaagaagcgctttcttgtatgttgtgctccatggatcactggaagtcctttccctcttttcccatgtccgggccaggaggagcagctgctctctggcactgttagcctttgctgccttttatcctaggcaagacactttgttattcctccgatttgtaatcccaagaaccttggagattggacttggagttcgtaacctcctggggagggccaggcctcacatttcaaggcctttgcacgcgtgatgtgccagcaacagctcagccctttgaattatgatccgcgactccctccaatcaccttccttctggatgtcagaaaagactgcccaacagcatctcctcccagctgccgaggctgatgatgtttttattctgatttagatctcacttaggtcttattttaactccactgagctgcaagatcttcactgaagtacaactggacttatttttagaaaaactgctctgttaagaagaccttcgtgcctgatgaagttagttattctgataaattacagcttctacgaagaaaccacacccctctgagtacggatggaagttggaaaattcatagaaagctgtcatttcctggcagaggcctggaaaacctcatttaacagagatgtctttgggttcctgcttaagcccaagcgaaggatcccgatgccccctccccagctgggaagaggagctggtggcgtgagttggcacagagccgcacctttctttctcctcctgtatcctcccgcaagctctgaagaccactctgtttctttgagcaggatcagttgtaactagaagtgggtaggatttgaaaagggctggttaagtgtttaaaactggggcagctttcctgccattttccagttcttttagatgtgcagggatggagaatggctgtttttgttggggttttctctttgatcctggttcagacggggccctctgaaatttctcgccctgatcttttgttctctatgaaaaccaggaattgcacggatggtgtagaaagtccccgtaggtggcaaagcatctctgctgtgttgaaatgacacacttagaaaagtgtcagaaaatggagttgccattgctctggccccccaggacctgtggctcagcctccattgggcctttgtgtctgggccagaccctccaggcaagcccccagtgaggctcttgggcccgtgattgcaggggcgccttgccatcccccgtgtcctgccctggttctgctagtggagcaagaagctgatcagcctttgtgttttcagatttcttctctccgttaaggtaaccttgttctttaaaccagcttgctttcaaagttgttttcctaataatatcaaaagggggaaaaaaagctgcctgaaaatccttttttgggaaagagcctgggcataaataaataaatacaaccatacaaagaagaagattaaaaaaaaaaaaatcaaagatggaactttcgcatttggcctgaggtataaatggcaggcttctgatgacatgcttttagtttttgattctctttctttccttttatgttcttgtaattccaaatcaggaacgatggtgtttttttttttttttttcttttttcttttttttaaaccttgcccaatctttgggtggaggctttggaagccgcacatattccaccattatagttactcaaagctgacgcttcccgaggggtggctgcatgctggcgactgtgccgagggtgtgtgtccctgaatctttgtgatctctctgaggtgtgttaggccccactttacagatggaaactgagacacacagagccgtcaagcagcttgcccaaggtcacacaccttgtcagtggtcaagctgggatccaaaaccagcagcctggctctgggattctaagctctctgttgtgctgctccttgaatatattaaaaggcctactatgtgcaggaactgggttggcactggcaggaaggcaagttcgggaaggagatagttacatggctgtgtggcttcagctggggagaggggaacacccaggagggcttcttggaggaggcggccagtaagatgaggttgaagataggtaggatttagtagggcacagtgaggtgcaagatcaggtagaactggctttagtcctgactctggggcttcacatctaacagcacaggaccagccactccctcacagacttgtttatttattattattgttattatttttgagacagacggagtctcgctgtgttgcccaggctggagtgaagtggcacaaccttagctcactgcaacctccacctcccaggttcaagcaattctcatgcctcagccgcccaagtagctgggattgcaggcgcccactgccacgcctgactaatgtttgtatttttagtagagacagggtttcatcatgttggtcaggctggtctcgaagtcctgacctcaggtgatttgcccaccttggcctcccagagtgctggaattacaggtttgagccaccgtgcccggcctccctcagacttgttaggagacaaggtgaatggctggcatggaagatgccctgcacatagtaggtgctcaggaaacgttagtggtgctctccccctttccaatggacagtcagcaatatgggttggacaagtatgttctgtaatccgaggttgtgtgccctctggctggcccacaaaatttgaattaatggctcgtatttataaatggggagattccacaccaaaccccacatttccagcttttcttgaaaactcagatctggtgactgcagcctgcacttcccactctgccatcccgggctgagcgaggagtgcccgtctccagagacagtgtgccaaggggccctcctcctatcaaatgccctcctgtctctctcttcctacctggccccccgtgcaggccacagagcgtggtgctgcaggtgaactctgctgcggtgggaacgagttggcatcgactccctcgtggctggctgctgggtttcgtgtggacagagacattcatcttagaacaatgcagacacttaggaaaacaagcacaaggcggtctttttcccttaatcacccatctcatgaaatcaagccccagtcccttggaagctcacaccctccacaccctccagacactgagagaatgcatgccagcatgcctgtgccagcgcgcctgtgccagcacacccgggccagcacacccgggccagcagatctttctctgtgactgaagacagccggcacttcacatctttgaagggtttgtctttctggcaagtagaccggtactttaaaaaccaaaacattcctgggattcactgaaagccagtaaactggcaccgttcaggtggcgggggggtcgggggaggggggaagccaagggtgtgagaggagcccctccttccaaaaatcacaccgatcctctgaaggtgacgatcagatccaggctgcaagttcttctgcaaaggagctgtgtccataagggaacccaggctgcaaaatatagcaaggcccagaagggcatccctcaaaccttcatggggttcagctttggacatgctggctgtggtttgtctccactgcactctgcaaagagccccgaaggccctttccttagcctggccatatttcaaggccagttcaattgctgcctcctccaggaagccctccatgcttctctgtggaataggggacctcgcctgccttgtggtcactcttcctccagtctgtgtctctcttggagcctaatcacagagaccctgtacatccacagctgcctctcccacttgcagggagtagtttgtgggccatgtgtgggtgctcacggttccccttattcctcaggaaatgtgaggaagttcctgtgaggccggtattcccaccaccccatgttacagatggggaaactgaggcttagtgcggtgaggggacttccccgaagccacacaccaacaagtggcaatgcgagatttggactggggctctgtggccacaggcctgggctcctcctgccaaccgaggggtctgccagcctgtgcccccctcctcctggtccccgaagcctttgcttccctcaggccatcgtgcataaccagccccttcagaatgcgctgctgagcagtccctgggcggtgttcgtgagcacgtttctcatttattaaggtcacaaaatccctggccctgtttagtgtcatctttgatgttcaagggcggtgtggaaatctctgttttgatatgacccaatttctaggctttcaaaatgtggcttctctcctcctccctctctgtgtttttgaaatcaggtgagcagggctgcctcgaagcgttgaccacttgccccgaggtctccctccccacccctcaggcccaggcacatgggtgcagtgccagctctcgggccttgccaagaggactctcgggcgtagcccacctgtgtaatcctccacacatagggaaactgggtcttttgttcttcctctgccatcagcgtgagcactgcaggcagctgtgctggacgggacctccctgcccctgttgtgtcctcctatgatgccagccaggacatggaacttccaccccgaccccctgtgctccagggctatcatattcccaaggatttctgtgaaaaatcacttttccctgtttcctttctgccttttaagactctctgctggttacaactctctttgtaactcgtcatgtggtacaaatacttgctgaaatttggtccctgttttctcagctgatctgggtgacctgtgggggttcttctggattatttttagagaggtggggcagagggagtctcaaaactctatgtctgtatcatttccctgtgaaggtatttaacatttgtccactgctggtgtagcgttatgctaaggattttggaaattcaaggatgagtggtgcctggatcttcccttaggatgctggctgtgggtggaggacagtgtgtgcggcagccaggctggctcgcggctggaatgtgggttacctggagagggcctgctttttttttttttttttttttgctatttaaaaaaattgttgtaaaataggcataacgtaaactttaccatcttagccattttcaagagcagagttcactggtattaagtacgttctcattgtgcagccatcaccaccacccacccacagaactctttcatctttccaaaccgaaactctgccatcattcaacactacctctctatttgctacttcccccgcccctggcatccaccagactgctttctcctctatgcattcgcctactcgagggacctcctactggtggaattgtacagtgtttgactttctgtgtctggcttatttcactgagcagaacattctcaaggttcacccatgcggtagcctggtccgaatgtccttcctttttagggctagataatattccgttgtatacgtggactaccttttgcttactcattcatctggtgttctcaaatgccaagactcagtgactgcagcagtgcccgaaggttccctcgaatcaaagaacttcctaaccccaacctgtacctaggctctgatactcctgcatcaggcagtcctctaggataaggtgcctgtttaaaatgcaaatatattaccttcgggggagtgggtaactggcatcctggggccccgctgccattgtccttatgagggagggaggttgtgttgtcctggaagtcgggtccacggtcacgtcctgagagtcccatcacgtgccatgctctgggctggggacttgatgttcattgtttggttacatttagcccttccaaagaccctggcatttttgcagtgttacctataaattccatgtgcggaaacatgggttatttccactcttttttttgagatggagtctcgctctgtcaccaggctggagtgcactggtgtgatcttggctcactgcaacctccgcctcctgggttcaagcaattctcccacctcagcctcctgagtagctgggactacaggcgcacgccaccacgcccagctaatttttgtatttttagtagagacaaggttccaccatgttggccaggatggtctcgatctcttgacctcgtgatccacctgcctcagcctcccaaagtgctgggattacaggtgtgagccaccgcacccgacctgggttatttctacttttgggctattttgagtcctgcagctatgaaaatgggaataaaagagggtccgctttttaagaagctgaatatcggcctttgctgacatgagaggagctggcatccttgggccctgctgccattgtccttatgaaggatggaggttgtgtcgtcctgaaggctgggtccacagacgtgtcccaagagcccatcatgtgccatgctctggactggacgctcaacattcatggttacattcagcccttccaaaggccctggcatttttacagtgttacctataaatgccatatggagaaataggtgcagagaggtgagtgggatgtacctggggtctcacggccagcatgagtggggccctgttggcctgctgctccaaagccatcatgccacacccccttgctgttccatcatctgccgctgtggaggctggatgtccagagctagaggtgttcaaggttcaaggtgattctggtgttaaaagaggaaataccattttacttctgaacctgtttcatggagaaagaggtacagctccgggcacactggcctgggtacctttgcagcatgtgatcagggactgctccccagcggccctccaccagtgccatgaaagtggccagggccctacctgcacccggcaccatggatgcatcttggggctggaacctcgagtcttacatgcagcagaggctgaggctgtgactgtggagaaagcgtgacattacagaagcaagggttttggcacctggtgtctgtgtgggtgggtattcctccctggtggatgtggctgaaaggcctgcagggtctcactggtgcagggagatgaggggtcatttctggttctgggattgtccctaatcactgggcgttccagatcctgtaactgttcagcactcccttgagacaggaggtcatggtgtttctgacttggagcctctggctctctttattagattctgttgcatgttccagccatcctgacccgggtgttccatcagatttctgtgcctgtgaatgtggccatcaccagtgaccccactttaaactccagattcacctgtatgcatgaccggagggggttagcatcttgagtccgtggttcaggacgcagccccccggcagagggaaggcagccccactctctcatgccccatcgctgtggtccatgctttgtctgcctcagcagtcttggtcagatctggaagcatctggaggcatctggaagctttggtgtcttagttatgagtttcaaagggcagtgaaaacagactggcagagctcagcgagacctgggaaatatttggggtggggaggaactgcagaatgtattcttggttcagagcatttttccctctgactctttctgggcaacagaccttttaggaatgtttgttaaatgctgaaaaaaacaggaattgatttctctctgcgtccacagccaacatgtgaggccacggcactccgtgtatactaacctggtttttctttccttttgctcaacagtgagtgacctgcaggaagaaggcaagaatgccatcaactcaccgatgtcccccgccctggtggatgttcaccctgaagacacccagcttggtacgggggttcctccgctccctgccctgagacagttgagcttccgtggcactaagttggtcttggggaggccaatgaggagcccgatagatctggcctcttgatcagatgctgggggcatttgggagtctaagttcttagctcaaggtcatctttagaaaagtccattgggaaaagcaagtccttcattaagggtttctgccctagtcttaaaacgtaagttttatttttcaggtggtgaagcaaacagattgggagaagactgacttgaaaagatagtttgttaaactcatagttctgaaaggaggtgtagcaggccactcagggccatgccatgccacgccatgccacgccacgccacaccatgccaagccacgccacaccatagcacaccatgccacagaaggccacatggaaagcactagtgtgaggcagaggcagaaggagcagggctaatgcctttatttgatattttatgtatatattttttgagatagagtctcactctgttacccaagctggggtgcggtgatatgatcacagctcatggcagcctttaccgtccaggttcaagtgatcctcctgccttagcctcctgagtagctgggactacaggcatgtgccaccccgcccacctaactttttaatttatttgtagagatggggtcttgccatgttgctcagactggtctccaactcctgggctcaagcagttctcctgcctcggtttcccaaagtgcagggactacagatatgagccactgcgcctggccccaacacccttactgtggctttctctgaaggaatgggcaaggctgggtgaacaggcctaggcctggcttgttggaatcgtttcactgggctttgcggtgcaggagctgtcctgagtcttctcagtaagaagactcttcttcttccacaccacgtggcgtggcgtggtatggtgtggcgtggcgtggcatgtccccagggccaggggagattagggtgaggatattggctgggagtgtaggagccccgtgagagcccaaggaaagaggtggctggggactctgggctctgcggctcaggctctgagtggttttcatatgaaaggtgtgctcacagagggtggtttaccatctctaggaattagcttgccctggaggtgcaatctctccagagtcagcaaggccccgagatgccaagcaccagaaaatacagaaaacagggcgggcacggtggctcacacctgtaatcccagcactttggaaggccaaagtggacggatcacttgagttcaggagtttgagatcagcctggccaacatggcgaaaccgcgtctctcctaagaatacaaaaattagccgagtgtggctagcctgtaattccagctactctggaggctgaggcaggagaatcgcttgaacccgggattgggatgttgcagtgagccgagatcgcaccactgcactccaacctgggtgacagagcgagacatctcaaagtaaaaaaaaaaaaaagaaaaaaagaaaatgcaaaacacaattaatatgcttcttccctttgggccagccagagctgcccgcggcctgggcttgcagggtgggctctgccaagtggcccaggcccctgcgctcactgcctgatgtaatgggtaacagccaagacacattttccttaaagtgtgttttgggatctagctgatctggaaggcatttatggaacattctgcgtatttccaaaccctggttcgaagggaagtcccggttcatcccttttttgtggtttccgtgacgaggccaggccagcaagagcttatggagaagaaacgccgatgcaagttcagccgccaaccgacccgaagccagagctggtgatgctgcctgaggtcgcaccagggtccacggggctttctctccctccgcttagaagagagtggccccaccaggctcggtggctcaggcctgtaatctcggcactttgggaggctgtggcaggtggatcacctgacgtcaggagttcgaaaccagcctggccaacatggcaaaaccctgtctctactaaaaaatacaaaaattggctgagtgtggtggcaaacacctgaaatccccgctacctgggaggctaagtcaggagaatcgcttgaatccaggaggcggaggttgcagtgagccgaggttgcaccactgcgctccagcctgggcaacaagaatgaaactccatctcataaaataataaaataaaataattagccaggcatggtggcacacgcctatagtcccagctactcaggaggctgaggtgggaggattgcctgagtctgaagaagttgaggctacagtgagccaagatcacaccactgcactctagcctgggtaacagagtgagaccttgtctcaaaaaataataataattgaactcactcactgaatatttgcacagcacctgattctttctgaagtcctctttgtatatttcatatcctttgggctcataaatgtcatcattgtagcgaatattgggggtccactgtgaatgcttctactcctcagtcccttcagtgaccctgtgaggtgggttgtatcattatccccattgtacagatggggaagctgaggcacagatctaagatcacagagatcactagtaagtgccaaagtcttgaaccccgggcattttgcccccagagctaggctcctccccctgctctagaccctctcagtgaagatggtggccctcatcagaggtgagtaggacaggtccctgtccttgggcacgttttattgcagctggctatgacgcacaaggtggggagggcgggggctcggttcccacaaaacactggcacagagataccaccctggcctctgggcactgcttctcctctgactgaagtggagagaaacctgaaccaggcccacctagcctgtgtggacccagacctgctgaagattctgagcccatgtctgaccccccggcaccccctggatggagcagcgcttgctgtacccactgtggtgtcccgggactgtgggctcctcgaggggtcctgcctcagtcttggagccaccgagaggagcatggcacagtttagcgaccactaaagtcacacagctcagagatggcatggcggctggtgtctgctctcagcttccttttaggaaaaacaaggagcctctcacagcccttttcttctctcccagagtccctggagtcctgttcctcaatgcaggatgtcagaaagtcccagggcacttggcagtgagggttcctggccacccgaagacctaccaaatgggagtatgcgggcccaggcccctctgctttaaacatgcctgcagtgactccggggcccactgaggtttgggaattgctcccctctaggccgcgtgagcagcccgtagcagactgagggccatgatgtgcagtggcctgcgggggtttcatgtccagggtccccggtcaaggctagcaggtcatgaatgctgacaggcagcaagggctgactgtgagctctggagcccccagatacagaggtgtttctcatctggagcaagcgcctgctctgaatcaggcccctgccccgtgagacgcagctgctccctggtctgtgcagagcctctgattctggcctactgtcaccatcaccaggtgaccaggagatcccggcgggatctgcagacatggacacactgccacacatagctgcctgcctggggcctgctgtccaccctctcaggcccactgttcccctctaggcggggtcaggaatgaaagctaccccacggggacaggtaaagaccggagatgcctctgagaaagtgtttggtaacagtaagcctcgaaacggcatctctgtcctccacctttcacagtctctgggtcagacgccccattcctctcagtggtcccgccgactgaggcaggacccctcaagaagcacacagtcctgggacatccgagccaccatggcatgctgcccagtctggggtcagacgtgggctcagagccttcaggagggagcagcgagttccctgtgggggccacatgagctgggcgggcccgaatcttgcttctcctcagttcagcgagagcaaggtgtggggacatgctagatagggcaatgctgagatttttagtgtgggttgaaggggatgtttccagaaacgggctctctgaaggctgggattgggtagtgacctgctcactctccgtcctgcaccccctctcatacacgtgtggactcacggcctggccctgctccttgcccgcctgagatgggtggtccagagggggtctcagacatgggtcacacaggcacacaaagtcctctttggggctggagagcttggaagatttggcattcgggctcaaggatctcagctggggagctgaggtctgaagggtgaaggaaacatgggccagggagagagtgtcagacagcgggagcaggtgccaaggctcagggcaggtggcagcaaggcttcaaggagtgagggaaggccggatgggctggagcagattgcaccaggagggcaggaaatgaggcgggagaggggccttggaggccacatggaggacgccggccttgatcccagcaggagtgggaggctgcggaggcctttgcagagatatcatcaggactcccgagaactccctgcacattacctggagtgtccttttcaggcatcagatctgtatgacttcaaaattagtttctccatgttgtcagagtttacactctgctgccgggaagttgcatcacatccgtgtcagcagcaaagtttcactcaaagccattttctttctttcttttgtattttattttattttattattttatttatttttaaaaatagagacagggatttcactatgtagcccaggttggtctggaactcctgggctcaagcaatcctcccgcctcagcctcccaaagtgctgggattgtaggcaggagccacttacgctcagcttcaaagctgttttcattctgaccgacatggtcagtgtccccagccccatgggagcctgtctgggctctgggaccctggtctcaactgtgtcctggccatctccacttgtatgtcctgggggtaactggcttctgcctggagcccctcttgtgccttttttcctctttaagagagaggtgtggtatagagcctcccggtgagtggagcctgggccccacccgacccatgctctgtgcaggtcccggagctggacagtgtggcagcctgagacccccttgcccttccctgtgtgtgttcagaggtgctcggcgcccgctggcttctgtgtggtgctgggcatttctgctgtggagcacgcctagccttggtgggtgccccctccgcagtcccgcctccccactgtctccacggcactgtcctccatgacgggctcagctggctgcctggtgtctgtgggatccaggctgaaacgtggagggaaagcaaacaggtagagaaatagaaagagggtgaggctgaacacgttttgctgttacacatcatccccccccacctttttttttgctatttatttctcaatattttttctgcatgttattttacatacaacattgcatattgattcttttccatggaatgtaccaaacattttccatttcattataaccatccagactcttcaaatgtatttataaatagtggccacagggaactacctggtgcctgaagctttcccacataccagattccggccagcggaggcatctcatgccctgtgaatgctgctctctccttatttctcctgaaaaatggaaatggtttggaccagctgctggcggagtctgggaggagcgaggccgggcagaatgatgagtttgacttcatccctttccagaagaggggaaggcgggaggatgccccatccaccttccagaaggcggttccttgcagtcaccctcccctagtgctgggttctctgcttctccatttgtcagagatgagttggcctccccctggttccccgtgtccctgccacccccacaatcgctgaccgtgacttccttttgtccctggcagaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattcagatttaaccctgaaaagcaggaggggtcaccctggccactcctggccaggagccatctgatgccgatgcctgcgctgagtggacagtcagtttccaccacgtctggaggcgtgaatcccagctgggcgaggaacctggctgccccgctcccagaagtcagggaacagtgagggaaggggcccatggtgctggccttcttgggcagcggctgtccttctccagcgtggctcctgctcaccgtgaggcagtgcttgtgtgggtccaaggacagattgcagttttggttgctctgatcgaaaccacggtagggcttgagagagaatcccctgaagaggagaggctgtgggctctgcctgaccttggtgaacccagggtgggctcttgggcacacggctgtggcagacacttggcttccatagcccacggcgagcttgggcaccccgggattcttgaaaatgccgatggtgacagtgtctgccagaaacagacatttttctattaaaagtgctttttaaaaagcttctccaccttcaccaccacagtggacccaatgctgggctgtacaactgtgttttcatgagggctcattcagaataagtaagacggcttgcaagttatgttcttttaaaatctacattgaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcacctgtagtcccagctactcaaaaggctgaggcaggagaatggcatgaaccccggggggcggagcctgcagtgagccgagatcgcgccactgcactccaacctgggcgacagcgaggctccgtctcaaaaaaaaataaaaaataaaaaataaaatataaaataaaataaaataaaatctacattgagaccgggcgcagtggctcatgcctgtaatcccagtactttgggaggccaaggcaggtggatcacctgaggtgaggagttcgagaccagcctggtcaacatggtgaaaccctgtctctactaaaaatacaaaaaatttgccgggcatggtggtgggtgcctataatcctacctactcgggaggctgaggcagaattgcttgaacctgagaggcagatgttgcgttgagccgagatctcgccactgcactccagcctgggcaccaagagtaaaactccatctcacagaaaaaaaaaaaaaagaaattccaaatgtcagttttagggtccacccaaagatgttgattattaataacttaaattatttaatttgttttattttttccctctgaatacccactttgttatttcaaacagaagaacgttgatgaggaaagtcactgtcttttagccacgaaaatgttgttcttgggggatatttaagcaagggatgcatgagaattatcaggcttctacaaagaaacagacccaattgtgtcaatatctagagagaggtttattatgatattggctcacttgactacggaggctgagaagtcccccgacctgccatctgcaagctagaaagctggagggccagtggtagagatgccagcctgcgtctgcagccctgagtaccgggaacagggtgggagaagatccaggtgctggcactagcagtccccggcagagagaggtgaatcccaacttcctccacctttttgttctatgggatcagatgaggcccacccgctttggggagggctgtctgctttactctatccaccaattcaaatgctcatctcctctgaacaccattccagacacacccagaaacaatgtttcattggctatctgggcaccccagagcccaggcaagttgacacagaagatgaaccatcccatgcacctttctaaagatttttttctttgatttttgagcaatgcttgagagttcacaaactccattcacaggattatctccttgaaacaacaccctggggagctgtgtcattcttgcttccatgtggagactcagagagaggtgaaggggctgggcgccatggctcacacctgaaatcccagcgccctgggaggccaaggttggggggaatcacttgagcccaggagttcaagaccagcctgggcaacatggtgaaaccctgtctctaccaaaaaaaaaaaaattaactgggtgtggtgggaggcacctgtaatcctagctatgcaggaggctgaggtgggaggattgcttgagccccggaggtcaagggtgcaatgagctaagattatgcctgtgaatagccactgcactctagcctgggtgacagagcaagaccctgtctcaaaaaaaaagacaggtttaagtaactccccacccccaggtgctggggttagtgatgtgtctgggcttgaatggctctgtccatttggtgctgtgttcactgagccaagttgagtgcgtgtggggtcctgtgctgggccctgggattcggggatggataagtgacttccctgctatgcaggatttgatttatgttcctcctggatgtctgcagtgccacccacccctgcctttgctgctttgctgccaaagacccccaggctgttttggccttggtggggcgagggctggctgctgcatgtcttccaggtttcagattgagaagaaggccacattgaggggcatggggtggactgatgggaaagctaattagcatcctttggggcaaagtacaactatggggcaaaatacaactaagaacaggaaggagctgaggaataaatgcctctccccgacttccctgatgtgggcttctgagaccatggctcatggagatgggctgcatggctgatcatcagctgggttttcttctgaagccatagccagctcatgcacctgcctcacctcccttcccctccctgttgctcgtctagggtgccctcccctcacccccaaacccctgccaaagaaaaggcatcagcagtgagctttgtcctggctctgtttttcagggaacctgggccagaatcatggtccccaaagatgaccatgtgataatccctggagccattgactatcatcttacatggcaaagggacatggtgggtgtagttagtgaccttgcaatgaggaggtcatcctggatgatccaggcgggcccagtgtgttcgctagtgtctgtataagagggacatggggagctttgactgcccatgaacatggcagcttgaccctggaggcaaggtggtagcttctggctctgaagatggaagaaggggccatgcactaatggatgcaggcggcctctgcctctagaagtggaaaagacaaagaaatggattctccactagagaacccagaaggaaccctggagcctccagaaggaaccagccctgctgacacctggattttagcccagtggaacagattttggactttgacctctaggactgcaagagaatccactgagccgttggaagcccctgggtttgtgttaatttgttacagtagccacaagcaactaacaccatcctgttctccaggctgctgcctccagctgcagctggcgtgccctggccactggggccaggcagggtgggttttgatacctgcagcggcagcatccttggccatttcctggaagggccagttgccagacactgagatgcctgttactgcaactgtcccaccagcctggagcacgtgtttctggagacaggcaaattctggaaggctccacctgctctcagactgcaggttgcgtctcaaagcaggctggcagacattttccactcttgatcaatcattttccaaaataagcatagacacagcaacccggagagcagcttcggtttggctgtcggtggcgtgttagttactgtagtggtggcacagaggcgatatacgttaaatattagttctcactgactatagccttttaaacagagcagcgtgtgggtggcagcaggtgagttggctatactgagcttgggctgcccttggttgattcttgtttgtcaggcatgcagggggctctctgtgcgtccaggcatattccctgtctggatttgcttgtgttcatggattttcagcacctcctttcttctggtttgggaatgagtcaggtcctcactacacaaggccagagcagtatgcgtgtgtgggtaggggtgagcaggtgtcattccctgcctcccctcctccttcactgccccagccaccctgaccaccttgctgttctgaggacacactgagccagtgcccactgggcatcaggtgaaaggggacatcccacaagcccaccctcacttctgacaccaatggcaagttcaggatctccaacactgccctgaggtttggtcatttgctagagggactcccagaacccacttaaagctgtcaccctcacagttacagtttctgatggtgaagggatacacatgaaaatcagccgagggaagagttgcccagggcagagttgaacgcacccacacagcacctccattgtcctttcaccatggggtcataggcagcgttactctcccggtgatgtgggacaatgcgcatgcagtattgccagccggggaggtcatctgagcctccgtgtccagagtttctgctggagctcacttgcatgggtgtggctgactgtccacatggctcatctgtctccagcccctccagcagctggctgatagagtgcaacccaaagccccctccctgaatgacatagttactccctggctggcccgagggccccaggtaagcagaggtactttatctggcagggcatttcggagcttaggagatcacctcccaggggctgaggtcacaggcccaacctctctgtgggcaaggttaggttcattatcacgtacctggtctttggactttcaaaggcccatgcctggagctgtcttcaacacttctttcagttttctctcaatgcttcctccttggagacgtatttcctgcccctgtcactccatcactctcctcctaaccccagttactttttctttgctgggcttgctgctgcctggagtcatttcctatttactagtttgtttttggtctttctcctcccctagaatgtaatcttatgctgtgagggaccatgaccattctcttcccagctaaatccccagggctggagttgtgctgcacatgcagagctaattcatccttgatagatagtaagagaaccgatgggggtctgtgtcagcagcaccaacatgaggttcacaccagcgtctcccaagatggcatgcggcttagagacaagacagatgtggttgctttttgttgttgttgttttgtgttgttgttttgagatagggtcttactctatcactctatcacccaggctggagtgcagtggcatgatctcagcttactgcaacctctgcctcccaggctcaagtgagtctcctgcctcagcctcccaagtaaatgggattataggtatgcaccatgatgcccggctaattttttgtatttttagtagagagggggcttcaccatgttggccaggctggtctcaaactcctgacctcaagtgatctgcctgtcttggcctcccaaagagctgggcttacaggcgtgagccattgcatgcccagccagatgtgtttttttttttttttttttttttttttgctctaccccaaacctgtgagatggcagggaggaggctctgggaagagggggtgagggttggggtaaacctgtggattggatgctgatgtaggtggtcccaggtgctcccttgggaggagatggacagtccggatggtgcagacaaaacacctccatccacattacctgcgtaattctctttgctttccagaacatcctttgtgtactgtggactgtgatgatctaatgctagtggattacatctaagtaggccttagtagaagccacctcccagtggttcctcggaggcatttggtccagaagcagatgattttagtgcaaagcacagaccgtatgcaggcctgagcagatcaggggacagacagatctggctgacatcctgatccgctggctgtggtggtgtggccattgcttgtagccacattgcagtcttgaatgtcccccttggaaatgggggacatttccaaggatgcctgcctggtcctctagttttctctttctctgttctctgtcatctgcacttttttcctcttgtcttgattgcttgtcctgtctcccctagtagacaccccctctgacctctgctgcctcaggactgttgctgtataaaatattgtgagatgccctctgctcctgtttaaaaaaaaaaaaaatccttagctctgggtaagctaggcactgagaatgaggccagtcattcaaaacttgtctctgagcattgattatactcatgtattatactgttaaggggtgaaggtcggctctagggtcagcttcctggatttaaatcccaactcagattaaagtgggagaataatagcaccaacgtgacaacctcaaagtgtcatttgtaaggataatgttagatcatacacttgatcacccgttagcagtgtaagggcagtgtgggaacatgagcatgaacagggcagcccagaagggagttgaatggacagatgggcaatgccagtttggaagtgggtgcatgcatccggtgggttcaggagcctggaagacttatccaaaagtcatctttgctggtgtttcttcctgtgtattttctctaaccttctccagcagtgacctgaattacttatgggtgaacactgaatgctgcccaggcaactagaggtttatagatgagatactttaaatttttaatgattcttaaaagagggagtggctattcttatgctttccagaatgaatagccaagggaaacctgtacagttgccatataaggagaaacctagacctggccttagcctctaggtcctggtgcagattcttagcacgtagcgcctaaaacctttgcgatttcctgagtgataggagcgtcttttgttattcataatgagatctgggtttatgctaacgaggtgactcagggtgggggctggccccagagtaaccaacacaggattagagggttgggtctatcagtcctacccacccccagcctctgggtggggtggagaggggctggagagtgaatcaaatcaccaatagccaatgatgtaatcagtcacacttacataatgaatcctccgcaaaacccatcaacagtggggttcagagagctttggcgctgggaaacacacatggaggtgctggagggggacacgcagggagagggcatggaagccccgcctccctccccgaaaactctgtcctgtgcagtgtttcttattaattacactgtccctgagttctttttttttttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaaaaaacacagaaaactccctaagcagattggttgaaagcaggctgactgcatgtcatctgggggtgcgtctccccccaagagcaggtttcacatctcattccccggttgattggacaagacccttcctgtctttaagttctgttttcttcctccctttgtctctccgaagaaaatcagctgcatgaaaacgatcctctgggcagaaattggtgctgttggagccgcacagaggtgccctcccgtgccccctggcccccaccgggccgtgtctcctcctgcctgttgcaatcagccctcgtccgactctttttggaagtgattaaaacataactgtcatagctctgggggagacaggctgcagatcctgattataattcagaaggatctaaagaaaaagtaattttttaaaaaaattctggttaaagccaaagctcataagacgtgtgtgatggagtggtatgcaagagcacaattaatgtatgtcctagacatctgcccacaggattcagggctggcaaatgagtgcgtccctaaaaataatgactagtgctatctttaaaaagtcttttgtggcatagcagattaagatggatggcctgggaagtacagtggcagcgtgtgctgtggtatccaggaataagttgtacctcctcggggtggcagtggaactgggccgtgaacagcttttgcttcccagagaggactgccatggcctgctgcatggaatttgattttaatctgtttgttatttttgggtttggtcttggactgggtttgaaatccagatgtgacttttttttttcttttttcagttttctttatagcagcaatgttgtatcttgtgtgtttcctaacaagactgagctctgagcaaggcagcctctggaaccaaatgtctgcaggcccaggagacctttctagaaagttcataggtgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaaagttcataggcggttctgcagtttgagccccttctgtgggtctgtgcctgctttagccgcttgagatatggcattgaacaaaacacaggccccgcctgggagaagctgccaggccagctggggagacagacctgataagtgaaaatgagatcgcgtggcctgcatgctccgaagaagactaaggcaggaaacaggactattttctcccgactgaattgtcctggtatccttgttaatatcagttgactgtgacttgagacttatcttggacacccctttctgttccgtgggtctgtgtctgccttgatgtcagtcccacagtttcgacgactggagctttgtagtcaggtgtgaaacagtggagtgtgggtcctccagttttgttcatctttttcagattgttttggcaatccaggagtcctttgaatttacatatgcattttattttattttaattattaatattattattattttttagatggagtcttgctctgttgctggagtgcactggtgcaatctcggctcactgcaacctctgcctcccaggttccagagattctcctgcctcagcctctcgagtagctggaattacaggcatgcaccaccatgcccagctaatttttgtattttcagtagagacagggtttcaccatgttggccaggctggtctcaatctcctgaccttaagtgatccaccagcctcggcctcccagagtgctgggattacaggcgtgagccattgcgcccggcctatatatgcatttaagacctgcttgtcaagttctttagaagccatctggatagtgattaatttgtaaaaatgatacttattatctttttgaactgccaaagtaatatatgctgctgaaaacctggaagacagaaaaatccaatagaaggcagggctaattttttttttttttccatgtatgtcccttcaggcttctctgtgtttttcatttttcctacacaaatttggaatcattccagagctagtaagcatctagggccacatttggactagtaccttgggataaattagagctggaattgccgggtcatatagtgtgcacagggctagggactgacttattttcctttctgaatgaagactctgaggtctagagaggttaaatgagtgactcaaggtcacacagctaaaactctggtggagctgggtcttaatgcagaccctacatattcatgccatgctgtatttatacaggcatgtacaccagcgggtcgggattttagggggtgttttaaaattctgcctgcaaaacctttttttttttttttttttttttttttttttttttgagacagggtcttgctctgttgcccaggctggagtgcagtgtcaccatcacagctcactgcagcttcctcccaggctcaagcaatcctcctgcctcagacccctgagtagctgggactacaggtgtgcactgccccacctggctaatttttaattttttttgtagagatggggtctcattttgttgcccagggtagtctcaaactcctgggctcaaacactcatcctgcatcagcctcccaaagtgctaggattgcaggtgtgagccgctgccccaggcaaacccattttaaagccatgagccaaaaattataaaagacatgcaaaatattatgagtagtcacttatctagtatttgcggcatctctcaggcttggggctttgctgggagctctgagggggtggaagaggctctgtcactggccttacctggctgtcaagggctgagtgtttggtggagggaagacgtctgcagcctgggaggctgcgggtcagaaggaggtcagccggggagctgggaggatcgtggggaacccgtggtggaaatcagcatggcgagagagtggaagcaggcagaggagggctttgaagaccaaaaagggtagttaggattgctgctctgtgtgtctgtaaacttggtgttgtctctcgaatttaaatgacatgctttgaaaacaaaaaaacaaacaaaaaccaaacccataaaatctcactaagtggccagagcaagttcccggggggtggcgcatagatgcagcggtctgggttctgtggctgggggagttggcttggggtccgtggctgggtcagtcttcaagagccaccctgggtggcactccaggtctcttggtctggggggaataccctgaccccagcggtttcacggcctcctccccactcagcctgggggagagtccagggtcggccctgtccccctccccccactcctgtcactatcagtcccctgtgctcagcttactggcagggttcctcctggctgtcccctctgcctccagcgctctttcctcaggtgtccacgcagctcgtcctcacccttttctgtctctgctcagatgccgcctgaggctcccaaaacagggtctcactctgtcacccagggtggagtgcagtggtgcaatcacagctcactgcatccttgacctcccaggctcaagcgatcctcctgccagcgagcttgttacaattcctgcaccaacacggatacattgttactaactaaggccctacaccagcaaagatacattgttactaagtaaggccctgcaccaacacagatacattgttactaagtaaggccctgcaccaacacagatacattgttactaactaaggccctgcaccaacacagatacgttgttactaagtaaggccctgcaccaacacagatacgttgttactaaataaggccctgtaccaacacagatacattgttactaactaaggccctgcaccaacacagatacgttgttactaagtaaggccctgcaccaacacagatacattgttactaactaaggccctgcaccagcacagatacattgttactaaggccctacaccagcacagatacattgttactaaggccctgcaccaacacagatacgttgttactaagtaaggccctgcaccaacacagatacattgttactaagtaaggccctgcaccagcacagatacattgttactaaggccctacaccagcacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaactaaggccctgcaccaacacagatacgttgttactaagtaaggccctgcaccaacacagatacattgttactaaataaggccctgtaccaacacagatacattgttactaactaaggccctgcaccaacacagatacgttgttactaagtaaggccctgtaccaacacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaagtaaggccctgcaccaacacagatacattgttactaactaaggccctgcaccaacacaaatacgttcttactaagtaaggccctgcaccaacacagatacattgttactaactaaggccctgtaccaacacagatacgttgttactaagtaaggccctgcaccaacacagatacattgttactaaggccctgcaccaacacagatacattgttactaagtaaggccctgcaccaacacagatacattgttactaactaaggccctgcaccagcacagatatattgttactaaggccctgcaccaacacagatacattgttactaactaaggccctgcaccaacacagatatgttgttactaaggccctgcaccaacacagatacattgttactaagtaaggccctgcaccaacacagatacattgttactaactaaggccctgcaccaacacagatacgttgttactaagtatggccctgcaccaacacagatacattgttactaaggccctgcaccaacacagatacattgttactaagtaaggccctgcaccaacacagatacattgttactaactaaggccctgcaccaacacagatacattgttactaaggccctacaccagaatggatacattgtacattgttactaaagccttgcaccaacatggacacatcattactaactaaggccctgcaccaacacagatacattgttactaaggccctgcaccaacacagatacattgttactaagtaaggccctgcaccaacacagatacattgttactaactaaggccctgcaccagcacagatatattgttactaaggccctgtaccaacacagatacattgttactaactaaggccctgcaccaacacagatatgttgttactaaggccctgcaccaacacagatacattgttactaaggccctgcaccaacacagatacattgttactaagtaaggccctgcaccaacacagatacgttgttactaactaaggccctgcaccaacacagatacgttgttactaagtaaggccctgcaccaacacagatacattgttactaaggccctgcaccaacacagatacattgttactaagtaaggccctgcaccaacacagatgcattgttactaactaaggccctgtaccaacacagatacattgttactagctaaggccctgcaccaacacagatacattgttactaagtaaggccctgtaccaacacagatatattgttactaactaaggccctgcaccaacacagatacgttgttactaagtaaggccctgcaccaacacagatacattgttactaaggccctgcaccaacacagatacattgttactaagtaaggccctgcaccaacacagatacattgttactaactaaggccctgcaccagaacggatacattgttactaagtaaggccctgcaccaacacagatacactgttactaactaaggccctgtaccaacacagatactttgttactaagtaaggccctgcaccaacacagatacattgttactaactaaggccctacaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttagtaactaaggccctgcaccaacacagatacattgttactaaggccctacaccagaatggatacattgtacattgttactaaagccttgcaccaacatggacacatcattactaactaaggccctgcaccaacacagatacattgttactaagtaaggccctgcaccaacacagatacattgttactaagtaaggccctgcaccaacacggatacatcccattactaactatggaggtgctttattcagatatcctcagtgtcacctgttctcctttggccgtctcagggttcctcccaggacaccacattgcattcagtcctgaggcttctctgggctctgacagtttctcagactttccttgtttctgttgaccttgacagttttgaggattactgctcagagagtttgtagactgtccctctgttggggtttgtctgatgctttcttcatgattcgatcaggttgtcactttggggaggaagtctgtgaggtcaagtgccattttcatcgcatatcggggcacacccatctgcacaccttcgctattggcgtcggtcgtcatcacctgtgcaggcgtgctcacccggtttctccactggatccagctttattttcctttctatcaaccatcacaacctgaaactgtgggcgtccgtgtgtctcttggagtctagtagaatgtaaggccctcaaggcagaggcctcgtctgtcctgtttgtcaccagagcctggtccgcagtggtgcctagtaagttagtccacccattcaccacatccttacagagctctggcgccaggcagcaagtgctggtgctgcggacagagccacagacaagccggtcatagcttctggcctcatagaccttggagtctaacaggggagagcctttcaaagatttgctcccattgctaatgggacaggatgagacagggtgctgggggactgagagctgtgatgggggatgctgcctggagggctggggtggtctgagctctggaggaggaagtgctgctcaggtagtgagggagggggtggtatctgggttaggggaagtggcgtgtgcagaggccccgtggcgcagatgagcttgggctatttgaagaaccccagcgaggaggcagggtgttcaggtggctgtggctgtggcccaggggcaagagggagatggggaggagtggaactggttaagaagtggacagaagtagggtgagaaggcaaagtccaggatctgagacaggaggatggtggccttcctgcctcccttccttcctgccttccctggaaaggagcacgcctggggtgtggtgagtcctgttagagatgctcacggaaccccctctccccaccccgccccgtggcaggggcatggagaggcgggccctgtgcttagggggtcctgggttagggacggcgctggaagttgcaggagggcagaaaccggcctctgaagagagtggggagggagaaggggagctgtccagggccctcaggcatgcatcatgtaagggtcaggggagtcagggaggatcccccaaaggaggctgtagagggtgaaggaggagggcaggaagccagtgagtgtgggggtctgtgggccatggggggtgggggaggcagctctttgggaactgagggggttcgggtgcagccctgggactcccaggccagtgctctccctccccctgccagccacctcgcagagagagcccggggtggaagcagggtagttggtgctgtgccctgaccttcagaggtggcattgacaagaccagaatgccacagggccatgcacctctccctgcaaactgccctttaatttatttttacctctgttccttgtgggcttgtgtgtcaggttcgatatttttatgttactgggaaaatagaatgtgcttcacagaaatttgccttgtggccaatattgcaggttgcagctgtttcagagtgacaggggacggtatattctggacttgtgcccttttgttcatctctgagaggggccataaactcccatttccgagaggttactgggaccaatgagatcatttattagttttccttgcacaggaaaatcacacactctgtgccattgattgagtccattttattttgtggaatagacatgtcagaagcaggattggccaggtggaattgtgtttggcgggagtcctgtctttccataggtactttcataatggaagcaatctccttctgaagtgtatcacccggtgaactgaatggaaaatctcttgtgaaaaggcttaagaggaaggctggcctggaaaaatgaaactcacatccacagagagacttgtacctgaatgttcatgtcagcaccactcacaatacctaaaaaggggtgataaccgaaataaccatcaaccaagggatggagaaacaaaatgtggtcccccatgagatggaatatgattcagcgtaggcacgaaagaaggacggaaacatgctataacatggatgaaccttgaaaacatgctcagtgaaagaagccacacatgaaagggcagacatcatcggctcctattaatatgaaatgtccagaaagccaaatccgtggagaggggaagtagatcgaatcacacacttttaaaggatgaattgtgtggagtgagaattctatctcaataagggtgcatacaaaatgcagctgacggtggtcacaccaagcctgtcagtaatgatgcataacttccctttgctgtcctgggttagggtgggttgagacttagggtgaccagggaggaatggatatcttgtgggtcaccttgactgtcttggggtgatgagagggcagtattaccaatgcttaatcatttgcccccataccaaggtgaacacgagatgctctggtcctagtggctgcagagttgtgcagcctctgtccctgtgctagctctggacctggtggtggccgcagagctgtgtagcctctgtctctgtgcttgctctggtcctggtggccacagagctgtacagcctctgtccctccgcttgctctggttctggcggctgcagtgctgtgcagcccctgtctctgtgcttgccctgtccttgtggtggctgcagagctgtgcagcctggccccagagctgtgcagcctctgtccctgtacttgctgtggtcccggtggtggctgcagagctgtgcagtctctgtttctgcactttccctggtcactgcctcattgccgtggcgctggtggactgaggccataatgcctgcgtctcctgcaggtcctcctcgactggattaatgacgtgctggtggaggagaggatcattgtgaagcagctggaggaagacctgtatgacggccaggtgctgcagaagctcttgggtgagttcacagcagggacagctctgtcccacccccatctccctgcagcggccctgggctgggccaggattctctgcatagtgacatcggccacaggtcctaggaagacactcaaagctgcagtgtgcatctcccaggtggtgcccaggccctgggctgtggcttcagggtcctctctccccttgccgtttctacagagcacccagccatggggcagcagcaggttggggacagcttccaaaactgcctgcggctcccatcctgttgggtctcaggcccactttgtgtccctgccaccctcttttgacttgaactccttcggttcaggatgggaggcagcaggagggaagcgggtctgcagcaatattctgtgagtgaatgtgtcaccaaatacatgatagctcatgttccctcaccaggggcgggctctagtgtctgcatttgctgggtgaaggcagtttagtgatcttcccgggactgactgatgcatggtttgatgtgcagacaaaccggttgtttattcatcagatgttggatgagtcccgagggctgggtaccagggatacggtgatctttgaaacagacgtggtccctgtcctcagaacttacagtctgtctgaaaagacaaatatttttgaatggttacagttactgttcagattgcttgtgatgagggccttcggagatgccgcaggttctgagtagaggacgccggcctggcctgggggtggggcggccttgcagctcatatggaagaacgagcgaagagttgccaggcaaagaacggaagagcagagttcgcagatgatgcatgagaggaattcttggacttgtagtgggttctcacgatgcctggcactgtcatgtctcattgtcacaatggtcctagggggcagtactgccatcgccttcgacaggtggggacgttggggcccacagtctcctggtgaacagccgggcagcctggccccaagcatagctcttgagcccggccgcggggcctttctctgacctgtctacggagcagccccaggtacagggcctgggtcaggcgctcctgcatgatcacagctggttctcacaacagccctgggggtctggctgaatgagcagatgtccctggttgtccccacgatgccttttgtttggatccaggagtgaatcacacatgaacgtttgtctcttcttttaggcttctttcatctggaaccgccttccctttccctctctccgttctgttctgtctttctgtcttttatgacgttttggaagggtctgggcctcttgtcttgtagaatatcctcccatcgggatctgtctgtctcctcacgatgagatctgggtcacatgtttctgctgagagtgtgactgcgctgcctgcttgtcctcctgggggcatcgtatcaggaggagcacacaatgtcaggctgcctgtcattggtggtgctgacagtttgatcactgggttaaggcagtggcctatgggtttctccattgtaaaggtgcttctttcctgttaaaaaaaccacttttttatttgttctattttggtagagtcaggatctcactcagttgcccaggctggagtgtagtggggtgaacatagctcactgcaccctcaaactcctgggctccagtgatcctcacaccttggcctctagagtagctaggactacagatgtgtaccaccacacttggctgttttttttttttctttttttgaaatggagtcttgctctgtcacccaggctggagtgcagtggtgcgatctcagctcactgcaacctccgactccctagttcaagtgattctcctgccttagcctcctgagtagctggggttacaggcacataccaccatgcccaggtaatttttgttttttagtagagatggagtttcaccatgttggccaggatggtcttgatctcctgacctcatgatccacccacctcagcctcccaaagtgctgggattacaggtgtgagccactgtgcctgactggctaattgttttgtattaaatttttaaatttcatttttttgtgttagagacagggtccttgctttgttgcccaggcctgttttgtactggcctgaagcaattctctcatgttggcctcccaaagtgttgggactacaggtgtgagctaccatgctcagcccttctttcctttttaatacatggtctctagaggggcagactctgggactttgtgaacgtcctgttcacccatgatgcgctccccatgattttatcatccgctgattatcattctctaaattatgctaaatatcatctctaaatattatgctggaggttgcaaaatagtgatttctgtatctttatcatggcttccccacttattagctggcattttcttctgtaaataagtgcttttcttctcctgtgtccttttttaaaaaaaaaaaatcccctaaaatagaataacacattcccctggactgatgaattattttatgttcaaaagagaatggtaattagatagcaaaatctgggccttatgggtgcttgtggctcctggggtgtcattgcttctagtctctttaagccaaaagaggtagcaaatatatagttttttaaaaattgtgagttcacactgctacttctaattccagttcaatgctacaagtttatcccttaactgtcagcattcagtattccagtctccagggagaaccttggttccagaaatatatttgctatttactctgattgcatacaaaaatagtgtcagaattacaataccaatacctctatcaactacaaacatgctaggtacaagatttctttgccattattttttaagtacaatatatccactaagagtatatagtcagaattctgtgttcagaacttaactgaattattttctttttgagtggtcatgtcatccatttaatgtataaataaattaatttgtttctctctgtatttagtttttgtgtatatgtttacatttaattttatttaatattacttttaaaaatgtaaagcatttacatgcttcaaaagtcaaaactatggaaatgacataccttgaaaggtcttagccaggtgtggtggctcagcctatcatcccagcaccttgaggggctgagccaggaggatcacttgagccgaagagtttgagaccagcctgggcaacatagtgggacctcgtctctacaaattaccagtcgtggtgatgtgcaccgtgcacctgtattcccagctgctcaggaggctgaggcaggaggatcacttgagcctaggaagttgaggctgcagtgagccatgattgtaccactacattccagcctaggcaacagagtgagaccctgtcgatcaagagagagagagagagagagagagagagagacagagagacagagagagagagagagagagagagacacagagacagagagagagagagagagagagagagagagagagagagagagagagaggtctcactgctttctctcccacgtatacactcccaggtaacaattttcaatggattctgattttatccttcttatgtttctttacaaaaatgtccatatacacacctactcatttcccttttattccttgcataaaaggtgatgtattttgtacattcttttacacaccctgcttgtttcgcttaatatgttctaggaatccttgcatgtggagatcacctttctttttctttatggctgcattgtactccactgtgtggatgttccttcgtttattcacccagtctcctatgtggggcatttttgtcatttctaatatttttctatcaccagtaatattgtgggaatatcctcgtgcagatgttacagaaactagaattgttgacctcaagtgtaatgggttgcttccttgagctgaccactgtagaggaaggaattctcaaattctgagaggcttcacctctctcacctctggccttcccaggtctgttgtgccttggttgatctttcctgtagccactttctgtcttccctggactgttcagtgtgcagacatgatgtaatatttccattaaaaaatggctcccttgctcctgcaacactccaatttctctgcatcactcaaatgtattgaccattagatttggcaccggatgggtcattggtggcccagatgagagcagttttggcgcagtggtgggggtaacacgctgatcggggagggtccaggggcagagaactgtgcctttgaggtacataattttgagagggagagagaggaagggagtgaacctgtggttgctgcagctgcttttcttttcaagacagggtctcactccattggctggcctggagtgtgggggtacaatcatggctcactgcagcttccacttcctgggctcaggtgattctcccaccttagccgcccgagtagctgagagtacaggtgcatgccaccatgcatgacttattttttgtattttttatagatacgaggctttgccatgttgcccaggctgatcttgaactcctgggctcaagcaatccacccacctcagcctcccaaagtgtggggtttacaggcatgagccactgcgcctggccaatacgaggctttgccatgttgcccaggctggtcttgaactcctgggctcaaacaatccacccacctcgggctcccaaagtgtggggtttataggcatgagccactgcgcctggccatagtagctccttttcatgtctgtccactgggaaccatgcaagctgcctgctgaaattacgtggatggagcccctggcacagtgcctggcacaggtctgtcgtcaataagcaggagttgttattgctgttgttttttaaacagacaaataaatgccaagagcagaactaaggagtatctggctcgctgctgggtaccccatccaccccaagtcccctgggtgactggcacatgacaaatatttgttgattaagtcaatgaaagaattcctgcagtttcattacctatgaagattgtggggtcctcttgtgggacatgaaagggggacagatagatgagtattgtttggatttttggtcctcagtgccatccacagactccagaagggatcagctatttgctgaacaatctttcagttctcatagagccctgatatgttttcagggtccacaaatgcctgtgacggtggcctcaagaacccagtgtccccttgtaggtgggatagcatacctcttaaaggtcagcatgagattccacccatgtcatccccagcattggtggggtcagcagatcctctctctggggtttcttttctgctcaacctccctgctttgatggactgcacagacaagccccatcttggtggaagggtctccccatgggctgtcctggagggtcactcccacagatatgccccatcctggtggaagggtctccctgggggctgtcctggagggtcagtcccacagacaagccccatcctgtgggagggtctccccgtgggccatcctggagggtcagtcccacagacaagccccatcctggtggaagggtctccccgtgggccgtcctggagggtcactcccacagacaagccccatcctggtggaagggtctccccatgggccatcctggagggtcactccctcagggcagggctggtgactggggtgggatcatgtttttctccgctgttgtgacagaggagtatctgctgcaggggatacgtggactgcggggggactgccacaaggatgtgaatgggtagggggtggggtgctgtttaggagagagagagactaggggagcccctgccagagaaacttggccctgaaaacacaggggtgcagcatctgtagctgcctctggacagagtttgcacactctgcacaaatggctcttacagaccagctcttggagggaaacctcctaggcttgtgacaggtggtggtgagggtggggggatgaggtgctggggaggccatgtcccataactcactctgaaggacacagtgatgcttggaccacattgtttgtccttattcatctggccctcagaaagtatatttggagggaaacatgtctgtgtttgttttggtcacacattcattcattcatctgatgaatgaatgttcattggcttacatgtgtcgggtggctcttggctgtagagacacagtgggaaacaagagagatgagccccgcaccctgcgcctgcccactcccccagcacacattctagcagagtgaagaaagagaagtattatggggtggagtggttcaacctgaaacctagatgatgttttaaaggaatgacaagtgctaggaggaaagtaatagaaggttatggggtacagtggtgggtgggggttggggaaggcaatccagggaagctcctctggggaggcgacatctgagcacatgtctgcacagtgagcttgggaagggcgttctgggctgaggctctaaagcgagaaagagcctgttgtgttggaggagcagtgaaaagaagcggaggcggggcccaggtggcagagagggagggagagagccaagagatgaggctggggccagatctcattcagccctgctagacaacagtctattccaagtgacaggaagccattggaggttttgggtagggctgtgacgtggattgggttagagtttaaaaggtcacttaggcttctgggtgcaggatggatggggaggagagtcaggagttggaactgagagatcagtcaggacaccattgccatggcccaggcatctgatgaagtagctcagcccccagagtggaagggcagacatggggaggtactgtacagttaaactgccataggaaccaagactgatggccaggtttgtggcttgagcaactggtaaatgggaagccgttgggagtagggtgggaggttgggaaggcgggggtctgtgttgtacatgctggggctgagatacctgcccttttggaggtgatgctgagcaggtgagcctggagtccaggctgcagtgtacgtgtgaacccagcagcactgagctgatgtttagcaccgtgggactgcacggcttcacccaaagagggtgttccaaattttatttggctgaatgccgaatgcccaagaattaacatctatatttggctaaggtgagaatccccatcttagaatgagatcccatggtacaagaataagtctgaaatgttcatcaagattgtgtcataattatcacaattttattattaaaaacgttagtggccaaagttttgatgttttgcattgcagtatcagtacagtcacacccagcactgttgggtaccacttgctcttgaggtcttcaaaccagacatttgtgatgctagatgctcactttcaactcagaaggctggaggagcacgtggacctttggctgatgctgtctgaagggatactcctcatgtgaagctgcccctgggctgtcagtttttctctctctgagtggctggttatggtagagacttacctcctctttgatcttggatgtgaagattgggctgttgctggtgatggccctctgttgaagcagtccccccaattggtactttgctccctacctgaagcagatattttctaatattttcagaagcaaacttgagtgttttgttcactttcattttttatttctgattcttttgcctgcacctgtggcttctcccacccaatgacttgaaacagtatgtcagcaagccttgtatctggcagcctggctgtggaactggccctcagaatctcaggacaggctctgaatttgcatctgcatctcagccgtggttgcctgtaaaccatgccagtgccttctatagagcagaattacaggggcatctttaaagctgcatcttcccctctcaaggcacatccttttggttccctcttcagttagtgctagcaaatgcagcacttactccggagttgctgtgattgtccatgagtcctgctatatcagttgtgttatccataaagtataacatgaggcttcctttggctcaagcagcctttttcttgtggagtagctgctgttccatcttgtttgaataatcacataagcacttgagaaggcaattctaaaatctcttgagtgtcaagtggtttgacatattaaaaccactttttttttttgtactgaaaaaaagaacagtggactagaatattcagatagtaacacagcatcagaatgtcttgcctcattttgtgaatgttgttacactgaaatgacataatatactgttgatgtgagatcctcttgatgtgatactactgatgtgatcacctgatccttgagctccaggatgccaggaatgacactgatgtaggcattcagctctttggctttccaaaggcagaagcccaaaccaaataggagattttagctgaataccaaggtcaaagccaacttctgtgcatccgtagtagagaagaggtctgaggactgggtctgggctgtcagccattagtggtcaggaagaggaagttctggcaaaggtcagtcacaagggagggggagccagaggagtgttgcattcaggaagggtaaaggaggtgtttctaggaggtgagaggaggaaagagaacagacttctggtttggccatgtggaaattgcccagagtgaaccagcaggacccctgaggagtccctcttctttttttttttttctcttgagatagtgtctcactctgttgcccaggctggagtgcagtggcgtgatcacagctcactgcagccttgacccctaggcttggatgatcttcccacctcagcttccccgggaagctgggatcacagatgcataccaccatgcccagataatttttgtattttctgtagtgctgaggttttgccatgttgcccaggctagtcttgaactgggctcaaacgatcctcccaccttggcctcccaaagtgcagggatcacagggatgagccactacacccagccgaatccctcttcttgagagaagattctggaagcagctgccgggttctctgccacatgccaggtttctgggggtgtagctcccctgtgtttgcagtgcagccctcaaggtagactgcatatggccagagtgaggtgcccgtgctgtgggagctcctggctgtcgtcctgctggtcactcacgggcacaccctctccttgtgaaggtgaagttcttcatcacatgtgtactcaacccccatgtggccatcactcagggtcacctgctacatgggagaatcctccccagttttctctctttctgtgctaggaagataggggtcctggccacaacagagccctgagctgctcctgcggcccccgccagtgggcacagtgatgtctgatgatgcaagtgatcatgtgccgtattctctgttgcacaggagtcacccaagacccagcctaaggcagcacacaggcatggccagtctctttggtctctgttgcctgctgtttccaccaccaaattcatattttcaagtcctacatgcagggcccacccatgtgacctcattttaccttaactgcctctttaaatacaggcacattgcaaggtatgagagcctcgcccactaggagagatgggtagcctggcagcctcccactgtccctgctaccagccagccctgcaggttgaacctcggaatgtgactgtatttatagagataataataggctgggtgtgatggctcacacctgtaatcccagcacttccggaggctgaggtgggcagatcacttgaggtcaggaattcgagaccagcctgatcaacatggtgaaaccctgcctctactaaaaatacaaaaattacctgggcgtggtggcacatgcctgtaatcccagctactcgggaggctgaggcaggaggatcgcttgaacctgggaggcagaggttgcagtgagctgagatggtgccattgcactccagcctgggtgacgagagtgaaactccatctcaaaaaaataaaaaaattaaaagaggtaatgaaagtaaaatgaggccatacgagtgggtgggccctaattcaatatgtctagggttcctataaaaagaggagattaggacacagacatgcacagagggagaccaagtaaggacacaggaaggagagggcagccatctacaagccaggagaggggcctcagaagggtctaccctgccggtgccttgatcttggacttctggcctccagagctgtgacataaatctccgttgtttaagccgcacggtgtgtggcatgcttcgttgcagcagcccagacaaacgaatccagtgtcctccgctcctctgccgactcctcttcctccaccctgggtgacgtggccatgttcagtctgcggggccggatggtggcaggtgcaacgggggcgcgtcaggcttcccatctccctggtgggcgaggctctcagaccacccagttctgtatgatcctatctctctccttccttctccaagctgccctgctctgccctttccatggttgttgaacacctgtgggacctacttgctctctacttccagggcgcaaattcagacagacagctgtggatgactcagcgaggagctgttagatccagatggagggaaatcagatgaataagcgggaatcgtttccactcccctgcaggatgtgttttgttgggctgctttgttttttctcttgcagtcattgccacccaatcagatgttttttacgggtgtttatctccccactagggacctctgttatctgtgccatatccagcacctaggacagtgcctgtcccatagtaggtgttcagtccctatctgtgagccaacaaacgcatgatcgaaggggtattccgagcccagcaggccttgctctagaattttattatcttgaaagggatgccaaagctgtttgttttctaattgagggaggggaggctgctggggagataacactgaagacatgggggcctccagctaaaatgttttaaacagaactttgtgctgggaaccacttgcaaaacagaaaccccatttgtgactggcctggacttgattgctttcatgatggcatgtcaatgccgcgtcactgacagcagctgtgtattgaaggctctgtgctgagtgcttgcagtcaccctcccagtgaaccatctcacgatgctctgtgacgtcgcttttgttgttttgcagagtggatctatcagtaaacactggagtcttagaatcgaagactagcagggaaactgggggtccttcctgctgtgtggccctgcagcgggcgtggggtggggcgctggtggccggcacctgccagtacctactgctaacaaaagggaaattgaaggaggtgcaggctgggctggagctcagtctcagtaattgaatcttgatgaaatgtgacagttcttgtctgtgctcctccggattgtttcctgttcattcttggtaataaaatcatcgccagttctgtgaatatctaatctaacttcctattgtggcattagaatgtttaagaaacaagaatgggagcctcaggtgtgtggggaggcagaggcagcttttaagaccttttttaaaattatctttatcagtcctctcccttttgggacccacagggacagtcttctcacctcctgactcccactttcattcttcccaggtaacctccttgcctctcaactacatcttattatgttttttccattttgtatgcatagaatgttcccgagtataacacccacagttttatccttaactattcttcccttttcaatctggcgtcattctctaaggaagattagtgacctggaagctcagcgttcatggttcaacatctcaagacgcccccatggccacatggtaacctgccccgcttcggggacctccttgaggctggggtcttggtggttttgagttcctccagtatatctctctccccttcctccctccctccctccctccctccctccctctctctctctctttttttctttcttctctctctctctccttccttccttccttcctttttctttctttctctctctctctctctctctttctgaggcagggtctcactcaggttgcccaggcttgggtgcaatggcatgatcttggcttactgcaacctccacctcccgggttcaagcacttctcctgcctcagcctcccgagtagctgggattacatgtgtgcgccaccacgcctggctaatttttatatttttagtagagacgggatttcaccatatttgccaggctggtctcgaactcctggcctgaagtgattcacccacctcggcctctcaaactgctgggattacaggcatgagccactgcgcctggcccttccagctttttctgaccctcttctcttgtgcttctcattgcagaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactgtgagttccacgccacagggggagggactgtctggagggagcccgtcctctcgacattcgtcatccacatttgtcatccacattcatcatcatcccatctggccttgcatcttaaaattgggttcatctccctgctctgtaagaggtagaacattgcaggggagaagaacaggagaagggttagggagatcctagaaaagggacctggtcaggccacaattctccatcctccccatgctgcagaggagagaggcaatgtttatggatgggtggatcagagggactttgagagagagaagcagccttggggggttcttgttgggactcaaccccaaatactggtggcagcaacacctagtgggctgtttgtctatgaccctggcattatgagatgtgacatcacggtattttcagccaagacatgaacccggcaggtgaaagactaaaccaggagaagctggaaagttctcctcggtcctgcccactccttccccacctccctcccctggaagcagggccatgagggtgtggcttcagggctctctgtgctgggccagaggtctccgtgctttggtgagctgggctctcagtggtaggcaggagaccctggagcctggccttgcacccggtttcttggtatcgagaccttgggcagacccaggctgtctcgtgggtggctgggtccgtgggtggggaatcgggtgccttgtaaactgtaaaaccctgcaggagaagtggtgatgttgaccaaacctgagtccgcatgctgaggaagagagaggacagactcaggcaaggcaggggctaatgtctaatgtccccagagtggcctctgctcttggcagcctacccttgttgggatggttcattgcggagagggagcccttttttagtgccagagataataacgcacatccttgtgatgggtaagtggccgtgacctgctttccatgctcttttcccttctgtgctaattttactatcctgttcctttccctcatcactgcccaatttattgcttttaaaaacattgtgcttctaaaagtggttgcacaagtcaccttaggccaacaggaaaggagacagtgaagctagaagtaaattcaccaggttgctcatcagctctcttgatttgtccacacttcgctccatccttgtctcgctggggtctcatttagatgctgtgtctctgttgccttctgcacgtgggctcaggttcctgtgtaacctgatctaaagcgtctcccttcctccttcctcctgcagcaattcacgggaagaacctggtggccatcctccacctgctggtctctctggccatgcacttcagggcccccatccgccttcctgagcatgtaacggtgcaggtggtggtcgtgcgggtgagtataaccgagtggtcggcctgcctgtaactccgccagagaggcaacatcttcctcctgcagttttcctgccctccccctccttttttccccccaggaggctaccttctatttttcccttttgacaaaatgtgtgtctcaccctggctccgagataaatgattggaacgggaacaatggcattgatttgatgagaggcagaagcagaggcatgagggtgttgaggtttaattttccacatttttgaaaagaacattcatttctctccaaagccaactggttggaattcaatccccttgaatgtgcttattactcattggaggaggttggccccgcgggatgaaacagacacccaaattaaagccgctttgcattcgttggggattattcatcatgccccatcatctctttttttgggttcatttctcttgattcacttggagaaatggaaccagaacccaggtccttctaacagagggtgaagtagagttacctttctcttgctatttcccttacatttattttttattttattttatgttttgtgaaagggtttcactctgttgcccaggctggagtaccatggtgcagtcatggctcactgcagcctcaacctcttgggctcaagcggtcctcccgcctcagcctcccaggtagctaggactacaggcacatgccaccgtgcctggctaatttcaaatttttgtagagacaaggtctcgctatgttgcccaagctggtctcgaagtcctgggctcaagcgatcctcccatctcagcctcccaaaatgctgtgattataggtgggagctgccatgcctggccttatttcccttacatttaagtggacagtcgctgcctagggttcgtgtgtgcagtttccctcagtaaatgtgcaatgagcgcctactattctctaagcactcagcataggctgccgagccactaaaggaggaacacatgcctggcgtctgtgggggtgaccactgcggccagagttgaggtcacgctcggaaccttggatgcctctgtgtttattttactcgagacatccggctccactttcctctggtttttaaacttctcagtcccgtggtctctgtggtcggggaggacctggctgtcactgtgttttccgaacccattctggcccctctgttaccctgggagctcagtcttgaccggacgggaatgctcctctctggcatccggcaagggccacctgccatgtgtccatgtttccttcctaaggaggatgtttgtggctggtggtggtgactcgggacctggggggccattcctatggccccgtgtcttggccactggttcacaggcagccggcctgaaaaggcttccctaggacacattgggatgtggttcccaagcctacctacgtcagctcggggccccaggagccctgtgcaggctcagaaactggagtatttcctttcaggcttgcacttgggtccaagataatctttgcggtttgcagaaagtttgaaccaggcaagcacttgctggtgcttcctgccataacgggttagaggagtgttgtttggccacgaccaaagcagaatgaaacgggagcagggggtcctgtgaaccgggcgcagttactccccagaccttagagccgccttctgtcttctctgcagccccctggcctctgagcttgctcaggggaccccttatctaaccccagatggaatggttggtgtaagggatgtggcatttccagggtggaaggaaggaaggaaagggccttatttactgcctggccacgtggctttgggctgatcacttgcttttgctgagctgcaatgcttttccccataaaaccaagattttactacaaacctgtaaaacatccagcttcatgtctacaatcctagacctgggcccagcacctggtgggtgcctcaggcatgtttgatccttgactaggtgaacacaatgtctggaccttccttggcaggcactcctgagaatcaggataaatgtcacccacactgttgttcaataacaagcaccaaccctgagtattccatggaggtcaaactcaggaaagggatggaagcccagatcttggtggtgtccactgtgggctggcccagcgggaaatgagttcccagtcccttgaggggttcagtggtggttggattagccacccaggctccatctggagctcctgtgacaggcgggctgccacccctaccatcaccactgccatgcccccctcactaccatcattacttttttttttttgagatggagtctcactgtgtcacccaggctggagtgcagtggcacaatctcagctcactgcaacctctgcctcctgggttcaactgattctcctgcctcagcctcccaagtagctgagattacaggcacatgccaccacgcccagctaatttttgtatttttagcagagaccgggtttcaccatgttggccagaatggtctcaatctcttgatctcatgatctgcctgccttggcctcccaaagtgctgggattacagctgtgagccactgtgcccggccatcattgcttttctatacctgccacgctctgggagaagtgtgacatatactgtgtcagtttcctagggcagccataacaaagtaccacaaaccaggtggcttaaaacagcagacatttattctctcgcaattatggaggccagaagtctgaaatcaagatgttgtcagggtaggatgtcctccctcatgtctcctcctctaggggaggggtcttcctgcctcctccagcttctggtggtggctgtcagtccttggtgttcttggcttgtggccacatctctccagtctctgcctctgtcatcacatggcctcctccctctgtctgtttctgtgtctgtttcctcttctaataaggaggtgagccatattggattaaggaggggctcaccataatccatgatgacctcatctgagctagtatctgcaaagacccttatttccaaatgagatcatgttctgaagtttgtggtagatatgaactttgggggaccctcttcagtcccgtgcacacacatgattgcaggggatgttccctgttatttatgttccttccaattgcatgcctcacctctcctggctgcaaagcatagaggatccctttggggaatcctgacctggggtgtttctcctgagacccacacaaatgccaactctcaaggccacgtggagaccagagggtggggaggaggatagggacaggttgtggtcgctgaaaggcaccctgcccagggtcccctgctgtgtactcacccaggcctggcatgcgtgttcaacaccacccctccttctcctgttgctcttttctaagatgatctccggccccgcagcttcgtctgccctgtcagtgcatctttcctcaactctccactgcctgattttgtatgtttattttggggttttcagaaacgggaaggcctgctgcattccagccacatctcggaggagctgaccacaactacagagtaagtggacccctgtcttgcccttccaggccctgctgccccgagtgagtgggaccccaggctgccacttcagccagggacaccagcgcccatggggctgctcccgctccacaccccttctctgtagcatgtgattctcatgctggttcccaccccagctctcctccctctgcacactttcttcagagtttttaacattagaactgagttaccttccacagactttgaattttttcattcctatcttaaaaggtgagctgtaagaacattgcaaagtggggcaggcagagagagttcaggatggttagagagaaccattgtctcagttcatttatccatctacattagccccatcagaggtgggagctacatctttaaaccagaactttcctttgacagacactactaagccatctgttatctcctagagaaagccagagggcaggtgttcagaagtctaaaaggcttcaaatctattgaaaatagcaaatcaaacagtatctgtggtatgtggttttaaggactccttgtgataacctgctaagaatctttagaattcactgcatttgtgcctcttgactaaacctgtttcagatgaaacagaacatttaaaaattgattgtctcagctaatccatcagctaagttcacagagtgattaattactgtgttgtgaattcatggatggtatttcaaaaattggagctgacacaggaaaccactcgtggcttgcaagctctcagggaagatgatgggacagtggagtgcaggctgatgcatgtgcagaggcccatgaagaggcctcccagtctgccccaggcccacgaagggaacagggagagctggaaaaggggaggatgagaatgtggttctttgcccagcacagtgggcctttggcagcagctctgcctattcagcagtaggagaagggctgctcgtggggaactgggattgggctggtgtcttagttgtttattgttgtgtaacaaatcacccccaaagtcaagtggcttaaaacaacatctgtttcatttgctgctcacaattctgtgggtcagcaatttaggctgggctcagctgggcggttgttcagccagtctcgcctggggttgctcatatgatgcagacatctgaaggctggatggaggctggggaggctgagatgggctccccctacctctggtggttggtgttggcctcccctgggtctctttcctcctcacagtgctgggcatcttcccagggtgctctcagggtcctgagagagtgagaatgcagctgcagtccccttgaggccttgtcttggacatccatacctatgtcctcaattctgtgagtcaaagtgagtcacaggtcatcctggatcaaggtgcaggaaacagactctgcctccttgtgcaggaatggcctgtgcacattgttgggtggtgggcatgctgtgataggagttcccctctaggtgagggggtcccatatgaggacagcaaggaggagctgggccccctgccataaaactagaatggtccagagacagagaatgagcaagtgggtgggagaattgtctcagctattcatcagcagtaagtggccccaaggacctgctgcatgccagcctccttgctggatcaacagagacactgagaggtgggctgagtgcagttcttttcctccagggcgacccatcctgctgatgagaaaggatgcatccacagacatgtacagtctaacacaggggcttgtgggaagtgcctcggggccctaagggaatttccaggaggaggggagcaccccaaagtcagggaaggggagatttcagtgaaagccacctcaatcagatatcagatggccctgagcagtgaggaagggagttgggattttctagcctgagtcagtgtccctctgccagccagggtcagggtaaaggagaggctgggtcacctctccaggatgatgccccaggtaggttctcctcagggctggtcatcccatccttgtctcctgttccttcccctccccgtggctgcggaggctctgacggaacatttgaatcattggatgtctgctgaaaaccagcggcccaaagatccacattcagtttcctaaggcagcattgccacctcctatccagtctcagtgttcccctttctctttcaagaggtggctatgaggtcaccccttccaggaagccctcctgtctgccaagcaggagtgcttggcttcctgttagttcccttagcctctggacacatgtggccaacattgaaatattggcttatgaggtctgtcactcccaggcatcctgagggcagggccacatagtgtttatctccaggggatgttaatttctgtatctgcacagcctgcacatagtaggtactcaagtaagtgcttgttaaataagatggagccaaaggacttgagcctagagggatttggggacaaagtaaagacttccttgcctctcaggaaggcagtgcatggaaaggatctgtgcactcactcactgggaatctttgaggagaagctgctcaccactcccgtctcccccattgcttccgctgccgcctgcctgagatcagggcctggcctcgtggttctccaggatcctttagttccacaagtcctgcaagtacattgtgtttactcctggaaacatgagtaacctgcaaccttgtgtgtgtgtttgtttgtttatttatttatttgagacagggtcttgctctgttgcccaggctggagtacagtggtgcgatcccagctcagtgcagtcttgacctcccaggctctagcgatcctcccacctcagcacctgagtagctgggactagagcgcacgccatgacacccagctaattttgtatttttcttagaggaggttttgccactttggccaggctcgtctccagccttgcatttttttattgttttgtttgtttgtttgtttgttttttgagacagagtttcactcttgttgcccaggctggagtgcaatggtgcaatctctgctcactgcaacctccacctcctgggttcaagtgattctcctgactcagcctcccaagtagctgggattacaggtgcctgccaccatgcccggctaatttttgcatttttagcagagatggggtttcgccattttggccaggctggtctcgaactcctgacctcaagtgattgacccgattctgcccctcaaagtgctgggattacaggcatgagcccctgtgcccggcccagcctgtgttttgagcgttccacggctgctggaagacctgttgtctgctgaaatcttcatattaaccactcttctgatttaagtacctcccctccaaacaacattaccagggtggttaatgtgcaaatagagatggtgatttgctgctgaccttgtgcaaacattaataattcacacaagcacctctcgtttataattagagcaggctggaacacagcaccatgtgacttgcgttcttatcagtaggcctttacctgggcagcgagggcccagctttctggctggctctgtccctcatcctccattgtgctgcttgtgaaactgtgttctgagtgacccatctcatggctctctctgtgttcttgtttgcaggatgatgatgggccggttcggtaagtaaccccagggaaagtggggagatggaggcatgttagggctcccccaggaagctcccagagagtgtacatggttatctggagggagtgggaaactagatgggtctcactgcccccatagttctggaatcctagagaaagtgcacagcccacccccacctttctgtataatgggcttgtttctcagagctgagagtggctgggttgtgctaggaggagtggggtggaaggctgggtgaccagctaggggagcaggaggggcctgggatgtaacactggctggaactgtcaggggctggagcaagagtggttgagggtaaaagggagggaggagaggcagccagcacatggagcgtcgttagctggctggaagagagtggctcagctctgtggatgtccttccatgtgtattatttcctcctggaaaccactggtttagcagacttccttagagtcaggcagccagggctcattcctggctggtggcttgtggcctgccccttcctctctctgctcctcatccgtgaaatgggagtgtaaaaggctctccccaggcaggggctgctgtgagtattgggtgagatcacaggtgagtgccctgcttggccgggggacagccctctatgtgggctggttttattagtgttggttttcagtggctcttcccaaagagagagaggtaatcactctctcttccctcatgaaagcctgagacctcatcttcatctcggtgagggatggtaacgtttcaaccctcagtaccaggataccccggccctcggcctggccagcctcagtgctttgggaagcatttcaaaagagaaacctcttgacccccagataccctgttctccagtgagcagggaggggagaacagctcttaaaaggaaaaatggaaaccagatagaagtctcccacctgcctctctagcggagctgatatctgtcttttgggggccctctgggtgggggtgccaccccctgagtcctatacaatgagggctgggccagcttggccatggggctctgtaacctcaagttattatggggaccagctaggatgccattgctgcttatctattgtattagggttctctagagggacagaagtaatacgatagatagatatatataaaggggagtttactaagggtattaactcacacgatcacaaggtcccacaatagtccttctgcaagctgaggagcagggaagccagtttgagtcccaaagctgtagaacctggagtttgatgttcgaaggcaggaagcatccagtatgggagaaagatggaggctgggagactaagccagtctagtcttttcatgttcttctgcctgctttttattttggctgtgctggcagctgattaggtggtgcccacctggattaagggtggtctgccttttccagtccacagattcagatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaagagaaacatcctgtatatagttgctgagggaggcgaaaccgcagtggggtcacagctcatgggaccggggtgaggcgtctccccaccctgcgtctaggtagaggcgcgttttgggggcccagtgcccccctctgtcacctcttctccatcttttcttcctggaggaggctcagaacccctttggaattgtagaggcctaaagatgaggagagggccgggcgcggtggctcatgcctttaatctcagcactttgagaggccgaggtggatggatcatgaggtcatgagatcgagaccagcctggctaacatggtgaaaccccgtcactactaaaaatacaaaaaaattagccgggcgtggtggcgggcacctgtagtcccagctactcgggaggctgatgcaggagaatcgcttgaacccaggaggtggaggttgcagtgagccgagattgcgccactgcactccagcctgagtgacagagcaagactctgtctcaaaaaaaaaaaaaaaaaaaaaaaaaaaaaaaaaaaaagatgacagtgggcccctcaagcatttttgagtctttttgttttttttgtggcgctgtcacttttgtgtttggttcgggccttgttggaggtttagggaaaagacagtctgttcagttcagttgggagcacatgggcctcaggctgtgtatagcaccctgtggcccgagggcccagaagcctggccccggagcccctgccaccccatgaatgagctttagggtctgatggctggggcagtggctccctaggtaagagccaggtgtcacatgtgaaaagtggacccagctgccactccaggggtgggaggactgtggaatcgcaagaccatgtacaagaggccgatggaattgttctcgttactttgtaggctttatgtgctgtgcttgagaaaatgcaaacaggctattagtcggtgacaggcaattagttccacccccggccttgctgcttctgctgacgcaggttccgaagtctcctggttacccagcctggcaccctcaggcacagcagggtgtctggcccggcacccgcccctgtgggggcagcagcacgccttgtcttcgcttccctgccatgccattcccctccttcagcccccgagagcaccccagggtgctccctcctccagcaaccttcacctgaatgctctccctctagattaccccatggctcactctttcagctctgccagctcttggttcaaatgtcactgatcagggaggccctctctgactccactgccccaaactggcctccactggctctcctccccacccctgccttagttctttctgtactcatgtgacacaccaagcagcactcagctcatggggatggcctggctcctcttccctgtgccagtgtttacacaacgaagcttgcacgtgtctggcagacactggtgccagcaaactttcaggggcacccacagcccctgcctttctcctttcacacatggctccttgacccagaggtgctctgtgggctggagctgacctttcctcggggtgcaccccaccccctgccaaagcagccagccctggccacagtctgcacgcagctgggggcagatgttttaggagcttctggaaggccgggcagaccctccttggctaatgtgctgggctttgccaggagtggtcttctgggcctcagtttccccacgagtaccctgagccagggagggatggggactccattctgcccactccccatcattccggggagggaggtggctccacaggtcctcgctgcctcctgacagcatcactgtcctggatgaggtgggtgaggaggcttctctccacggaaacaagtctcaggggttccagggaggttgcagcctggtctccatggcaatgggtgagctggtgcggcttctccgcgggcggcccttccccctcctgggcctgccctgggctggaggctctttctgaggcagaggggaaagaagggggatgtgccttcctcactctcttccccctcattgtaactcctagtaattccccttcacgtctctcccatttctgccaacagggcttgttccaaaacctctggctccatcccatcacccgtggctcctgactgtgccctccataactcccacgttgcaggccacagcccctgttaacccctctcacagtccacccggctcttgaacctgcgctgggctttctggcatctctctctccttgtgcctgctggtccctcggtggagcgcctttcctcctcctcttgccccagcaagcctggcttgaaccccaggactgctttgtgaagccttcctcaggtccccccagcccttggttcatgggtcccagactcaggtgtctccagggaccaggctgataatataaaagaggagagtgtctagattatgcaatgataatgtcatctgccccttcaccccagggctgggtggcagtggggagtggtggggtctggcgcaagctggagagtccacacccccatccccaggggcagcttattgctgccaggtgggagtgcaggctcactgttgccacagcctccagttcttcaagagaagccagaagttaagaacttttggacaaactttccaatttaagaactgttcgctctcgccgggtaccgtggctcacacctgtagtcccagcactttgggaggctgaggcgggtggattacttgaggtcaggagttcaagaccagccttaccaacatggcgaaaccccgtctctactaaaaatacaaaaattagccaggtgtggtggtgcatgcctgtagtcccagctattcaggaggttgaggcagaattgcttgaacccgggaggcagatgttgcagtgagctgagatcatgccactgcactccagcctgggtgacagagtgagactctgtctcaaaaagcctaaagaccaaaacaaaacaaaagaaaacaaaacaaatgaaaactgttgactcaaatcaaaacattacagcgaccaagctgagcattcctgcagattgagcttgggcagccctggcatatggtcaggtcggttggccccccgtctggcttcgtcttttctgacactaacagggttgcactatcatagtttactccctctccaggccctcccccaagtctgtgcctcttccaagagaggagtccctccttgtttatctctgtgatgtccccagagcctgcggaggctctgggggacaggacgagcgggagctgtaaggactgaggaccgacaatgctcctgccaggctccatgctcctgcctctactcactgccccacttagttccacaccaagagcgaggcaggggctgtgagaatgctgcctttatggaggaagaaagggggtcggagagggaaggatttgcccagtcatggggtgtgaagtggggcagctagaacaaaataggatctattttcgttcccaaggccaagcacatcacaggggtgcagtatgctctctctgtctctctctctcccctaggtcagggtggtccctggggaggcccctgggttaccccaagacaggtgggaggagcttcctacccgaccctcttcctgtcaacctgggctctgcggctcccagggctgctccttgtattggggccccagcctggctggtaacagagggtccctccactgggctcagtcttctgagcatgctctgcccccaggaacctggaggatggaagttgggggccctgggtcccttccaaatgcccttgggtcctgtgcctggtccccagtgcccattttcagagcccctggcccctccctgccttgtggactgtgtgacgtgatgccagtcccctgggtccaggggcatggcagccggcggagaggcctctgcggccccgatgtctccttgagtggcttgactctgccagcccagcggtggcccagctaaatataccctggctgacgtcaagcactcttctgctcctggggtttttcttaagctgcatttatagtttgcgtattgctttgtaaagatgtaaaaatttcactttttttttttgttttgccccttagcagactgtcttattgagtgtagtcttagatgattatgaaaatcatttacagctgccgcattaggaagctggcgtgtgtgcagaggcagggcattttggtcaatgttggtctttaggtgaagaaaacttccctcccttcccccagtcacgcacatgctcacacacgcacacatgcgctcacacaggcacacacacgctcacacgtgctcacacatgcacacacgtgctcacacgtgtacacacgctcacaccgcacacacgcacacccgtgctcacacgcacacatgctcacacatggacacacgctcacacacgcgctcacacgtacacacgctcacagcacacacacatgttcacacacaacctcacacgcacacacgtgctcacacacgcacacatgtgctcacgtgcacacaggtgctcacacacacacatgcacacacgtgctcgcacacgcacacatgctcacacacgcaaacacgtgcccacaatgcacacacatgctcacacgcgcacacacacgtacacatacactttccttctctcctttcctctttgtttctcaccacctccacaaggccacggaaggggctacttgggctgggctgggcaggggggtgtgagctgcctcctggggcccagcctgggaggaagggtcagcatgcttcctctgggaggaggcttggccaacttctctccgtaggtctctggcttacctgggcctaatcccttctttctttttctgggctctctttgtctctctcctaggccagggcggtccctgaggaggctcccctaggccacccactagacgggtgggaggagcttcctaccccactctctccctgtcaagctgggctccgcagctcccagggctgctccttgggttggggccccagcctggctggtaaaagagggtctctctgctgggcttggtcctctgaacatgctctgcctccaggaacctggaggatggaagttggggggccctgggccccttccaaatgccctcctccctgtcttttctgccctggcagtgatgccccacagctctgtgtctacctggagacctcagccctctgcttggggtccaagtctctgttccatatgcccctatggaactcccccctccatggcagcaggagcaaaggctctgaggcaagtgtgcaccagtgtcagcaggagcagctgggaggccggttggtggagtgaagtcagggagggtgcatgtaggaggataacgctgagtctgagtgtcccatggcacgtgggagagaggatggattttatctgagtgtcccatggctcgcaggagagaagatagattttattctaagcatgataagaagcagttggagggttttagttgtggtgggagtggaggggggaaacaaatgatcctgtttgcacttggaagggctcactctgcctgctggggagaagggctcaggggccaggagtggagtaggaggctgcagctgctcccaggcgaggggcagtgaggcgtgagcaggacatggccaccgtcgcgggggaagtggttggattcacaggtgacatttgccagtagacaaggagtgtgggaacagggagaattcaggacgcctcaagtcctaggacgtggcaggtgcagatgccagatgccatctatgtgtttcatatgagaaggtaaaaagcaggtggaagggaccctctgcagcctctagtccacgctgttctggttgttcccaagcgctcttgctcgccttggtttggccgggactgatcatcagggtcagccctttcattctggtaggaattggaaggattctaggcaggtgtgggagttgaggctgaacctcctgagggatcagaagctggcagggccctggattagggcagcaccacgggtttccataaacgctccttcgtgtctctctttgcatgtcctcagagcgggatgccttcgacacgctgttcgaccacgccccggataagctcagcgtggtgaagaaggtgagctattggtgggatgttggatgtgctctcccctggctcgcggctttttgacagcacaaacgccccgctgggaagaaggtgggaaaatgtttggaatctcagaaatgtttgccacatggattgaaatgtaattacagtcaaaaacctaaccacagtgcataaaatcagcgccttttaactcaacctcgctgctccctgggtgtcttcctgcccgcccgctccgcttctgttaagtgaattacccagcccccatttctttctgactcgagaccttttttcaatgtggaaatgtttttaagcatgtcagcctgctgctctcgctggcctcatttaccatctacagcctgcccagtaaacacgcaggcctgtgcggctgagctgtgccatacatggatttggcccgtttccctccagacagagaatgggccctcactagcccaggcagcctgctggtcaatctgtggatggaaaaatctccgaggctctggagttgggggctgggtgtgatcagcttctgggggatctgccagggaggcttgttcccgtcaaaaggaactggagcccactggctgctcattaacttatccgagtgcctgcaggcatcccattcaggaggctgctgcatccctccttcccataacatcggaggagcgctcatttcaacccatggtgcaggcaagagagttctcctttgtctaggacagcttacccaaacagctttcttagtgcaagacttgtcagaacctttaataggctgacctatactgtacttctccaagagggagcttggtaggaagcatttttcaaacttgtttgtttatagtgggatttatttatctatcaattttggggtaagacgcattgtattttagtggaacccacttttggaaaatgttggcctgggtttggacgatgagatcattcatttttggaagcattttgcaaaaggctgttggaaccgtgctaatggtccttctgggacaaagccttcctagcactcttgggtggtgagggatatacttggagcatcagagtcccccacctccacctcgtcacatgtggcccccagggaccctgacagaaccggttcagggaatgaatcaaatccagcttccccacttatcagctgtgtgacttctggcgaagggcgagattataccccccagcctcagtttccccatctgtcaagtggggacagagatgttacccacctctcagggcactgtgaggataaactgggattctctctgtgcatgggcttagccggcagcgtatagtcactggtagcattgagaatggtgtggcctgagattgctttcatctctcggtagataccatgttaattcattctgcgaaagacacattttcggcactggagccaccagcaaggaagaagacagaatcctttgatttgcctggtagcttcccactccagcctgtcccttcctcacctccacattgcaagtttaggtgtctgtagctctctgtgccccagaatgaagtcaggggcccctgcccacctctgcaggtttctccctgggtcgtcccctcctactccttcccatcccacccacatccagccacagcctgaagaccccaaagggtttgcagatgtgtctgggtgcccactcggctcactctcaccttgcactggcccaccctcaggcccagctccaatgctccctctccatggtcttaacgggggtccgcacacccattaatggctcatgaaatctcccttgcattgcgtgtttccctgtagtgccctatctcttgacttctccgtcccaccactacacgcatatggagaattacatcacaggccctttggcgggggccaggggtggagctctctgtgtttgtgtccttagcaccaagcagcatgcctggcacatagtagctgctcagtaaatttgagcagaatgggtaagaaatcatatcatgggcaggctgggcgcggtggctcacgcctgtaatcctagcactttggaaggccgaggtgggtggatcacaaggtcaggagatcgagaccatcctggctaacatggcaaaaacccgtctctactaaaaaatacaaaaaaattaggtgggcatggtggtgggcacccttagtcccagctactcgggaggctgaggcaggagaatggcgtgaacccgggaggtggagcttgcagtgagccgagattgcgccactgcactccagcctgggcaacagagcgagactccatctcaaaacaaaacgaaacaaaacaaaacaaaacaaaacaaaacaaagaaatcatgtcatgggcagtggtggatgatattgagtttctatcaaagttggctttggtcactgaggaattacaggtgacaggttttaagcttgtgccggagagaagccagtgccccttggtacttacataatagggctcagagagatcaccctgggtggatctccccatgtattgcaaatcgataggcaggctgggcgctgtggctcacacctgtaatttcagcactttgggaggccaaagtgggtggatcacctgaggtctggagttcgagaccagcctgatcagcatggggaaactccatttctactaaaaatacaaaattagccgggcttggtgacgggtgcttgtaatcccaactactcgggaggctgaggcaggagaatcgcttgaacctgggaggtggaggttgcagtgagctgggatcatgccattgcactctagccggggcaccaaaagctcggatgatcctcagtggtctggggtgcaggcttcaaacctgtagctgtctagtgacagagtggttcaattccacctttgtaggcccggcgcagtggctcacgcctataatcccagcactttgggaggccaaggcgggtggatcacgaggtcaggagatcgagaccatcctggctaacacagtgaaaccccatctctactaaaaatacaaaaaaattagctgggcgtggtggcaggcgcctgtagtcccagctactcgggaggctgaggcaggagaatgatgtgaacccggtgaacccgggaggcggagcttgcaatgagccgagatcacgccactgcactccagcctgggcgacagagtgagactgtctcaaaaaaaaaaaaaaaaaaaaaaaaaaaattcagtaggtgtggctcaaggcagcactttcctcagtcttctgagtatgccgtttattgttccaggtcacacctaagatacatttgcaaatgtaatgatcctcccctggcagtttcatctttcttaagagcacagggtgctctccagtatgattgttaaatatgtcatgcgtgcacggattggcatatgtgtgcatgggttggtgagcagagacgtgtagccaggatagatgtgggcattatgccatgaaaactaggggctactgtcaggatattgagtttgaaacatgggctttttattttagcaaacaggagatgatgaaagcgtttcacagagctggggctggcaaatgtcaagcctgcccctccagatgggacctgcatgcgggccattcatggctcctgtgtctcttttattcttggcagtctctcatcacttttgtgaacaagcacctgaacaagctgaatttggaggtgacggaactggagacccaggtatgtgctgctttggcttgaaggatcctttgtccaccgccattttcagtcagtgttttgatcccaggtggggcgcgtgaacaaagctggcgccattttgttcatctcacaaggaactcccgtggtgcaggcagaaataaccaccgtggccttctcagcccctctgtcttcctttcctggggctgctgccacaaagcaccacaaacctagtggctgaaacaacagacctttgtgtcctcgaagtgctggaggcctgaagtccaaaatcaagatggggcctgggtgggttccctccaaggctgtgagggaggagctgttcctggcctccctcccagcttctgtggttttgccaggatctttagcattccttggcttgtacacacatcactcccttctttgccttcatcttcatgtggtgtcgtccttgtgtgtgtgtctctgtgtccaaatgtcccccttttatcaggacgtggtcatgttggattagagcccacccatggcttcatcccaacctgactgcatctatgtaaaccctgtttccagatacggtcacattcagaggtcctggtgattagggttccactgtatcctttttctttctttttttttttttttaaagacagagtctcgctctgtcacccaggctggagtgcagtggtgtgatctcggctcactgcaacctccacctcccgggttccaaccattctcctgcctcagcctcccgagtagctgggactacaggtacatcccaccatgcccagctaatttttgtatttttagtaaagacggggtttcaccgtgttggccaggatggtctcgatctcctggcctcatgatctgcctgcctcagcctcccaaccactgtatctttttttgggagacacaaaaccccaaaacacctgagtggtgttattcaacccataacacactccagggctccaccccagcccaacacagggcctttgcacacgcagttcctctgtctagaacgtgctggccccttcagcctctgctcagtgctgctgtcacactgtggccaggacctagcaaatgtccccctggtaggtatgtacaacacatttcttctgcaataagtatatcaagtctacttccccagccccgacccctactcaaagctaaaggagcatccttaaattatatttttgggcactccgagagcattaaagacaaaatatgattttcccaggattagcagggtgcttgaatgcggaggtttttgagctcttggtacagacatccctaatgcacagctgatccttcttaaaccccaaggtgaatgcattcattcccttctctttctttaactttcctcatttgcttttctaattaaaaaactaattcaggttcattgtagaaatgtctgaaaatgcagataagcaaaacaaataaaaatcacccataatcccgtcacccggagatgaatgcacagagggttttgttcaggccttttctctacacatatagcgagtcatggacagtgtgggtctgtatataaaagcatcacggtctgtttttaatgtatatatttatttgtgtatcgttggccaacacatttcttattttccgcagtttacaaatgttgcacatttagcctcagattattttctgtttgagacgttagcaccccagaagccactgaggtgaaaagtaaaaatcttcctttctctttttctggagacctcccccttcagactctccaggggcagctaactgcagttcatggttggatgtgtatttttctagatattttctttttctttctttctttttttttgagacagagtctcattctgtcccccaggctggagtgcagtgacacaatctcagctcactgcaacctccacctcctgggttcaagcaattctcctccctcagcctcctgagtagctgggactacaggtgcgcctcaccatgcctggctaatttttttgtatttttagtagagatggggtttcaccatgttggtcaggctggtctcgaactcctgaccttgtgatccacctgcctcagcctcccaaagtgttgggattacaggtgtgagccacattttctatgcacaaaggtatttttctaaataacagtggatcttaccgcccactgttttgtaatgtgttttgtgtcactaaatacactgtgggcatcttttggtgtaagagaaagtgtgtgtgtgtgtttctatctgatcctttttcccttgctcgatctatcggtctgtctatattttgtcacttttaatgggaagtgtatctcatcagcgggaaggctgcactgcacctcattaaaccagtgcctcacgactggatgtttttctgctcctgtaaacagcagtgcagagagcagctttgtgcacggctgtctgtgctcgtgcctgcttcctcggaataaaagcctagaagtggagtcattagagcgaagcctgcaccgcacactttgaaggctcaggaagatttgctgtgtgggggcccctggtactgtcatggggcgtgtgaggggcactgctcccccacatccataccagctgtccccacagcccttctcagaggtgtctgcacatcagtattagcagctgagcctcttacattgagactctaaaattaaatttgcatttgtttttatttactcaatatcttcatttttttccccccgattaatcgtactatatagagtcttaaaagtacatttaaccactggtcccccagaaaaggtcgctggttacagaaatgcagggatttttgttttgttttgttgcaaaggaatttgggtatttttataaataccatatatcatttatgaagactgtaaatcattaacgtcttgatgccctaggagtcggagaggccctggtttaatttcttcaatttctatttgtgtgtgggtgagtgtggtttatgtagtctggtatgtgtggtttatgcagtctgttgggggtgtgtgtgtgtgtgtggtttatgtagtctggtgggtgtgtgtgtgtgtgtgtgtgtggtttatgtagtctggtgtgtgtgtgtgtggtttatgtagtctggtgtgtgtgtgtggtttatgtagtctgtgtggtgtgtgtgtgtatttgtggtttacgtagtctgtgtggtgtgtggtgtgtgtggttttcgttgtctgtgtggtgtgtgtgtgtggttaagtagtctgtgtggtgtgtgtgtggtttatgcagtctgtgtggtgtgtgtgtggtttatgtagtctgtgtggtgtgatgtgtgtgtgtagtttttgtagtctgtgtggtgtgtgttgtgtgtgtggtttatgcagtctgtggtgggggtgtgtgtgtgtggtttttgtagtctgtgtagtgtgtggtgtgtgtgtggtttatgcagtctgtgtggtgtgatgtgtgtgtgtgtgtgtggtttttgtagtctgtgtggtgtgtgtgtggtttttgtagtctgtgtggtgtgtgtgtgtggtttttgtagtctgtgtggtgtgtgtgtgtgtgtgtgtgtggtttttgtagtctgtgtggtgtgtgtgtggtgtaggtgtgtgttttccctccttttccaaaccattcttacattgcggacagcgtcccagctctgtgatggtgagtgaactcctcagcctccctgagcttctgtccacagaattaaactggaggcgatgggcagtgtgaggactgggtgagatggcgcactgagatcaagtgggcagggctcggcaggggttagcactgcggatgaggaggcggtggtggggcctctgggcctccgtggggattctgctccctgctgagctagacagcaggttgtggagagagggcaccacgctgggtgcttgtgaaagtggagggtcacccgctcgcagctgggccccccagccctgccctctccttgtggccgtccctccctccttcctgtgagcccgtgtgctgggacagtgaggagacaccacggaaggaagaaaagactcagcaggctcagggcctgcgggagcagcggcgtggccaccccagacctcctggggagaggtgtgggttggtgccttcattcacgtggcagcttccattccctggaagttagtccatggagacgtgggcatggcagctcaatgttgttctgctgggaaggtgccagcacgcttaaccagggtgctgtgggcatgaagcttccatgtggagacacacttaaaagaattcttcaaacccgtctgatctccttaatgataggagtggctggctgctttgtggtgtggaaggctgagggcatgtgacatggaggccaagtgccatttgcccatcaactgacagcgtgttgaatttccaggcgcagtggctcatgcctgcaatcctagcactttgggtggccgaggtgggtggatcatgaggtcaggagttcaagaccagcctgaccaacatggtgaaaccccatctctactaaaaatacaaaaattggcgggtatggtggcacgcgcctgtaatcccagctactcaggaggcggaggcagaagaattgcttgaacccaggaggcagaggttgctgtgagccgaggttgcagtgagccgagatcgcaccactgcactccagcagggcccagaccctgtcctgagtcccttaagggactgttgcccactggcactagctttatgctttacagctctagctgcagctctccctgctaaaggtcagggcttctgatattggatgtttgtgattttgacttttcatctttttttttttttttttttgagacagtttcactcctgttacccaggccggagtacagtggcgcgatcgcggctcactgcaacctctgccttccgggttaaagcgattctcctgcctcaacctcccgagtagctgggattacaggcatgcaccaccacacccgctaatttttgtatttttactagagacggggtttcaccctgttggtcaggctggtcttgaactcctgaccttgtgatccacccaccttggccacccaaagtgctaggattacaggcgtgagccactgcgcctagaagtttttacttttaatttttttaaaaattcaaatttaagaattctggagattgtttgtacaataacgtgaatgcacctaacatgattgaactggacagttaaaagtagttaagatggtaaatgttatggtatattttatggtatattttaccacaatttaaattaattaaagagaaaggttagcataagcgagacacaaaagataaatggatatgcgattccacttacgtgagatacccagaggagtcaaattcatagagacagagagcagaatgattggtggttctcaggggctggggggaaggtagaatagagaattgggggacagagtgtcactttggtaacatgaagaagttctggagatgggtggtggtgagggtgacccaacaatgaggatgtacttaatgctactggcctgtgcgcttacacacggttaagatggtacatttcagcttatgtatattttatcacaataaaaaataagttagcaacattcaaacaaaaacattttaatttaaatagctgcatgtggccattggctaccatgttgaatagcagctccagaggccccctggagaatggggccacagtcactgtggtctctgctgcaagacagagtggtgagggccaccaggtcccagctctgcaccctgcagatttgaatgaatccttccagcagctgatgctgatggagcactcacgtgtgccaggtgctccctcccagccgtctcgctgtgtcttcacgacagccctgaatgatgggagtcactactatccctggggtcaggagtgggggacagttccagaggcacggtcctagccaggcagctgcactcagctccaaacactcatcatatttggtctttgcagagccccatgtgttagagccccctccccttttgcttttttctaggttaggagccaggtctcaaaagacttcacattcaggccttcacttgattccagattctcctgcctaaagtgagaggagggatggattgctttactttaaaatatttccagctgggtacagtggctcccacccgtaatcccagcactttgggaggctgaggcaagtagatcacttgagcccaggaatttgagaccagcctgggcaacatggtgaaaccctgtctctacaaaaaatacaaaaattagccgggcatggtggtgcgtgcctgtagtcccagctacttgggaggctgaggtgggagaatcgcctcagggaggatcacctgagcctgggaggccgagctgcagtgagccttgattgcatcagtgcactccagcctgggtgacagagtgagaccctgtctcagaagaaaaaatatgccccccttaagtttgtgcaaagcatttgccaactccttaccctgcccggaaacatcacaagtctttctctgcagtttgcagatggcgtgtacctggttctgctcatgggccttctggaagactactttgttcctctccaccacttctacctgactccggaaagcttcgatcagaaggtatgtgcatggtctccatccttggtaggggctcaagaaatgctcattgaaatgcagagcatagactatcccggcagctcttcctgcagcctggctgcattcttcagaaagtaaaaaatgcacaagtgatattgcaattagatgtaactctcagcaaaagaaataagaagcccatcagccgtccacaacgcatccgagttttgtttgccacattttctttgcggtcttttccatgggaccgtgtagtttttaataattgtgatcacatctcggtagagttgtaaacccttcccccattctgctgcagctccaccacctgtggttttccctgctgcttcccaagctttccaaataccatctccagtggtggcacgaagtcccaaggatggctctgttaccagcgtctttccattccccattcttgggcagtcaacttgaacatgtttctattgtttttccctactgaaacaacagagcatctttttgatacagattttttttttcattcctgtggattgttttcttaggaaaatttctcaaatagggtcaaatttggggcattcctttcaatctgggctggcccacgccacccggtcccgctgtcactgccctcgtgcgtgggcctctccctgctgtctgccctctgtccagggcttcccgcagccaagcctctcacagcagtatttagcacattgcctttaaaaacttggccatggatggtctatgttgctttggattcatgggcatctgtcattttattttcccaaagtgttagacccatgagtcagggaggcagacaatgtaagctggtggcgacagccagagaaatagcagaaatggggccagtgtttatcaatctgcccacttctggcacgttgcagtctgtttgcttgtggccaaatgttgttcctatcttgcctgctgagatggaatcaggacagattagagaggtcttggcacatggagtccatgttgaatcgagagagagagagcgagcgagcgagcaagagggagtgcagagggaatgagcagaattgtgcagaactcaccaggaaactcaccaggtgcctgtgctgtcatcctggaaatgaaaggtcagaccatccagcgaagaagcgcatgcatttccaggccccgatatggctggttgcagacacattgttttggagagatcttttctttcttcaaactagtaagaatgctggcgagaacagtgagtttagccaggagacctagggctggtttctttccaagacaaggctttgtacaaatgtcagaggcatcatctcctgggccctggccttcttccctttgaaactgggatgaaagtctttgacaattgctgccctggcctgcgaggcttgaggaggcttgagtcatctgccttcccctctgaatcggagcgaggaagggaaggctattttcaggtatagcatgcagcacaccattcatcctgttcactcaggagaaagggagcctggggtggcggtgtggctctgcgggtggctggaacactctccttcggaggatgggaggctgtcagtagttcctcctccagcccctgccttttttccctttctcctcatggcagctgctggcaaggtcttcatgagcccatagtatttattatctaccttgtagtcttcgtgaatcctggacaggtgggtggtccctgctgtggaggactcacccacttcaggctgggcccaacacccgtgtactcaaaactgcttgcggatgggatgttgatggcatcccttgctaatgtctcctgtgggctgagaccccgaggtgcgtttgctctggccctgggaatcctgacagctgctccacatttttgggaggagggactgaggttcagtgagcaaaaccagagatgcgtcatgagctgctgtccccgagggtagtaatgacttatggtttaaaacaattgcattggatttaaaaaatatcacactggacagctcagagcctgtaggctcgtgccccatgagctatctcagaggcatgagtgtggccttcagtttttttgttgcaaagccactgtttgagccttaccctgcactggccacgtgctgagcaccttgcacccattggtcatcattttgggagactctgcaggctccctctctctgtcgagtggggtgcatcctggagacgtggagatctttcctagaagaagacacgagttgcttccccctcagcattactggatgaggacagggaatctcaggaaggcttagagaccagcccagggttgcacggccagcaagggcagagccaggagggtcgactcctattccagaaccctctattctttcctcacctggccaagttgattaaaaccttttgaattgcagagagaaaggatttctgcccatgtggctggctcgaagcaggtgtgtatatggcctggtctctgctgggccttggggcctcctactgcagtcacagctggggtgagcggtccccaggcctctccgggatccatgtgctgggtatccagggatctaggctcaggggacacttctctgcctggcatgaaagagggctgggggaggaggcatggccttgagagataacaggcatgggagggtggcaatttcctgcctggcatttcctcagcctgagaagaaagcagaaggaaaatctcacttcaaaaccacttactgtggggccgagcggctgcagagcaatgaggcttggaaggggctttgctctccccttaaactgttctctcatggtgtaggggtgaccacctcgtcacccgatcacactctccagccgtctctgagtgtctccacgtgtcatgcatctcatccccagcccctcctgagcatccactccctcagcgtggaagaggattcctcaggcttaagaggtgcacgggagaggcacgtgaaaagaccggtccaaattggtgctgacttttacaatggagaagaatcttttcttaaaagaaaaatcttttctcgctattccctctctttgctatcctgtctccatctcgatttggggtcaagcctgttgtgtgtgtgtgtgtgtgcacgtgtgcatgtgcatacgtgtgtgtgagctcatttgatgatatggacggtggtcagctaaagggacctgtgttgctaggggagtggaggtgggaggctcttggaggagaacgggcacagattctacgtttcagtcctggttccatgcctgtgagccccgtgccttgtttttcttttcttttttttttttttttggaggcggggaaggaatctcactctctcacccaggctggagtgcagtggcacgatctcggctcactgcaacccccgcctcctgggttcaagcgattcttctgcctcagcctccttagtagctgggattacaggcacatgccaccatgcctggctaatttttgtatttttagtagagacggggttttaccatgttggccaggctggtcttgaactccagacctcatgatccacccgcctcagcctcccaaagtgctgggattacaggcgtgagccactacatccagctgccccatgcctttttagggcaccgatgtcctagcccatctcagcccagcaccaccctcctttgtgaaggaagatgatattcacctcgtacagggctgggaggggaaagggaacctgtatggaatacactgaccccatggtggatgcacagcacccgcaggtcgctccctgctctctccttaggggaactgcgttctgcaccctccgcacgggccgtcctcactcctcccccattgccagtgtttggccatcctcaggcccagccctggtgcagcactcccgcatctccaggcaggctgtcctgcagggttggggtgtctgccatgtggcccagtgttcccattggcagtttctgagttggcctctggagcagggtctccgtctgctgcacccccgcccctgggtggacatggcctgccctcctgccgggctgtgtcttccccactgaccctatgactagccagaccctcttgcggttggtgctggcaggtcattcgcccctttgcttctccgagcacaggccgtgtgcactgtggaagcttttccaaagcaccccacactgttttccagtgttgttcgtttgattaactcagggaagcctctttttcctggttaattattaaattacattgcaagtaaaattgttcttgtttctgattcattggcctcaaaatcatgaaaatatgatcgttgaaaggattttttgtttgtttgtttgcttgtttttttgagacagagtgttgctctgtcacccaggctggagtgcagtggcacaatctcagctcactgcaacctccgcctcctgggttcaagcgattctcatgcctcagccacccaaatagctgggattacaggtgtgcaccaccatgcccggctaatttttgtatttttagtagagatggggtttcacccattggtcaggctggtctcgaatgcctgacttcaactgatccacctgcctcggcctcacaaagtgctgggattacaggtgtgagctaccacgcccagccaggatgtttgattactaagagccctgaagtcccttgcactgtgacatctgtgcttgtttgctgtttgtttgtttgatgtcccctcctcccatcagccttggcttgcggcaggtgggtggctggatgtaatctggttcattgccggcatccctctgagtggtctttaaacacagcccagaaggcttttattttaaacctgttcagccatcattagcaggataaaagcttcaggtacatttgggggctgaggagtaatagaccctttaatttcaggggaagtcacggtagggcggaggtggccacgtttctgtagcatctaacaggaccaaggtcctgcaggctgacgcttgcagccaccatcgatctgacttccgttctgactggtccactgtccctactcagtgctaaggccctccctcccctgagggcaccccatcctgcagagacacagcctcacgtgcaggtctttacagcccttcctggggcagtgccaggcctgcgtgcctctgcacgggactcatcctttctgggcctcagtttccctgtctgtgaaatggggtcactgtgggccaggcgcagcggctcacgcctgtaattccagcactttgggaggctgaggcgggtggatcatttgagcccaagagttagagactagcctgaccaacatggcaaaacccgtctctaaaaaaaataataataatacaaaaattagccgggcacagtgatgcgtgcctgtagtcccaactactggggaagctgaggcaggaagatggcttgagcctgggaggtggaggttgcagtgagctgagatctcgccactgtgcactagcctgcgctctagaccctgtctcaaaaaacgtaaataaataaataaacaaagaaataataaataaaatggggcccctgtgacttctcatcaggtggctggcatctggggcagagcaggctcttggtggccgtgagccctcgagagcaggccgggcacctcatccttccatctctcagcccagatcactggtgtgaggggtgagaaccacctagtaagcgcacatggccctccgcagacttcctcacccgtgtctgcccaccctgtggcccgccccgggctcactgggtccttgtggacgtcagcgttgcagaggctcggtcctgtccatgccggctgtcctccagcagtgggccgtgtgtgggaacgactgttggaccctaacgctgacccaccccccttccttggcaggtccacaatgtgtccttcgcctttgagctgatgctggacggaggcctcaagaaacccaaggctcgtcctgaaggtaatgcccctggctcaggttcccccgggagaggtgcgcacggaggggaagaaaaacgggtcctagaagtggctggaaggctggcatgttgttccccagatgggccccacgtctctggctctggggcaagggtctgccaaccccagctcctcagtctcctcattttgggaaccaggaggacttcgctggtggagctggcagtgccggttctttaataaccacttgactttgaaggacgtggcctctgcccacagacctcaggattaagtgcgtctctagctggccactcaggctggaaatgcagcttcgtgccctgagaagaaattaaaggcttactcaactgtaatgactgttgggctggaggtcccctgatgctcagccaaaggcagtacttggtagcagggacttggcatgctctgcgtgggtcggagctggaggcaggaggccagcagagctggggcgggcggttgcttccctgtcccccccccggctcctgtgccaagttacctataggaggactctctaacctgagtgagcatcacagttccccaaacacacttcctaggtgtttggggacagccaggctcagcagaacatgggtggcactgcctgtgaaccctgctggaaagttacagggcagagctgaacattaaaggctttgacaagtcctatatgaagacatctgtttgcctccatcaaaacctttgccatgcaggaggagcccacagaactcagacactgtggtttagtgccctgggcccccactttgaccgtggccccctacctagccctgctccctctcctgagtcccccatggtgctatatgagttgggagcccatgatgcttcctacacctgttgccagcatccgctcaacggcgggctttgtagagtctccaaaatagctagaaaatggatcctgtcccttccatctacccactgcagccaccgcttcctgccagtccacgcggaaggttcctggccggtcccttcctgcctgttcatcctcctcttggggtttcacaggacaatttcacaccctcctgtctcgtgtgtatggctgtttattcttttttgttttgagacagggtctcactctgttgcccaggctggagtgcagtggtatgatcacagctcactgcaacctcttcctcttgggttcacagcatcctcccacctcagtctgtcgagtaactgggactaaggcgcataccaccatgcccggctaatgttttaacttttcttttttgtagagacaaggtctcactatgttgcccagactggtctcgaacttctgggctcaagcgattcgcccattacaggcacgagcccccatgcctggccttgtttattttttattgtccctccctccccactagaacagaagcctcaagggagcagggctttgtcccctgcatgccggtgctgagaatggtgcctggcctggaaactgctcgacagcacggatcaaagcacatgtccagcagggagtgtggcgagctgctgcctgtagataccggcccggcctgggtctctgggacccctcgttgctgctgccctgcagcccttttgttgctgtgaggcagggccatgagggagtggctagaggcccgagggatgctgctttgcctctccccagctgtgcatccttgaacaggttactttgcctttctgtgccagggcctcctcctctgttgaggggagtgatgatggcacctgcctccacgcgtcatggggtcgctggatggggggcggatgttcatcacacaggacttgtcagagccttcactgttcaactctgccctgtaactttccagcagggcccacgggcagtgccaccacgtgctgctgagcctgactgctcctgagcacctattacgctcaagtgagctgctcccatgagcactggaagagggtcctgcccacagaacacaccaggtccctgctgatggtggctgctagctcggcgttagtgtctggtgggtcgcacactgtcagggaggagaaatccttgctcatgtccactgtgggcttggctggggcttcctttagtttcctgtagcccaaagcctgggccctatctgcagcatggggtgcttcccccgtaccctcagaagagcccctggtggccctttgcctctgagctgctgagggagccctgcttctttgtcctcccgaacccacgactttttttttctgagacagagtcttactttgtcacccaggctggagtgcagtggcgcgatcccagctcactgcaatctccgcctcctaggttcaagcaactctcttgcctcagcctcacaagtagctgggattacaggcacccgccaccatgcctggctaatttttctatttttagtagagatggggtttcaccatgttggccaggctggtcttgaactcctgacctcaggtgatccacctgccttgccctcccaaagagctggggttacaggtgtgagccaccacacctggccctttgtcccgtttttgaggagtgaggcaggagcctgtccagaggccaggatatcctctgacaggccggcctcctaggagggtgtttgcccctgagcccggatgtgtttcctactcatctgccgctggacggcacgttagggaacccaccacggacgtgtggaaaccaggccagaggcagaggcactggtccagggcaaatagcaagttctgcagcctcccaggcagggtcccttgggtgtcccagggcctctgtccagcccaggcagggggcagagctggtctgcagtgctcattagcaccttcgctgggccagcactgggcaggggccaagccgcagagatttatgagatggggtccctgctgggcctctttattttgtggctgatgcaatgaatgagagacttttccttcttcattcaaaatcagctggggagcaagaatcaggaggtaacagagataagaatgacacggagaatggggtgcagtggctgcggtctccctgacaccctcctctgagctaggcagacttacccgggtacccagggctggtggggagggaggcagtggctgtggcctcccctgcaggcctgagactgccctgttggtccccacccggaggaagcagagcagtctcacaccccctgcacgtgggcgggtctgaagagccaggcctgcacctggttccctaggcccccagcaatgatgggcatcctggccccctgcccccttgtggggacctggcggagactccagtggggtccccgaccctgctcttaaggaggccccttgcctgggagaaaggcttgtggctcgctccaaattcacagagccgagtgcggagctcgatggtggggtgggtgtttggggagcacagagggactgaggttcatgggtcacagaaggtgattcctatccctgggcgcaggtgctaaggggtggctgtggttagcaggtctggcaggggtgtgagggttaagttctgtttgtccagcgaggctgtctggaagttctcagagctcagacctgggggctgctgcgtgggggcatcggtgtcaggctgctgctctggtctccctgtgagtccaccatgggagtggagtcagagggggccaggaggtgatggcccccacccctgggagctcctctgtccttgctgcccccctcgccttggccacctccaactccatggccgccattctccctcccctgcctccactgggctgttgggagctggggtggactcttcaggtcagggggagaccctgggatccctgacagagccccgggtgtgtccccaagcccgccgagccgagttccccgacagagccccgggtgtgtccccaagcccaccgagctgagttcagccctgcttttgctctgacagcacactcgtgggcaggtcatttctccatgtgagtcttggtcctctttgtaaaacgagagggaaggaaaggaggctgtgcaggctctgatgagggtgtgtgagtcgagaaactccatgcccagtgacaaggacagttgctgattcttagcatccaccccacctgctctctcagtaaccgatgtcgtttcttactcttgtgatcaggactaaagcacagggtcatcccatggctgcttttggatcacagggagtcaggactccaagggcctcgagcgttacctggtccaggcccattttacagatgaaggcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaa

SEQ ID NO: 2141 - DNA, 276076 bp, Homo sapiens
ggcggagtctgcaatgggggctgtccagcagtagcaagcagcgggccgatcctggtggagggttgggaggctgctgtcattttatgggtcggcagccagagtgagagtgtccctgctgccagaggactacggcgggctgggcgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaaggtaggggagctcctccacccctttttcccagcggtccgggcggcagccgcgctccggcgccctcgctctgccgttgggagcggcgcgccccagggcacgatggcccagccgcgggaagcgcctgccgtgcagcctgggcgcacgctttgttgtcctcgcgtgtgcgtgttcctggtggtcttgagaggtagggggcggggggaagaataagggaagtttgctccctccggctttcgccctttgtgctcttttatcgctgctgaaatccacatcaaaggtgggcttgttggatcgtgctttctcaggcaaaatgaggtcactttcttttctggtttccactgcaccccaacgctgcttaacctttccgccctccctcgcacagaatgctttgtcttaattttccttactgctggaattatacactggagagtggagggggactgagctccctggacacaaatggactgccagggctacgttagggcagaattttctttgaataaggagtgtcaggtagagagcttggtaaggattcctctccccaactcctatcaacatctttacaattccttttaaaaagtctccagactttctccactatatttacagatgatattacccctagatttaatggtggaaaaatatataataataaactttttcgtatcttctttggaatgtgctaccctgaggttttactttgagaaaaatgaaaagcaaaggagttgcttttgaaaaatcagtttgacaactatactgtacataaatttttttgaagaaatgtcagctagatgttttcttggacggcgatgtgaagttctgaagtgattgtctatcactcatgtcttcagtggatctactttagttctgttgttagtcttttcctctctccgcaaagcaaactcaagaatgtcgacaggtgacttggagctatcctttcaggaccacagtgataccttccctagaaatggatgccaggttaatggatccaaaggttttcttattatagagtcacttcttgcttatatgcaccattaattatgaatgcctaaaaagaatataatggaacaggaccaatggattaagaacagcattacttttaaatactccatattttcatttatcttaatgaaaaatataaaaaaaattcagggagaaacagcaacagaatgcctaagtaagaccttaaaatatatttaatatgttttaacattttttcttaaattatcaataatcattaattttaaagtatggtaaataataagctcagttatatgtttttactgtaggaggttgttctttcatacacatcataaatgcattagacttattaggttgtctattagtcgttttctaactatttatcaaactgtcacaactattttacctatgcaataattgtcatgaaccaaaaattagaaaccaagtcactatgcattttacgagcaacagctaagagttatatgtatgacatctgatccaaacctaacgtttagcacaactgcaggtttttgcgtgagttcttcataatgagataattccagaaataagagaatgacttggttgggagtgggggtaaggttttgcaattaaaataaaataaatgtggccattgtttgacttaaaactcgatattggaatgagaaaatgcagttagtgatggtgtaatgaaaatgttagtgattgtcatagaggtccagcctgcttcacataataggtatattcctgaacattgcaggtaaatgtaaattatggcaaactgcttccatagtaaatacattggcaaagtttgccatttaaataataattattgtagtgggacacataattttgtaagaaaaatcattttcctttattttatgtgaatgtaatatttttgtcacctgaatataaactatatcagaggaaagaagaaaaaactgtatatattaaataccttctatgtgctggttttttaggcattttacatacgttatttcatttaatcctattttgctgcagttgacaagagttgttcaaaaaaaatggtaaattgggcacacagtgtaatatcttacatttagaggatagtatattacatggtgcgttgggcacatggtataatctctttataatttggagatatttttgaattaaaggtcctgattaagtgccagtaaaacagatctactcaagcaggttgtgactggaggatgagaaaaaattcattattaaataccaaactgctaactgtatctcaataataaaatccaaaatgttccacgtgtgccgagtcagaaatgaaacattctctcaactctcccttgccaaaataatttccatagttttcactatagttaatacatttttcactactccatatgtgtatcctttatataagagtgaaaattctgaaggaaaataagacagagaaattcaagtatgaggcttaatttacagctttacattttccacaactcaaaaataagcagctggatatcagtggtggaaaagtaggaaagtttgaatgtgtatgaatggctataatcagttccattgagggagactaaatgtgactggccaagaaggtctttgtgccatcgttccttatccatggagcagtgatgagcacatataatcgggcatctcagactgtctaaatcattcactgcacattatgaagctaatatctgcataatttatcttgcctaaacacaatgttggttatgaaaatttttatttttatatcaatattgatggtgtatataaaatagaagaaaaaatggaactctgttattatattgaaggctactaatttcaaagtcttctatggatgaatgcaagtgaggtatttatctggcgagcctcgctgttgtgtgtcttcccataattcccagtgaaagaaatgtaacttcctacacttgtcctatctttactaaagccctcctagaaaatgtcttcctgtatcagtttactcagtataagtactttgtctactaaggtgcaaatcgtggaatatgacatcataggaatttgaagttggccttccctgaaatgttgctttttagtagtcagctggaatatattcctaaactcaagtgcttggcgtgtgtccttcttttttaaccccttctctctatttctttctatttctgcttttaccagagatatcatcaaagaatatcaaatttaaaaagggtcttaatattgtactttctgaaacaggtttatatttaattctataatacatgagtgttatgatactggccattctactcttatccaggggaaatatctgttttccacggtctgtctgcctttcctttcctatgtctcccctcgcaaccccatacacacacacaaagaagtttcacttttcgtggttgaggtttcatccataaattgcacagtgttggcaggtgaaccataatcctttcattttgctggagcagcttagatcctttccatcacaatgaagtttgctgcccttaactcccatgtcatctgactcctttaataaatcatattgccaaccttttggagaaacctttttacatgtgacatccccagtaggttggcaaaggctccctgggccatgcttctacagatgatcgagtaataatccttcccactgtgaacatatgtttccttttgttctttgttttgtgagagactatcgttgtgtgaaggaatgaaaaattcacattacacctctgcctcattttggcccaaaagaaaatgcacatttatgtggataactgattaaaaacaatatgagttgtactttattttaaaatgtaacactatttctactatctaaatatccaacttaaaggtatttaaacgtataagcagatttactcctgaaccttataaatataattctaacttgaggggttgtaaaagaatgtttgatgtcagatacagttgatgcacttaagtaaaacattgtaattggtagcagtgtggcacaatagaaggcttaacaacaatgaccacaagttttcattttcccctaatttaatgcctctccgtacacagtttcagtgatgttgcattttcagaaacatatcccagtgcagtgatgagctttactgtaaagcacttaatgttttcatttaattactccaaatatgttgtaaatatttttgaaataaaggaatgtctactgtaatatttctatctttcatggtgctagtatgtggtgttaggaatttaatagaaggttaataaacagatttaaattttctgcattatataaaagctctgactgagaattatgaaatattgtaatattgacttgtgaacacatctttaaggaaaatataggaaaattatcattatgggagttaaataatcataactacaatgcactcattacattcaaatagtaaaaattttaccaatcacttatattagaatcttattaaaaccataaattaaaatatcagttatttttcccagaaatgtaatattctcagttgctcatttattcattaatgttacctcacctctgtttaatgttattaattaaaaagtagcaaatgacatactaggggaaattgatttttttaacctgtatgggtgacctacaatttcagctagtacccagatatacaggtaatatttttgcctcctcttccacatcaccactccgctatgaccacaaccaaccagaactgaccaagatttctgtgttcctagtagaaatcctcctaatgttttgtcagacatcacccttaagagatgaagtattttctacaccctggtcttggttatccctatggtagtgtttaatccaaggtcgtataacccaatttcttacagaactcttctatagtcatcttaaatacccattatatcagctctttttgctcaaataaatatgtaagttttttttgtgcgctggtgtcattgatttgaggaacccaaacaaggttaatgtggctcaagtaaagtgagcaagagtgtgaatggattgggatgagtgtgaatgggttccttctctcctggtgctgttgactccagcaggtcccatagggtttctatcagccaataagaggtggctcacgcctgtaatcccagcactttgggagcctgaagcaggtggatcacctgaggtcaggaattcgataccagcctggcaaacatggtgaaaccccgtctctactaaaaatacaaaaaacagccaggtgtggtggcaggcacctgtaatcccagttactcgggaggctgaggcaggagaatcgcttgaacccagaaggcggaggttgcagtgagcaaagatcacaccattgcactccagcctgggcgacaagagtgaaacttgtctcaaaaaaaaaaaaaaagtatatgtgaataacctccttaattaaatacctctcatgtaatctgctatcaccaattactcctaatgtttcccttttccaagcttgttctaggtcttcagaacaccaatccttagattttttttcctctgcacattgtacctttgaatttatttctatgagtaagatcatatcttagccttgtgccagaaaagcgttcgcaagtctttcagcatctaattcccgaatgaaagatttcttctttccttagacattctagttacttaaaggccagctcctttttcttctgaatattttaaaaccaccaaacaaacagaagatgtttgaaacaaggttgcggggatttcctgataaaaggtttttttctttcctttttttcaggaaattgagatgaaagggagaaaagtgatatatgcttggaaaaatatttcagaaacagagaatcagaaatggaaataggacttcaagcttgagagcggtattgcaaattatgagtatgaatggtaatttctgtaagaaaatgaatataggggaaattagagaatgaaatgaagaacatttgatgaaaacaaatacactgcaattctatttatatgcaaataaatgtattttcttatcaaatactctttatctatttggtttttcactctttataaataggaatgctgcacagttcatttttctaacaaaactatttctatcttaatgaaaatttaaactaaataaacctatttttaaatgtgatttttggtatatttactagcaaattaaaagaataggaatgcaatttatctacaagtagtggtgcaagatcagaattatattaatagtaatctatatgagatttaaatgatgaatgtttcccttttttgtgctatttcattttactgttttcagataactgagactttgttttattttcctctttctgcctactaagtttttaatatcagtgatttatataacgggtgaggaaaggcgtcatatgactctaccatgctctcaatactgttccttcattattacccgccattgaccaaattaagtgcagaggaatttctgaccctggttctctctacctttaacccgtatcagagaccaattatgagcctgctgtgctgatatgtgtcttgtgattctctcttggttccacgcataggaatttgtgattggcatgtacaaaccagatgtcagagaattcaaaagaattttcagtgccctttgtatcttcggtcctatctgaagcctgattcccacctccctatacttactttctgaatcaatattgtattttgataaactctagtattcctgcttttggatcctggcattaattataattaaccactccttgtcttttagtttccttgaaagagcatcctataaacattttttggctggccaatctttccccaatgccaaaatggaaagattgagaagctccctttcttcttcaatactgtcttttgtattccagaataaagactcactgcccaattccatttagttaatcaaacatccattaagcatctaatatgtgccaggaattttactagatattataggtacagaagtggataatactcagttgagtccctggcagtggcatattgggaacatggacacagatgatggtcattagaatatggtgttttgttttacggatgaaaatgtgggctgctagaggagagacacttaactatttagtggtttgggaaattatttattttaagatgattcctgagctgagtcctgaagcataggtacgagttaggtttaaatatatacacacaaaggcagagaaaactgcacgagcaaaggcccagtgttgtgaaaagcatggcagagtttaggaaaatgcagatatatatcaaaggcaatgaagccacaggagccagatcagggagacttctacatgctgagccagaaagaaggatctctgtattctctaggggaagaggccttatcgaagggtttaatcaaggcattagtgagataagagttgcatttcagatagagcgctttgcctgcaagaaaggctatcccaaaggtagagccagcctggaagaattaaactagtagcaggttgttgaaattatccaattaagagacgacaaacactggcattagggtgacagacagtcaaagagtggcaatgttgaaaaatagctacattggcaagactgattagatgtgggaaattggagagagcaagatgtagggtaatttcttggtaaccaaccctcttgcctggaagagtagcggtctcaagataacatgtgtgctggacagtctactctcgagatcaactgtgctggatagtctgctcttgagatcaactcacctctccactgtgcccagtgccaggaagtgtccctctatggaccatttcttcctgttcccttgccctttggttcctagtgagtttggccaatagaaggcactagccaaagattactgctagaaggagggagaaatcaaatcatttattctcctagcctccaccctggccagcccccattaggcagtggcttcattctctcttccagttctatagtcagcccctcttacaaggctgatgttctggccaaattcctgaaacagttctctgtctttatcccttgagagcaatagcttctccctgcttctagaccctaagtatgttttctccatgcttaatacattatttctgctccaaaccttgatcgctttggctagtccatcccttcatttcattctctgggattttctttttgagtgtcctgctgggaccatgactgatataagacatggtaggtttggtggtagacctttgagtttgaagcagttgaaaacaaataaataaacaaaaacaggtacttgatatgagtctgaagggtagaggagatggaaggcctggagatgtgaatgggatcccctagcagagagaaagggagtgaagggcagtgggccggaagggggtcttgagaggcaccgattgttaatttcaggcaaataaggaatttaagaagttgaaggcacagccagagaggtacagaaggaaagcaaaatcaaggaaacccaagatctaggaaatttcaagtggaggacttggcaaacagcatctaatgcaacagagaggccctataagctaaggtctggaaaatatctttatattaggaaataggtaggctattggactctctggagactgggaggtataaatgcttccgggaattgaagaataaaaaagcagccccttatctgataagagcataggtgccaggtgagatcagagagacctgaagtcaatatcaattctccactatgctatttactggcagtaggatgctgggaaagttatttcacctctctggattcccttttgttcatctcttatacatatgtcttagaattattgtcaggaataaataagaaaatgaccacaaagtactgggaacagtgcctagaatacagtgagcactcaattaatgttatgtataacaataaactaaagagaaaaatagtaaaaataggcaaagtgaagtcaaagaggtagggcaataaaaatgtgtacagagcagcatttcccaaaatgtgctccacagtacactggagaggctggcaatactcttgtattgaatgttattaaaaatgaatacctttgtggtgacatgaatttgggaaattattagtttaactttgtttaaactagtattaacttgtttttgtgtgccagaatttcttagaacttttaatatgttaacacgtattgtatcttccacaggagaaatatgatgtataacattttcaaacttgtttgattatagtatcctttttgtttctctttctttcttttttttttttttttttttgacagagtcttgttgctctgccaccaaggctggaatgcagtgacatgatctaggctcactgcaacctctgccttccaggttcaagcaattctcctgcctcagcctcccaagtggctgcgattacaggcatgcaccagcctgctcagctaattttttgtatttttagtagagacagaatttcaccatgttggccaggttggtcttgaacttctgacctcaggagaataatgaatatgctctaagaaacaatatttatgcttatatgatagatgctttgtttatctttcctttgtttaaaaaattataaatgtaaccttaaggataaagaaaacatagcagcaagatcaactgtaatttaaatctcagaatcaggagaatttgcttggaaagcaatcatcccaactttcttataaaacactgatgttcaggaaaatgcttttggaggaaaatacgtagatatcttccttactttatggactgtactaattctggcttcagtaattgtacatgtaaaatgtttctttgagttttgaatcaaaaaatgaaccatacattttaacatcattttccaatgtaattatcttaatatatagcttaacagaccaatcaactttgttcagtatatatcattgaatcataaagccatattttttcaaagaccatctagttcaaaatttaagctgatgcttagatattgtctctaatatcactgctaattaatcataaatggtgacattaccaacagctgtaaagtagccattccaccttcagacaacagttttgttgttttgttgatttggtttggtcttgagattaactacttctggttgtagcattcacatgttacttccatctctgtttgactttagtagagcactatatagtaactgctcttgctctcatgcatgttatgaataactgctttgccaacagacctgatggcttataaagataaaatgtgagaagcttgtcatctcactgttctgtcctcatcctccatcacacaactttaagctatttacaccagcctgagttttctgcctattgccatttttttcttttttatagccccaataacaaattgagtagaaaacagtttttattcttcccgagggtgttccacgatgaaccatggtaaggagttgggaatgctagtgtgagaaaaatgcatggcacatagtaagcattctatacatgcagattttatattattccaatctctgctcaagaaacatttttattcagcacttctttctgaacagcctatctaaaatcatccctatcactctaatattttaccactcttacctaagcttctttttcttcagagaatgtatcattcactaaatgacattacattgcatattttatgataacttagctcctctatgggaatatttataggtttcatgacagcaaggactttgtccattgtgttcactgttgtatcctcagctcctggaagagtgcctggcctatggtaatgtccagtgaacatttgttgaacgagtgaatgaatgagtgttgaataaataaatggagtgagggaggtcaaatggaaggtatgggacagactcgagacagaggaatagcaggatgcaggtgtgcaagcacagggagtagagaagctgcacagtgagatgagctaggagggagggtctatcaggcaggcgccactgagtcgggctggggaggcagtggcaccagggtggaggatgacctggagatgccattttgctctggtggagggaatagaggttttattaccacaggtgaaaatgagctcatttagacatcaagataatgttcctgacccttttttttctctttattttatcaggttagagtaaaccactgaggaccaaatgatgggtgcccaagtcataaataggttcccttgtgtaatgaagcaaaagcatagcttttctgatcatttattctccatcgtattcattgactgtgcctataatttacttacttataaaaagtaagtttttaaaatgtaaaactttgtttttatcttggctctacggtttgaaaatgtcaaatagaaacttaatgtgtaaatctttttttctctcaccatgcacgtcatataaccagattgtctctagacctcaaaaggcatttctggaaactcacacaactaactgaagctctgatgataaattattgtttttcttcaaaacttaaaacttttatgatttcctttacttttggaaattttattgtttatttttttaaatgcacatagatacctcacggaaattttaaaaatgactttttgaaaatgattgtcttttcctggataaaattccattacgtaacttcttatagaaacaactggtaatttttatactcagttgaaatactaggtgataaatattttattatgcaacacagacagtgagttaaacatgctgattcatgagtgctacataaagtgttagtacatatagaccaaaaacctgaattgtccagattttcaagtgactaacatacaaaatatatgcttaagacaactgctattacttaaataattcagtatttctctggtaagttgaaaggtattacataatcttgtaatgcactgatctatatccatagtctattaactgtactgaaaaagtactgaagtttgggttagctgtaatttttattctacaactttaattttgtttctgtttgttggcaaatcaatatatcatccaaagccaaaaatagaaggaaaattgtgatcaaattatttacactctcacatacatgactgaaaggagtttttgctcctgcctttataaatttatgatcaggagactcacttctggagtataaaaatagcattaataattctttaatgaattgttttccttaaaattaataatcttctttactcaatatcaaatcaaaatttctggaaacatttgaaaacacatttacacaagtctctttctgtctctggagtggctacactagaattaagctaattgtcacacatcatcctgtctctgagataagccaggaatttccaattttagtcaagttggtgatccataaaatagatatcctagtaaaattactatgagctttctacttactttgatattgtgctgataactaaagtgtaattataaaaattgaagtgttgttactgccaaataccacaaagtataagcatcacacttataataatacatattgacaccatcaccttaagaaatatcttctcatttgaatgtacttaaaattcttagatttttatctaggaaaaaaaattggcttctaaagttcgtgaatgttaagttgattaataagataaatagtaaaagaccgagggaatggtatattgtctccatgtattattaaacattgagtcatgtggtcatctcttaaaggattatagaaaaaaaaggtttttatgaaatgcattggtgtaatagccttatttacatataaacatagtgaggagatgtgcccaagtttattctgcattgccatgggggaatttcctctgcaattttccctaactaaattatactttttaattagtcttttagaactgactataggccttattcaaagtggttagatacttgagatttgtaatatggaaattgtggtattgacaaagctttgctaaaataatcacaaggacttagaactaaatactttggaattcattctaaaaacttagtttatgaggttttgttatttttttttaattagcgaaatttgctaaaactgagccacccttataatgtgtctcagattgcttccttggatttacattttatttatttgcaacaaataaaatacagttgcatctttaaaccctttttccatctctatgctattaccttggttcatttctactgctagattgatgtaacatctttcttttctgaaggatagttgagaaactaatgagaatctttccattgaaattcttgctgctacactgaggccttcaattagcctctttactatatggctgcttatggttttgaagtaaggtattcttaatttgatatctttaagcctgaatcaggtgtgcatcatcatgcacgagaattctgtaataacatacaaagaactggaaaactgacagatgttcacagcggaaaatgtataaaatacaacaggcagaaaaagaatatcatcattcctaaacactgcattccaaaatagctaccatctggagacatatctttccaaatcttttcctgtatctgtgcatttgagtgtgtatgttaaaaaaaaaaaaggtataaaacttccctactatacatgcttttttcacttaaaggtattgtgataatttttttcaagacctgaacattttcactcttctgcaatttaggacattaacccatatgtcaaggtcaattgcatgcaattcccaagtgtatttgcattgttaaagacgtagatgatcatagatacagattgtaaccatgaagtggggaaaaggaatttgttgagcaaagagattgttgtctatgtatgtgcccaccattagtgtaactactgaagaattacacacatagcaaaacttcagaggctatattggcaggcatttattttccattttttcacaactaaacactgtgcataaggaacttaagaataaaggcatgctggttaaaaaaaaagatataggattgaattctggctgtattctttactagctatggcatttggcagtgtactgatctcttcatagaagacaaatcacagtggctgcacagatcactattcctccagcagcccagtctgccatcccaccaggtcagcctacgcccagccttgctaatatcttgctaatcttggaggaaaatttcttttcctctttgatccacatagtctgaagttgggataccattctcctacttgacctcactgctctgggcagaatgaacagccaagaggtgaacacctgacctaagcccatgtggggactgcacctcgctgaccactgtctttggaattggcatgtgatctaagccagaacaatcagaacctagtcctacaattgttttcaaactggcaatggcaggggaggtgaaagaatattttcctttccagttgtggagctaaggcatgagcttggacagtgtcctcaaccataaaactgactcaagaagaaacgttttgtaggaagaaatattttatagcagaaaagaagccagcaggaatagtagagacttcagcaagactatcattcattgcaggaagatgatctcattcctcagactccagtgagtcactccacaggcacttagaaaaattacaaatttactaaaattcaactccatcataaccaagcaggcataatagtgatacttgggatccttatgtaaactgaatcagagtgattatgtaatttatcataccaaccggaacacttccgagagtgaagggatccttatgccaggacagaagacgcaaatcagcctgttctgggaaaaccgtgatggatggttacctcttcctgaaaacacaaacaaacacgttttgtgcagtatgcagtcactagttcctcgcccatctcactcatccatgaaaatctctgctctaagatgaactaaccatagaaaaggaattgcaattatcttaaatcaaaaactaaaacctgtacacacatattcctagaaacttcctactagcccagaactgagaataaccaaaatgtccttcaacaagtaaaaagtttaaaaactgtggtgcatccataccatataatattattcagcaatgaaaaggaatgaaccattgatacacatagccacttaaatgaacttcaggaaaataatgctgagtggaaaaagtccatctcaaaaggtctcattctgtatgattccattatataacattatgatgaaggaaagtttcatggttgccaaagactagggattaggggaatggggaatagctgcatgtggctaaaaggggctaacatgaggaagccttgaaataatgaaacagttatatatcttgattgtggtggtaattacataaagttatacatgtgataaatttgtaagatctggacatacactcacaaatgagcacatatgtaactggtgaaatctgtatatgctctatgagatgtactaatatcaatttcaccttttggatttttcttgttttaatatgtaagatatcaacattgggggaggcaggatcaaaagtacctggaactttcctgtatatttccttgcaacttcgtataaatctgtagttatctccaggaaaaatgtttttaaaaactttattaggtttttcaaagcttgctttgttttgttttttgtatgtgtgtgtggcactctgctatgtattttaacagtggatagatatagtctttgtcctacagggactgtttcagaaaaacaataactacaattgcagggaaagtaagttatcgaagcaaatttgaagcacctaggaacatacacaaaatacacaaagacctcaataaaacaccattagctgcaaactcaaatttattatgaagcacgttgtatattggactatattcttaccaggtttatctagaaagttcttgaaaggaccaatcattaaggcattccccttcataattcccacaacattgttaaaggcaacattttaatgactcttcagagaatcagataaaaaaggaaattaccactgtaagaggtaagggcaaaatattaattgataaagtaatattcttccattcttttagtaattattaagtagcatatctggaaatggtataaataagtctgaacaaaatagaaagtataagataagcttacaaggtttgagtaaaacaggagcggagtagaggaaaagaatggatgaagtattaatgtgaagatgaatacatgttcagatatttccaccagtcaatcatcaaacatgtattaaggtaaacatgtaaggaaggcactgtgttcctcattttaagagtacaaaacaaagttattttgctaagaagtctgtaatacaagtgaaaataacaaacatgtaagaagctaaagggcaatatatgagttaatactataatagaagctttgaagtattaacgtattagtttataaatgaatgagaaagagaactgtattgaaataaatgtccttgcattcagataaaggaaaaagctcttgggctggagggagcactgatttcatgaaggaagacaaaaatttaatataagtccaatagagtttaaacagttaagagcaggttaaggaaaacatttcacattggagaaagagaagaacagaagtagaaacacgagaaaatgtaagttatgtttaggaggcttgaataaaacagtggggacagattcaggtcctgaggaggatgagtagttggaaatgaggttgaaaaggtggttttgcccagccatgaacttctattcataataatctattcaataatgctgcaaagggaaacattaaaatgagctttagttcagcagtggtgtgcaggaaaaaaattatcatacctcattttagctttaattgattttataattccaaatttgctgttaaatgcaaatgcttaattctaaatacgtgtgctctgtcttaattagataaaataatcctctgttgcttgggtagttcagtaaattagtccctagacttaaactcccctggatcatgttgtttatgcattaatcggtatgcactcttagagataaatgaaaaataaatggattttttcagagacaagttgtaactgtcagcatactttcaaatttatatcctctgcatgtgactaaaaatttgccatcgtttactgtagtaattacaattcatatatatatgctcccatacttgtagaatttcttctacatgtttgtattttatttaaaactacatgttgctagccaaagctaagtagagaatctaaacctcaccattatgtacataaccatgccaccaactcaacaatgtaggttctatctgcatttgtatataagatatgtcccaaaggaactaatcaatgtaggtaactgaagcagaaattaaatgatttagttcttccaagcctcactgccttattgataatgatggagatgatactgatgatccctaccattgactgagtgactgctgtttattggggacattcctaggaactttatgtacattatctcatcgaatccttatacactcctatatattataatcatttcagtaatgggcaaactgagtttcagggagaaactaaaggagttaggagtgaaaccttggtccatttgaccacagaactctacacacactgtaacataccatactactttgtgtgaaaactatgacacggcttgtatttcccctttattggtctaccacttcttcctcttcctcttactacggaaatatctcgagacacaggtgactgaatcagtccttggttgggactgccttttggacagaaatggggtagggatcactcctggagacagctgattcctgcccatccaaaatcattcttgcggtttcttttttctgtccgtcaatctgtcaggcacatgttcccagaaaaaagtctgtatatcagtggattcctatatattcgtaaacgtcaggcttattcttttgttttttatcttcttcagtgtaatagatttgatgcttctgtactctgtaagataattacacagagctgaatgtaatgttacgtgctgatggggagaactggtgttttaaattcttttaaatctggagcttttatggtcaacgttagaagcaccatggcagacttatgccctggctttagaagcctgtatgagattttgtgacttgctggctttatgagacttttacacctcagattggcctttccctccaagaaagataccaccagacaacaacaattttaacactaatgtcttccttttgattacattagatttgcaaattaaacagattaatagtagtgttctgtgttcctctcagctcttctgtttaatactcttatctgacaaagtgtaaatagaagacataattaattactcattacttgcatgtcaagttgcataaaaaattacatccccaggaggcctattattacatatctgactgttcagtgaaattagttttgcaaagaaaaagcataccttaaggtaagggttttgtttgtttttcttttctttttatttaatttattagagtatctgcaaaaaattgtggaagaacaacattaactcttaatacacaattaaagagattaattcatttgcccaaggatatgttatttttccttttttattttttagtttgtccatgagatattaaactttgcatttgaaagttataagctaatgatgcttctacaaaaggaagaccccagaatatgcctattgtctctttagtatatatcccacagagaaagttattagttaagcaggctatgtcataccccctcctctgtaaattgtctcaaccttgagctgggaagtgtactgccatgactgaaaaaaatagaataattttccagccatttcttgtcttatctgtctagagttgatctgaatgaaatgaggtctctgcttcaactggagagctcagcatttcatatttagctctcaatctgtttcatgataatttttgaaggaacagactgcttatgacaaaatgtgctgtactattattaaaggcatactgcctttatagagttccatcacttgaaacaaagtgctggctgggaagaattcttgaatgtgcatatcttctgaggttttttaacagctattaaataaaatatagtatgtgcctcaggtaagagaaaaccaagtacctgattaaaaacaaaacaaaacaaaaaggtcgtagcattgtcaatagagcaaagcagcataaagcaaagattacctgcctgcaatcacttagtcacttcacctctctgtaaaaatgacaatcataatcacctctacctcgcaggattactgtgaggtctaaatgagctaatctgtgaaagcactttgtaaactgtaaagcacaatttaaatacatattatcttattaaaaatgtctgcatcacctgtttcattgactctgggagagagatgttttcttttccacatttatgtgtatttgtgcatgtgtgtagtgtgtttcgtggaagcctttaattaacacggtagtactttctttttctttttataaactaaagtttgccatacccaagtgcactttctgtcacctgaagtcacagcttaattatgtgtctggaatgacttaatatataaaagtcataaaaatttctgtctaatggcaactatttttatgttagccctgtcttttatatactgaccagatcattctcattaaaaattgttgtttatctaatttcatacccataccacccagcattctatttgtacagtgttttatgtctatgatcaccaatcatctttcatatgttatatttgagcataatttattctttctttctatgaacatttatagagcatcaattgtgtgccaaatactgtgctaatcattcagtgtctccttggatttcacttatctgtaggtaaaagtgattacatatttatagtaataactccaattacagtgcagttggctcaaccagtacacacccaatatcagcctttttcctatgaagagccctcacaggtgttgctcagtgcccagtggggctttgctgtggaaccctagttctctgcccttccagcctcgaagttttcctgttagacatctgccctgctcgaccaggtgctaccactgccaatcccagcaccttccttgatgtacccaaaatcttcccatgccttgaaaactaagcctttcttagtatgtcaagctgttgctttggggttttctttgttagtttggttttcccattgcagtttgtcagctgtgggccgataggtttctggaatttcagtgtcaccaattattcaggtatgtgtacctattcaggtatgtgtaccagaataattgtgtgtgaaggtgtgtgaagtccatttaggcacaagctgggatctccactcccgaccccatcacattaaaaatagcaaaaattacttatctaattttatcttcctctcatttgccttgtccatcttctagttgagttgaataaactagtggacagtgaaataatcaaatgcaggatagcatacaggaagatgaaaaacataaatataatctaattttttaaagcctgtgttaaatttcttctgcttgtaaacgttttgaaatcttaattgaatatgaaaatagatacaaggtaaaaagtttatttttgtttgatactgtgctccatgtatttatttctaatttccacagtggatggaatattagaaattattgaaagtcctaattatctcaaacatttgcattttacgttaaatgtcctaaataagcaaccatttaatatgaatttaaaattaaaatttaaaggctggacgcggtggtccatgtctataatctcagcattttgggaggccaaggcgggaggatcacttaagtccaggaattccagaatagtttgggcagtatggcgagacccctatctctacaaaaaatttcaaaattacctgggcatggtggctcgcacctgtagttccagctacttcagaggctgagatgggagaatcgcttgagcacaggaagtcggggttgcagtgaacatgattgtgccagtgcactccagacaagatgaaacagcaagaccctgtctcaaaaataaatatatatatattttttgagacagagtctggagtctcgctctgtcgcccaggctggagtgcagtggcgccatctccgcttactggaagctccgcctcccgggttcgcgccattctcctgcctcagaccagaggcgcctgccaccacgcccagctaattttttgtattttttagtagagacggggtttcactgtgtgagccaggatggtctcgatctcctgacctcgtgatccgcccgcctcggcctcccaaagtgctgggattacaggcgtgagccaccgcgcccggccataaataaacaatctttttaagaaaagtttcattctttatagaaacatatcctacgttgaacgagagttttaatgtgagtctacataatcattgtcaggttctaactaaaaagaaggcaaatataaaaaccggctttgtcacttgaagaacacaagaaataataatgagaactatgcaccatttcacaattctcacacttgaacattgttaatgttgaagccccaggattatggaaacactggaaatatgccacactgtgatcacattcatttttagaattaatagtaggtatcatccaaatggttctaaaatacattttttaagtgtgaaatgtctttcacaaatatggccatgacttttcagagcactcttttgcaaataaataattctggatagccaaattctactagacctccctatacagaaatctcataaaactcagataaatgcaaataagtcaatgaaaagaatagctctctatcttcctcctaactcagccacttaagactaatattgcctctattaaagagatgaaagcagatgtggtatacattattgatattgctccacattgaaagttaaaacttttatatatgttctctcagattatataaaactcatataaaatttacttaatgaagttttcaaaatagtgtatgggaaaaagggtaagtttgtgatttcatggctgttttcatatgctgatctgaattcaatgtcgtctctctcttttcacaaaccatctgggagattgacaagttgcatctcaccagatggcctaccataccaacctcacacttccatggcaccatccctccatgataaatcctgaaatgctttaatacaatgttcctgctcgggaagaactccacagctcatgccttacgaaccagttcatcgtcacccacttcatttcccaaggttgaaatgggatatgatttccactgggtgctaaattattctatggctcagaggaattaagtgatcccagctgaatacaccaccaagctcctatcatcctatctttctacaatctcttttcttattctctgtttcccttactactccctggcctattcttttataacttacactttacagagagattccattcttttttcctctccttttccatatacataaatcactggaatgtatactttaaagtgtcagaaagcaatgacagttttgagctgtggttcatgtcttcctgaacctagcatgcagatagttgatactatacaatacaaaactgaattgtctgtgtcaattattttatagtatcactacatatttaaaagatactataaagacacatgcacacgtgtgtttattgtggcactgctcacaacagcaaagacttggaaccaacctaaatgcccatcaatgatagactggatgaagaaaatgtggcacatatgcaccatggtatactatgcagccataaaaaaggatgaattcatgtcctttgcagggacatggatgaagctggaaaccatcattctcaacaaactgacacaagaacagaaaaccaaacaccacatgtttgcgttcataagtgggagtggaacaatgagaacatatggacacaaggagggaaacatcacacaccggggcctgtcggggggtggggggttagcattaggagaaatacctaatgttgatgattggttgatggatgcagcaaaccaccatggcacgtttatacctatgtaacaaacctgcatgttctgcacatgtatcccagaacttaaagtataataataataataaaagatactgtctgggaagagattcttaagaccactcattcttccttttgcctttacaaatgtcagagaggcactaaagaacaaactgtgaaggaaaaagacctgaaaaaatatcttttttcccctagcttacagatcaaatctgacctcaatatcttcccccactccctcccctacttttcccctctgagcctctctcataagttttataaattcttccagtcatttagtgttcaagaagagagtccaaatcagaaactttgcttaatatgataggtctcatttctctggtgccttgatcatctttctttaaatagagtgaattttagcttccaagttattttttcttctctttcttgacttttagactttactgtgtctgtattctctgacaaacatataaactgcttatatcttcaccctcatgttttgcatatcaaatccaactatctgctaaatttttcttttcatttagcagtaactgactaccataaatatactatcactgtaagaacaaaccatgtcatagagaagtttgcctccaggaactttatttcaaatctttttacttaagttttcaaaatgctactttatatgttattttatttctcccattgcatccccaggttgggtcagatgacagtatacctgcatcatctttatatgtggatatcagtttccatttcctattctcccacatgcagagctgcaagaagttgtctgcagcttgttgggcacataaagatctttatggaacaggctctgcacaatccaacataatattgacctcagagaagtttggtgctttccttgggtgtgactttgtcgactagaagattagccagtgtttctcaagaataccgaatggtctatttggtgtagataaaaagagaaattgtgatgattaatgaaagaggaatttttgatacggaaagaataagattagttctgtcatgaggatagggagaccaacagctaactcagttagttaaaggataatggaatagagtaacatgaaaatctgtcatcttacttccctgcttaaaacatacaaatagattttcatggttcttcagataatgcccacacttcttcaggggtttaaagtctttcatgatctgatttattatcactttgttagtgtcatctcttgtcaattcctcacctttttatgctgtaatctttctgaatttttctctgttcctcacacttgatactcattctcaccttcctctaatcctttgcatataccattctctctgcctggaaaattcctaactctacactctccccttaacccaacaagtggctcctcatcctccaggtctcagctaagatgatactccattcacaaatgcattcctgacctcctctcctttaaaaatgggaggagtactcagttttttcctcctcctcagaaaccttccatactccatccttaattggctatctggaaaagtcctgtttatttatcaagacacaacttaaaacagttttctattctttgaaaccatcccagcctcactcaagtgtagttgattcttttccttcttaatacatcactataacttgaagatatgtctattattaattaaattacactgctatgacaagatttccctgtatatttatattcccaaccaggcaataaatatgatctccttaaagaaagagactgtcttatattcactattatcattttacccccaaatatactctttcctcacctgcttatcttacagatgtaattaatttttagttacctatctgttactctgtaagccttctaagggagggaccatgtttaattcaccactctttacctaccacgtttcacaaaccttggcacatacagacactcagatagttttagaatgaatgtatgagcttgtatttgtatacaaaagataaatttttctgcaagtattaacaaaaaaggactgaaccagagactcttagtagttttctgtagcctttactaatgttgataatatatgataaattggaggtcatagaaaattcatctggtctatttagttacaattcatttgcatggccccatgcagggcagagatctagaaaaaataacacttatgaaaagttatgacaaataaatcagatgagaataccagattatacaatttacctatggccctaaacatagtctaatatacttaaaagacagacatacttaatatcatctgcatacattttttttcaacaagcattatttatagatcatctaaaatatgctaggctctgctgataggaaaaataatgcatcccaaaagatgaccataccctaaccctaaccgtaactgtggaagctgtaaatgtgttttcttatatgacaaaagagactttgctgatcggattaagattaaggaccttacaacagcaagattattctggaatttctagctgggctctccaatcacctagttccttaaaactagaagaggaaggtaaaagactaggtcagggaaacggccacagagagactcaccctaccattgctggcttggaagatgcaggagaaagggcataagccaaggtatgcaggcagtggaaggtgataagccaaggtatgcaggcagtctctagaatctgggaacagtcctcaggtgactaccagcaaggaaatggcgacctcaatccttgtaacaggaagaaactaaattctgccaacaacagtgaaggagttaaaaaaaaaaattataggccgggcgcggtggctgacgcctgtaatcccagcactttgggaggccgaggcgggcggatcacgaggtcaggagatcgagaccatcctggctaacacagtgaaaccccgtctctactaaaaacacagtgaaaccccgtctctactaaaaatacaaaaaaattaaccgggcgtggtggcgggcgcccgtagtcccagatactcgggaggctgacgcaggagaatgacgtgaaccccggggggcggagcctgccgtgagccgagctcgcgccactgcattccaccctgggcgacagcgagactccgtctcaaaaaaaaaaaaaaattatagagcccctagaaaggaacacaactcttcttctgacaccttgattttagcccagtgagacccatgccagacttctgacctatagaattgtaggataatacatctgtttcaagtcattatatttgtataaatttgttggagcagcagtagaaaactaatgcagcactgggctaaatgcttgggagagaacaataaagagctattcttaattaatgtctcttttttatggcatttttaaagaccatagaatagtctgacctgcaaaacagatttatggaacaagtaataccgatacagtataataaaacttatagtagatgtatataagttttatacttcaagaaatagtgatggaattaaggaaggtgttaaatctatttggagtgggatcagggaaaatttcagagaacaaaccattttaagatgggtccttaagtaataaatactagttttccaattggctagatgggggtacgatttagtaccatgttaagctaagaaggagtgcaattggagatggatgagtgatagaagaatgagtgacatgaggacttgtttgtcccacaaaatgtatttggatgtataatatggaataatttgcatctagaaagtttgctccagctgcaaatggggaatggaagaggggcaacactgtatgcagagactactaccataggctgagtaagaaaggatgaggtctctgttttataatagcccccatttattggaacttggctatgtgtcagcaactataacaacactttacatatataattccatttagtctctgttagttagctctgcaaagcagatgccattccatctcacaaagaaaccaaagtttacacaaatgtgcccttaaaaaagaaataccccacaaaaagctaacaaaagtaggattcaaacccagttgttaatcacattaaagcctgtgctttaattcactctaccatggcaggaacagggaatcaatataagaagacagaaagagagagatttaataggtaaaattaactaagcttattattgattacacgtaggacaagggaaagagaggaattgtagcttactgatagtttttggatttgagttctaggggaaaggagttccagctaagatagggaccaaagtagaagacactttctgagtcaggaataaaagttaagcttcggatgaatttaaggtgtgtattggatagccaggtagagatgcccagaagccagtctggaatttagaattgggacatggactgaagagaaggatttgaaaatcatctacctgtaggtaactttcatggtctggaacccttcatatataaatgttggagaaatctcctgtttctaatgaatagtgaaagaatctatccttatctgtgctctgaaagaaactttcatctgagactccctgaaaagatggctcagcctaacaccaacgctgactaccagactgggggtgctggcaaaatggcaaactgacagtgccaagggctttgtctgtgtcctgcttgatgaggtcagaaccttgttcccgtggaagacctactatgtcatacagctctgctgcattaacagccagtctgaaagtaaatactttgctttagacactgtttttaactgcttaatgagcatactgacttcccaccctaccccccaattagctgcatatcaatcagtcaattagcagatagacagctcagccaaggaacagtgaaggctggtgttgcaactgattgttaaatctgtcttgaatttgctattggaaaatgagagaagtttagggcaaatactgctccctgtacccctgactgaaatcttctagacaaaataattgctatcaaatattctgatacaggaattcttgaaactgcctggttactttactagaaagggaagcagccactaactgcaaaagactacctctgttgtaccagatgcacaagaagagattttcaccattgcagagctatttatacacagccaacttctgtcctcagttcacatatacacacaactcccattgatatcagtggaagctgcggacatgtggctgagaacagaatttggcccactgagctgcaaggcttggcattcttttgctcactatgacaacttcagaactggatctcttagcacatgtgcttttagaagaagagttcttgatttattttcttttttttccctcccctctttatcttggccttgaaaaacaaaatggaaacttgagaaactactggcagcaatgggtttttcttgcatagaatcaactgtatggcggacttggagaaacagagaccatacaagtttttggattcaaaaacttgacaaaatagttttctgtaagtgtgctgccgttcccaggatgccgactaacagcttggcttcacagtcgtccttgaaataaaagcaaaagatgccatgaaacaacttttacacacgtaaaattattaagtccaatatttaatttacagatgacatattccagagaatatttgaaacctgtcattaatatgtacttttattcttcttataggaattgctctttctctagtttaagtgattttagtggggctgtcagcaagactcctgcctccctgtaagtgtacatgtcaggctaggcaatcagtgtatccagtcctcttgaaaacaaaaggcctattaaccaaggagagacaaccagcatatgatatttcaaagattatatggaacagggaaacagactctccttccgaggtcaggagattaaaggatacaaagtcttttagctttgggggccagttttgtaccacttagagaaaaactgcaggtaatgaagccaacagggaggaaagtaaagaaggtagaggagaaaacatttttataatatttaaatccctggatctagccatgccttactgaattttcccactatgaacaaaaaattaatccctttattcttaaactggttggagttgaatctctaataactggtaacctatagggatttaacaaaaaaacattgctccttcattcactctagagattttctctgccaaaatgtatttttttattgcgtgcaaacactcagatttcaccatctttgtatatactgaaactttcctaaataaataacctcaggaaaaacatgtgatttgcaataactgtggatgctcttcacaccaagaagataggcaggaagattatactagacaatgcaaacacataatgtctccatgtctctgctctgttgggaaagaggaagccagtggaggaccctctttgtggatgcactttgaggaagcacctcattatcttgactcttggctgttgcccagtgtggtgccctgatggagtctgcgcccagcatgtagctctggtaatggatccagtgacaggcagactgtgttacaaggtgcattacacttgaccagccatcattacatcggttctgcccaaattatttgattgacatttttagagaaagtcaggaactgttcataattggtagccaggaaggcactattttcaaataagtgaataccaagaatgaaagtgtaaaggaagagacttaaagaaatgggaaggttttcagccaggcgtggtggctcaagcctgtaaccccagtactttgggaggccaaggtgggcggatcacgaggtcaggagatctagaccatcttggctaacacggtgaaaccccatctctactaaaaaatacaaagaattagccgggtgtggtggcaggcgcctgtagtcccagctactcaggaggctgaggcaggagaatggtgtgaactcgggaggcgagcttgcagtgagccgggatcgcaccactgcactccagcctgggcgacagagcaagactctgtctcaaaaaaaaaaaaaaaaaaagaaagaaagaaagaaatgggaaagttctagggaaatgggtcttctgccattgtgaaatttggatttcacaatttaggatgtgtgggccatcctaaaattaggagaatgtgattcagccttgatacacacgaattggaagaatagcttacataaacagcctttagttacatctatttggcatagcaatgaatctatgcaaaaccttaacagtttattgtacagtacattcccatcaattacccagaaaatacatgtcttatatgtcaatatatcatgcagtagattcccattaatcatccggaaaatatgtcttaggaataagttatctactgcctgaggaatttaatttaattgttgaagaaattgccttcagcagggactgatttcttgcatcattaccagtgagtgtttcctcacatgtaataactgattttccagacattcaccttataactcccatttatgtgcaggttacaatatccattagacatagaagtcccccttaccacacatgaaaacacatacacccacctacccactcatctaccccaccctacccaccacacacacgtaagaggacttcaaaaagttcaaggacaaatggaattaaagataaaaattaaaaagatgaacttgtttttcaacatatcatcaagttcaagacacttattataaattatgataccagccatttagtctgtccctaaagaactgaggctcctaagaatttaaccatgttgatgcagtttttttttttacattattaagtgaggaacaatggataccctttacagatttttttaacattcagaaacaaaaagaagtcagaatgagccaaatcaggacgataagttggatgtctaacgaattcccactgatattctcacaatattgcccttgtttgatgagaggcatgagcagaagcattgttgtggtggagaagcattgtcatgatgaagctttcctgggcatttttcctcaaaggctttggttaactctcaaaacactcataataggcagatgctattgttctttggctatctggtatgtcaacaagcaacatgctctgagcattccaaaaaattgttgccatgaccattgcctttgactagtccacttttgctttgattgtaccatttccacctcttggtagccattactttgattctgctttgttttcaggatcatactagtaaagccatgtttcatctccggttacaattcttcaaaggaatgcttcagggtcttcatcccactcgtttccataaaagctatgctcttgtctgcagctgatctgggctcactggttttggcatccatcaagtggaaagtttgttcaatttttttcagtcagagctgtgtaagctgaacaaactaagatgtctatggtgttggctattgtttgtgctgttaactgttggtcctcctcaaatagggcactaaatttttttttaaaaaagggcattaacaaggttaaatttttctacacaaattgatgtagatggtctgccacaatgggctgcatcttaaacattgtctcattccttcttaaaatgagtcatccatttgtaaactgatttctttgtggcattgtccccataaactttttataaagcatcagtgatttcaccgttcttccactgaagcttcaccataaatgtgatgtttgttcttgccttaattttagcagaattcatgttgctttcacagggggtcttttcaaatggatgccttatctttcttagtgcttcaaactagattgtatttatacacattataataagttagtaagagtttattttggtgcaaaaagtttttgaaatccatctatagttttctcataaatgcattttccatgaacttttcaaagacctcttttccatcataaatctaaaaaatgttaagatttaagtagcttcactcatctaagagaatcactaagcatttatttgactgcttgtttttcttctactttaaggtgtgcatttgtttcttactgcatgtaataaaaggagccatataaaaaaggtttgttatatggtataataagcaccgtatatacatggtctttctggatactcacaacagccttgtgagacaaagacaaccccgttttacaaatgacaaaaacaaggcttagggctatgaaataaccaagcaaatgagtttgattccaaagctcattctaataaccactaagtaaatgtcagtgcactgttgtatatttttaccgtattttataaaaggtccctaaagacccaaatcctctgtgcatttagttacaagcaccattctgcatttccccccaatacattttcccctggtttatacctatcttctttgttctattatttttgaaattttgagtagtaaaggaatttgggagagggaggatgaagagagagagaaaggaagacagaatcacaccgattaagatgaatttagaaagtaagaccactacggctcacattggtggcatttccctatgtgtctttgcaatgctcttatctgacacaggtctcttaaaggttgggttgaatatctgttcctcagttattgctcttttactccccaaaatcttcccctacaaaggactaaaaatagtgatcagaaatgacctttccctccttagtcccaggtttgtttgggatttcatgtaataaactagagcatgggtgtcctcttccactgattgccatgttcatttcatggccttagtcaggtgccttggctgcaaattttccctctctacactgaaaaacccagttttgctgggcaattttagttcccactatgaagaaaacccttccagcatgtaaatgcaatgcttggtgaggcctttcctgaaaagcagtgttggccttcacacacaagatgagacatgtggagattaactttaatatctaatctattgcagaggtgaaactaaattctatttctttctcctcatctgaaatgaaaaggaaatgcttgaaattttgccccccaaaatagagcactttaatcaaaccattttaatgtgatattcctgtgtcttcattaagtttccagacagttttaatgtttattgaactaaattgatagggttaaacatctttgtaagtataaactaaagtttttatggctatttctattattgtgtaaaagaaaaataacaaaaaagtatctattcgtttgaggaggtagctggtatttgctagcaaaggagaacagccatataattaactgtgtcaaaatgttttctttgttcacagttaatctaactgcagctgctaggaggcagaatgcataaatatgactgtgtacttttaattacagaaaatgacaggcgtaagttgtgactggagtgttgcctgagattgttgtgggcaaaaatgttgctcagagactcattgaattaataagtagccttttattttttggtgtccaaattgtatagatgttactagcaactaaaataaaattaaatttcagaattttaatcagccaaagaaaatttaaatataatcctgcaacatatttagagaaatcatggcacataataaccatttgatattgaacattatatacaataatacttcatacatgtgatttttgtcttggagcaagaaatgctctacataagtgaattttctagagatacctttaagaattaaattatttctcccaattttcctctccattctgtgcaaagaagtcactcccaattctgatttttttccctagatgctctaataataatgaagacaaaatatctcatatttgctgatttttctgttttgataacacatagtaatgcctataaatggaggggtgggtagctctgagtcctggggttcattcccctctaggtgttgatacttatgacatagtatgaaagagaaatggagcagcacttcattatttgggacattgttctcttcttcttccccttttctcttctacctttaatggctgaatagtatagcagaatgttcattgggctttccatcaaacatattttatattcattgtaactctgagcagagaacttaacctttctgaaaatcagttcatttctttatatggatgaaataggatcatcaatgtttaaattttaaatatagtgattgctcagaaatgttattccttttctttttatttttctcctctataactattttttaatcacctttttattatacatcttttctcctttctgtgctatggtagacaggtagggggtgtggtattggctagggaggcttaaggggtcacggtcaatgctgtagataattgctgttttcagctgccttgttgccttcattctattgtctatccctgcacgcagccactgtgggggtggctgtcaccttggtgacagcagttttgtgccatgcatgtggtgtgaacactggcttagagcagggtataaacaggtcctgctgcttcaagtaattcggtataagcagacagactattgcctttgttctcttagcagctctgctgctgaaatacactaataatagaacatgttagttgaaattatgcctctccatctctaattactgcatgccaaagtattctgactgctactgtcatttcccagcaactgatggctgcaggtgattgtttcagattgtgctcaagggacttcttccactcattctactcattctccctttgccccactacgtcatgtgttcaataacttgactgattcatttcagtatgctgaatggtttgaatgaaatagaaatgaactttaagaaaatattttcaaatcagcagatgttcattgtgggttttctctgtgtaaaggaaagtggaacagtcatagaaattgtttagttatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacagtgagataccatctcacaccacttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcgtcactattcacaatagcaaagacttggaaccaacccaaatgtccaacaatgatagactggattaagaaaatgtggcacatatacaccatggaatactatgctggcataaaaaatgatgagttcatttcctttgtagggacatggatgaaattggaaatcatcattctcagtaaactatcgcaaggacaaaaaaccaaacactctcatgttctcataggtgggaattgaccaatgagaacacatggacacaggaaggagaacatcacactctggggcctgtcatggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtatgataataataataaaaaagatgatctatgcattcctgagcctaattttccggattttgatgaagacaactattcaattccatccctactcctacctaactcccccacgtctctatgcatttcaggcagaccttcaaccacgacctgatattcttcctgctgcagacagccagctctgttcagtcaggctttggatcctggagactctctaatctagtttctaagttttacagatgaagaaattctgtgttacatgaagtgtccaagatctcacagtagcttaagcaaagatagaagacaaacccagcattcccaactgttgatattgtatgctctgtgcctcacttcattgtatgttttacctgttatttaatgtaacagatgttgctgataaaatgtgaacagaagttgtcagtggcaggtacaaatcccaggccaacatcgaaagtttgtcactgtcagaacttctgttcagttttagttacatctgctaaggattctaagcacagtgtacatgaaccttccaaaagatccttggcatttttacatcacttttgtttcctcctgctttttatattttatggaatgagtccaaaatgatcaaggcatgtacagtttacataattgtgcactcaaacttgaattttacatgcatccagaatttggtctaattctgtaaaataaaacctcagttggaactgggctatgctgaaaagcaagtttgatataagtgacattcaagatcaccttgtattttccagatgatcagacctgctgtttctaaaagagtacctcactttgtagaccactaaatgcaaattgtattttaaactatagatttgggggaggaggggtaattaagagttatagtaatattgattcttacccatgtatgagtacagatgatatccccatttattcagacattgttttatacctttcattattgttttattgattttaatgcccttattagattcattttcagatattataaaggtttgtttactcttgtgcattggtctacttttctttctctttccttttttttttttttttttttgagatggagtctcactctgtcggcagggctggagtgcagtggcgtgatctcctgggatcaagtgattctcctaccttggcctcccaagtagctggaactacaggcacccaccaccacgcctagctaattttatttatttatttatttagtatttttagtagagatggagtttcaccatattggccaggctggtcttgaacaaactcttgtgtgcggatcaagtgatccacctgcctgggcctcccaaagtgctggaattacaggcaagagccaccgcaccaggccattggatctatttttctgtcatgtttttcaagtttgtttttgttgacttactaaagaaaaattggttttttaatgttaattatgtgttcagcatctctctaggactttcttctcagttcatgtagtttgtctttctatctttctaatcttatcttgaacagcccactcagctttgttccaacaacagggaccttcagatagttcctaaaattccccaagcattttcctcacccagagcctttgcttttcctatgtctcaagtgttcttcagcccaagtggttagctctattttctttatctttcaagccaccatttaaaaatcaacttatcgcagagattattcctaattataccatcaaatgtgggcccttccctctattgtgcttttcaaattccccagcatcacgtttttacccttcttaaaatgtatcgcaagctggaattgttttacttacttgcatttttacattaaaatatgagtttcatcaggaaaggagcttatcagtgtggctcactattatcttcttagcacctaaagctgtgtctgacaaattgtaggtgttcagaaaatataagaacacaagaagagtgacctgagactaatgatctaacatctctgattataagtagaaaatacattttcaaagcatatagtgatacactctgtctccgctgtaaaagaataaaaataaaatataatcataatgaatatccatgacaataaaacatagtgaaattttctggtctaagtcctgtccccaagtgccatgcaggaacaacaacaaaaagccaagaataatgcatagggactcagcacccaagtacggtttgagccacctgaatttaaacagtctgtgattgatttagtatctctctttctctctctctctctatatatatatgtgtgtgtgtatatatatacatatagagatactaaatcaaatatacaaattttctcttatatttatatgtgtttaaacatatacctatatgtttataagttaaaacacacacactatgtgtgtgtatatgtgtgtatatatacgtgtgtatatatgtgtgtatatgtgtgtatatatacgtgtgtatatatgtgtgtgtatatatatacgtgtgtatatatgtgtgtgtatatatgtgtgtatatacacacatacacatgtgtatatacacacacatatatacacacatgtatatacacacacatatatacacacgtgtatatacacacacatatatacacacgtatatatacacacacatagtgtgtgtgtgttttaacttataaacatataggtatatgtttaaacatatacaaatataagagaaaatttgtatatattgaaacatataccagtataagagaaattatgataaatatttaataaatagctcaagaatcacttgctgcagaaattcagaacatgggtcgggcgtggtggctcacgtctgtaatcccagcactttgggaggccaaggcaggcagatcacgaggttaggagatcaagaccagcctggccagcatggtgaaaacccatctttactaaaaatacaacaaaaattagcctggcgtagtggctcatgcctgtaatctcaactactcgggaagctgagacaggagaatcgcttgaacctgggaggcgaaggttgcagtgagccgagatttcactactgcactccagcctgggcgacagagtgagactcagtctcaaaaaaaaaaaaaaaaaaaagaaagaaaaagaaaaaacaaagaaattcagaacatgtatccaacacctagtgtatcaatagaagaatagggcttatttgaccaagggtcattaacagtgttctgttaatgaaccttgaattggccacagaaaacaatatcctgatctgtcaaataaatgttaccaagtgcttactacattcagcagtgcgtttagtttgcggaagagcagaatgactaaatgaatgaatgaattttaaaattgagttagttatgtggacgtttggcaaatgtacaaaaagaatcagcaaagttttattacaatgcaaatgttatgctgcattttaatttctatttagcctctaatatgcaacattaaatcaaactattgtgtacaagaaccttaaagttcatttaatgtgattttaattcatgttataaattaaattatttgcaatggaaatggagaaatgtcttatatcttagtttagacttgtcagctttccaggctaattttgtgcacagtaatactaactgtagacagacactgtacatgaactacagtgtccaaatcatagatcggacctacaataaatttctgtgtggaggagaataaattctcctccttctctccattctcatatcaaactcctccggtattgcattgctggttagcacaaactaacccataaacagcatttaaggggatgttgccattgctgaagcacatactgctattgaatcccattcttcaagcttctcatgcatcactgaaagtcattcaggactctggattcaccaggaactataaaagccaccagcaactactgagaaggcaatgcaattgaagtgtaactctggttggaaaataagtagggaattgggtgttgagtccctgcgtgttattcctggccaaatacatcagagctacatgtcaggttttgtccaaaagtgttgtatttgctttgattttcagaagttcaatataattccattattacaagttcatctatttcttaatgttttaaatacattttatctaagtattgttttgtattggatttactctgaatatgtcaggtctttatagagaaaacagtaaataggaaatatgatacaatatttacagaaaatattctccagttaatgtatcttattattatatgctcttccttatatggtagagtttatgaagttattgagttcattagaaagtgaattaagaacatgaaataggtccagtaaaatatgaacccacacatcaaaaaaaaagatctaatctccaagtggcttgaagtgtagtgtaaatccagtaaagctccaaaataaataaaataaaataaaacgatattatagtatgcatattcaaatgtattaataaaattgtgtgaaacctttttttaaagaaatgtaaatctaagttaagtgttcttgctgttacagattaatagatccacaactttctaatttcaaatttgaaaagctaaacttgtgcaccaaaatattttcagctgaaatatttttaaacattatattttttctattattacttgagctttttaaacttagtaattcaaactaatcttggaacacttgcaaaatgtgatggaaatgaagaagaaataagctgtaaattcaagatggctgaagtttaatttctgtgccgaccttgggtatgtctagggaggaaaattggcactctcttaacaaaacaaaccagagcttagtttctacatagaacaaggtttgaaatgaatatggaatgaaggtaaatatttagaagattaattctttgagcttcctcaataccttagttttgcaagactttgaaaccatcttctccagggacaaaagaaagtaattacctctcctccacatgacgtttaatcatgctctatttttcgaagaacagctgtgcaacactggctgggctacaaattaaacatacctccttcaacttgcttagatttaaaagataatgaatatgttgggtgacagaatctgaattcaaaaagactttaataggccagagctataagctgaaaacaagatgaaagtaatcaaggataaatgtaaggtcctatacttgagtccaagaaaccaagtgagtaaatacagggtggggaagataggacttaatggcaacagactgaattaagcaccagagaatttagaagctatatttgataagaagctaaatatgagttggtggtttcatctaactaaaaaaaaaaatagaatgtggcacatggtacataagtaaaagcattcatcattgaagacctaacctagtttgatacaacataatatgaattcgagggacttacagctctttgcaaaaaaacgctatcactgttattttaatatttgttcaagcagagatcaaaggatctacgctgacataatcttccttttactagttgtactaaaactccaacagtttctgttattatagaatttgtaaaagcttagatactagctggcatcagaatattatgtatattaaaaattagcatatataccacacatgaataagtgaaacaagatgtagcttaatgaaattatgttgtggaactatccatttaacttatgtcacatttgttaaatctagattactttcataattctgacaaagattaacaactgaccattgtgtaatagagaaagaaaataggacctatgtaaaaatcacagagggtctaggaatatgatgtataaaatattttgaggcttcagtctaggaatatgatgtacgagacattttgaggcttcagttcaaagcataaagagtgaaacatgatacatttaccagaaaataaactaaacttctaaacacatgtaaaggagagaggtcattattatctttgtgaatattcattattacagaattggtaaatttcccaggttttcttggcttctctctctacaaataaatcactgtagtaaaaactctcacaggactgtcaggtgggttttctggaaatatttactgtaattgatttttgtggtttcctaaatgctgtaatccaaaacctcatttatcaactttctgtctgctttattgtaattgcagagttttctattcctatatcatgacaggtcagagcagcgctgtgacaagcagcctctgtattagtaaagatgtgcattccacacaccagcccagcaatccagattattgactgtaattaaactcacaggggagttaaacttgtttgacaagaaagggggtgggatgatttgcaggatttaagtcatagcaacagtgacacatgcctgccccaaaactttctctgaattttgcagggcctgtacacatttagaaaagatcaaataattttgttctgcaagagagtagtacatatttataaagcactgaatcccggaatcactggtcccattaattgaacaacacaagcatgcttcttgaagaaattcatataccaaattttgttattctaatatcagttcattacagtcagacttctggcctgggtccagaaacaatgccatttttaatgggttgattgctaaatctcttgctttctttagtttgactcattctttatcgtttcttcttctgattttgactcatttttcttttcacaattaggctttgtcccccttctgcatcacttctccagctttgaccatgttcttctaatttttgccaagaatgcggaatctaattttgatgacactgattttgctatgctggacatatcccctgaccattcagtggaggtccttaggaaccctacattctgggtgtctggatctcttcccacttcttccacctaccttcctgcctctttctcccatatttggccagtccacatgatcgtccaatgtatgtaagtgagactcaaacaaaagcatagaaaactttgttttcaaaaagtaaaaaccattcactcttttgaatattactgtttgaaatgtgtttaggtcctttgggggaatggctatatatgtttatatatatatatatctccacagtagtagcaaagaaaatcaataaagggtatattttatgactcccttttattacaggataagaccaagaaacattagaatcatttaaacctacaacacagagattgaaatacttgttttatgtaggcccagtctctattgtctgaatttttcattagctatagaaactttactggatattggatatggatatagataatcctctctggatatataaaacatctttttatttatctgacataatgtatttaaaaactagttcttctttcttcattctgtctacaaggaaaatccttttcactccccattagttttcttgcaagttcatgcttgtgataaaagaaaggcagaatcagagtctaaagatgggtcagtgaacacccatccctgcactaaagggctatgaagggcagtgcttgctgttattgggtaggcaatataaaaaatatgtaaggaataatattaattctgaatcctggcccattagagattggagcaatcattgctagcaaacatattttctgccttcaagtaatttatagctaattgacagagtgtagaatatcacaattaggtacatcagaaaaatgactttagtaacttggcaggaccaaaaccagccaggtgcaatataacacaagataataatgagtaggtcatgctcatcttcaaagcagaagtcacagctcctaggcgacaaatatcacaaaaaaacttattcatgtttttctgttttgttccttgtgatatttccatatggtatccctgaagataagttgtatctaattagagtgtagaaatactttcggttgctagttgttagcctaatctttactatagaagctgttgtttgtctttttctgaacttttacaatgacatttaatacttaagttaccagtggtatatggtgccctagctgagtgagggggggaaaattgtaatggcagattctaagttaggattttgattcataatgtttaaactttgacactttttaataatgaattctaaatttaaagttttgattgcttgttgaaaagcatagttcaaacttgcaaattccatttttcttaatgcataccaacatttagtaaaatacctgtaggaatttcaatgaagattttagttagacaaaagctgtaaataaatattgttaaaaagaaatgggtagtatagttgagataatatctaatccatattaatacttatttttgagtttgaggtgtacttgtttttattaatacttagagaaaaaataattgtttgttggctgaaatgtttcatcttcacctgttggaatgtgtgtttgtgtgtaggttctgtaaataactatgcagtgaccaataaactgatgaaggagatggtataaacaaataaatgtcaaatctacatcaggtataagactacatgctgaattcaggtagtgtcatttgactattttaattaatcaattaactatttatttcaagtcaaccaaggattttgcaattaaaaaatacaggtactcaagggaaaaaaatgaaaggtcactcattagtaacaaaatttaatgaaggagacaataaaataactctggaacacaaacaagataaacactattgcagtaaacagaaggaagttatgatcatttattaaagtatagtacaatgtcatcacagctacagttaatacatatttttgagcatctactttagacaaagcaatgttccaagctcctgaaagatgaaaatacatacaatctttagtctcatccttcaaagtaagaaaatttataggcaaacgtttctgaagcaagaatcaaatagcagtgcaagataataagaagcactacaaaaaggtacaaacaaatccccagtctaggatgactgagggaacccttacataaaggaaagagtttaaaaattggcatgagcctgatgaatggaaaaaagagggaagaagatttcagaacaatgtgagcaaaatttcagatgcagcaaaatagaatcttgagaagaataaataaagcaaattagctagtagagtcatggactttagctaaggctaaagtgggaccacagtgagggtaatatctatttttttcagactcctaaattaatatcttcaacctgagcttcccatggaactccagattcacatatacaactgtatacttatgttctccacttaaatgtctaatagatgtctcaaatgtaacagacctgaaactgggcttctcaaattctcttgccaagcctgttctccagtagtcttccccatctcagttggtaacaactccaccctcccagttgatcaggtcaaaaagtgtgaatcatctttgacatctctctttctgtcacaccccacaatgcccaccccaaaggaaatgaagtggacagactgctccatggacctgacgggctgttgttgggataaccaccatgctcgtaactttcatcctgcaccaagcctcacctggagtgaagggagtcatagctctactctgccctgggcaatagtgccttctcttcatgcctttctgggtctcagagtgactaaagaggccataaagactgcttactttactcatttaatcaattcatggatcaatcatctaaacatttctcaataaaaccgtttagtagcttcgcttcccattcaggggaaatgtcactacaataagctgcaaaactcgccagggtctggactcctccgtgttctcctacttaacacctggttcactccattcctgccaagcctttagctgttcccccaacatgccaggcttgctctggcccatggctttgccctggctcttccctctatctggcattcccatcctcaccaccaccacaccatgctccatattgtttccttaccatatatggcaattgacgcaaattcaatattaggaagccttgtctagccactttatataaaggtgtaattaaaccatctccatatcacctgcagcaacttctagcaccattcctgtatttattttccttgttagcacttttgccactgaatcactgcataattgattgattgattgatttttattgattgtcttcctttctacaatgtaggcaagggttttttcctgttcccagaatggctacatccacagcagttagaacattcacagtcccaagtagaactcaaaaaatggagttgaatgaatgttgcatttgaaaggaatgaatccatgttaagaatatagataaatatgaagtttattcatgagctctggatttatcctctagataaatttctccaaactgtttattctctgcccatcatatttgtttcttttaaaatatatctccttaattgttatattagatttcacattgagaatgttatatcacataattcctgtttacggctgaaactttaattgttggaagtgcttaagtggacctgttatatttttaagatgacatagagggttgtcccttagttgaaaataaaggatgcttgctgcaggggctggaaagcatagagataacaacttctcattctatgagcaactcccgtgggggctgtgaaatcttagggcagagaaccactgaggtggcaaatcctgctctcactgaggaagcctgttagatggatggtgcttagtttgccaatgtgctgcttcattaattctctaaccatcgtgagggtgtgagggagactgctgaatgttttgaaaggagttttaattggaccttcagtcgatacagttttctaaaactaaaatttaaaaaaaacgtccccagtggatagggtcagtgacacataatctggaacaagaaggaacgatttctttgagttagtgtgttttagggaaacataccctatgattaaaagcaattctaaacttaaaaggtgaagcaggaaaggaaagcagccatttttttctcttgaccttagggtcttcaaccagtttctcattcacctgctcttacagatgcatcaacaatcaaaggtacagagctcagtctgaacctagcaggtaggatgcgaaaccttctcagtcatatcgtcatggtttgtttaagctaaacaatccatccaattttactttctttgtaagtctgcctaaattcaaaataattgatgggccattaattcaaatatgcaattggaattactagattctcaatttgatacctaacgtaaactacaagtttgtcattgcattaactcatgtctctttcctcatatgctcaagctttttatggaactaaaaatgattttcagcctctaaattctcccttcatatatattgattatatatcctagaatacggaaaattcttaaaaatgaaaactgaggcatatcaatcaacaacaaaaaacgtatttctggctgggcatggtggctcatgcctgtaattccaacactttgagaggccaaggagggtggatcacctgaggtcaggagtgcaagaccagcctaaccaacaaagtgaaaccccatctctactacaaatacaaaacttagccaggcgtggtggcaggcacctgtagtcccagctactcaggaggctgagacaggagaattgcttgaacccgggaagtggaggttgcagtgagacgagatcgccccactccactccagcctgggcaacagagcaagactccatctcaaaaaaaattttaaaaatgtgtttcctcctcaaggaagtgtatgttatctcaattatatgacacatattttaacagaaggtttttgagtaaaattcttgcagacagtctttgtatgaactctagatattcacagaaactagtacgtgcctttagaatttttaaagaaaaaattataatgctttcctccctgttgctctgcattcttaaaatcccagcctcctttatgtctgaattaatcagtgaaatataccaaaaaaaggtagtaaatacagctgttaataccaatttcacatctgtcataaccaattcagtgaaaacaaatctgtaacccccaaataaattccaaagtgattaaagtcataattgcaaattaaaactgtaaaataattaaaaggaactatgtgtgaatattaatttaattatagcatatagaaaacttctcaaagcataagtctaaaggcatagaattttaatctcctgtatgtcaaatttcattataaatatctaggaaggctaaaacaattcaggcaaggggacgatggtaatatatgtatgagaggtgtcataatttttgtattgttgatattcttaatccataaaacatttttgcaaatcaatagagaagaggaatatttcaataaaaaaacacaaacaatttgttaaaaatcaaaagccttgaaaatatgcatatatttaatctaataattccactaaggaatctaacctgaagaactaatcaaagataatacaaagcttttgttaaaagcaaatgcaattgtacctatgaaaaaaagttcattgaaacactacttaggatatcaaaagactaaaacagcttaaatttccaacaatcagagattgtaagttatggcatattcatactttgcaaagcagaacagtaaccctgcataaaatatccaacaacatggataatgtacataatgtattgctaaacaaaaaaaatggattatgtaatactataatgcaagttataatctggatcttcagcaaactattcagatcagctttttctagttagtgagttaatgattttccaagttttccacaataagcaagtattgtatttacaattagaaaagatgatatcttgtaaaacttgtagtactttataaccagcaaatattcttctaatgttaaataaagaacataacctcaagctcactattttttttttttttagaccgagtctcgctctgtcgcccaggctggagtgcagtggtgcaatctcggctcattgcaacctctgcttcctgggttcaagcaattctctgcttcagcctcctgagtaactgagattacaggcacccgccaccacgccaggctaatattttgtatttttagtagcaacggggtttcactatcttggccaggttggtcttgaactcctgacctcaggtgatccacctgcctcggcctcccaaaatgctgggattacaggcatgagccaccacacccagcaagctcacattgttattttaagcactgattacaataagatgatcagccctacccattcactaaggctgacataatattgtatgtgtgtgtgtgtttgtgattttattacgtgtatatacaatcttttttatttcttattaatataattaggctttgttccccacccaaatctcatcttgaattgtaatccccataatccccatgtgttaagagagagaccaggtggaggtaattgaatcatgggggtggtttcccccatgctgttctgacagtgaatgagttctcatgaaatctgatggttttataaggggctcttcccccttcactcggcacttctcctcctggccgccttgtgaagaaggtgccttatttccacttcaccttctgctgtgatcgtaagtttcctgaggcctctccagtcatgctgaactgtgagtcaactaaacctctttcctatataaattgcccagtctcaggcagttatttctagcagtgtaaaaccaaactaatacacttatattttgcaaattgaaattgtctttgaaggcaattttactttgcaaaattctttaaattgtgaacttctctaaaagaaaatgtgggtcaagaattcttatatgtgtcaagcgtttgtggcatattagtgattgtatatacccctaatgaatcatttatataccctgaaaatattttctgccctcttagcatgtaggggtgcagttcaaaacttgagatatttgattaccatgaatcttggtgcctgaggagaataagctagaaagagctttcctctttactgtctatagcaggaaccacttatatggtatctctctctaattccataattcctttcatcaaaaagatccctaaagtccattatgaagctaattaggagactcacttattttcaaaacccagtccctcttgtttgcccacagctaatatgtggcagcgaaaatgcaatttgatagtttcttgtttcagaaaggagtgaaagaataacttctctaattaaaaccactatgattttgtgggattttttctttaagtgggaggacagtgtaattacacagattggaatgcagccaaaacagtaaagtaaagttaactgcctgcaagtgaaataccacgcaagacattgcctatattagtaaattgttgtgggtggagtggaggtacatgaggatacacaggacactctctattggcctgtgaattgaatctaccactaaaaataagctaaataattattattatgaaatgtgataatcatactcatttttcccctatagtagactgagaataaatagactatcttagtcagtgtccataatttatgtaggcaatgctgcagaggatattattttgtgctggatttggactaaaactggtgtaggcaggtggaccatctatttttgtcagttgattaattggaagttggttctgagtcagtcaacggcatgactgtcacaagggcaaattggagtgtaagtttataggacaggcagcaattagtgtttccagatgttttacatggaatcaagtgaaaatacatggaaaaattaaagtagaagtaattacagtaccgatgagatgctgttaccatatttagagccataactaaaatgctaggtaaagtggtataggggctttacagaaacaaacataaatatgagatcaccaagttgattgtaggctttgctgctctgtaccattaatgctagcatgatggtgacagcaaattgtcttgtgagcagcatactataggacaggaaaacaaagcaatttgggtgctaagattggcatcataactgaaggccctgagaacaaatcttcgtcagttgttttatggagtttcatactgaaagattttttgaagaagcagatcctaggtgtggtggagatggagagatttcttaagttttcagaagtctatatgaatctattattaatttcaccagtactttttcatctttcctccccacccactctgctgtttcttgaatgtaagatatcatcaagctattccagttttttatggacggaagtgtttaactggcaaaagctgaggaaacaggaaagctgaaggaatatattttgagtagcatttattcaaaatataattattaaacacctactatgtgcaaatcattttatataacatagaaattgacaatgaacactcaataaatattgacttcatccttcttgtttactagcaaggatacattttctcagatacaaagatggtagaatatataagaacaaagattatcaaaaaatgtaatacaaaattctaagacaggaattcataacctgtgttccagaggcttgtttgggatttgggcctatgaccttattttaaaatgggtcattttgtactcacaaatgtatattttgcgtggtatgggtctctatcttggaggtaagttcatcatattttttcaagactcggtcacctcaaaaattcaaagaacaattggtttaagaaaaggaatgaacatgcctaataagtagagagcatgatgattagtacagacatttgctaacaacggctttgaaaatgtttaaacataacatatttattacctagttttagaatggcacagaaaaatttcaaggcaagagtaatatccataggaagcacttaacttctctaaaacggaaactgggtcactgaaatactgggaaggaaagaaggaaggtaaaaataacagttaagattcagtcaaggggcttgaaacttctgagacttcagagtgaggatttccataaatccacttcttcatgaaaacactgaaaaaattttcaaattaactttttcagaactctgaaaattagccaaatacatgtaacaatttgaggagtgttttatttattaaaaaaactgctgaacttgagtaagaacaagaaagtttatggctttttaacttgaccttaaacccttgcccctctccccagttttgagtagccttaaaaaacaacagtcttggagcactggagggggcagtccaattttggaactcctcaaatagtagcatccccagagtagcaccactatttaatctgtcttgaagctctctggaaaagctgtattcacagggcattgtcactatttgacctgattcagaaaccaaaagccctatctgcagggcattgttgaaagcaattacaacagcaattgtttaacatcacagatgacacagtaccagttggggtgaacaagagcctgaacaaaaacataaaaggaagacctgccaatgagatatccatagaggtctttgtaaagccctgacatattgtgagggatttagaagccacatgtataagtagggctgtgtgcatgctgaagaaagaccaaagagtgccccagtccctcatctctgactgatgttgagcccctgtaccaggaggaagtgaaggcaaaggcagaatttaaaacttcctgagcattactgaagttccccaacacacacaaagcctcttggcaaagggttgacttactggttcacagtattctaaaaaatatctgagcaatcactagctgaccacttagctaatcagagacttcagttgttgcccaatagagtaagtacagactttacagaattagccctagaaaatctctaaacaacaaacagcaacaataacaaaaatcaacaacaaaccctggggaaaacatctgactttcagatttgccacattttatgatttgcaatgtccaatttttaagagaaaaattgtggtgcatacacaggggaaaagaaattgtcaatagaaaatctgttacctgaggggacccagattttagacttactagacagactttaattaagctattataaatgtgtttaaagaactaacaggaatccttttcaaagaattaaaggacagtatgacaataattcacccaataaagattatcagtaaagaaacagaaattaggtcagttgctgtgactcacgcctgtaatcccagcactctgggaggccaaggtgggtggatcacgaggtcagcagtttgagaccagcctggccaagatggtgaaaccccatctttactaaaaatacaaaaattagccaggcacggtggtgggtgcctgtaatcccagctacttgggaagctgaggtaggagaatcacttgaacctgggaggcagaggttgcaatgagctgagatcatgccactgcattccagcctgggcaacagagcaagactctgtcccccaccaaaaaaaaaaaaaaaaaaaggaaacagaaattattttaaaaacacaaacagatattctggagctttaaagcataataactaaaacagaatatttgagtttactcaacagcatatttgagttggcaaaagaaagatcaaaagaaagaaaggttagtgaactttaagacaggtcaactgagattacctagtcagaagaatagaaagaaaaatgtatgaagacaaatgaatacagtctcagggacctgtgggacaccatcaagcatatcaacatacacattatgtgagctccagaaatagaaaatggagtgaacagggcagaaaaaatatttgaagaaaatcatagccataaactccccaaatttgatgaaacacataagataaagtcaaggagacccacacctagtcagactgtcaaaagacaaaggaaaactgttgtaatcaacaagagagaaaaaagactcatcctgaaaaaaaatttaatgagattaatggctgatttctcatcagaaatcagggaggcaaaaatacagtggaactaacattcaatatgttgaaagaacaatactgtcaaccaagaattctatattcagcaaaactatctttcaaaaatgaaggagagattgagatattttcaggtaaacagaaactgagagaatttgttactagcaaatcttccctgcaagatttactaaagggagattttcaaactgaaatgaaaatacactagacagtagctcagattcacgtgatgaaatacagagcctccagaaagataagtatacagtagtcttagttcattcagaatgctataataaaaataccacaaactgggtggcttaaacaacaagtatttgtttctcacagttctggagtctgggaattccaagatcaaggtgccaacaggttcagcatctggtagggtcccacttactagtttatagacagctatcttcttgctgtgtccttacatgacagaatggggtcagagagttgtctagggttcttttaaataaaggcattaataccattaatgtgggctccactctcataacctaatcacctcccaaaagccccacaccctaattctatcacattgggggtatttcaatatataaatgttaagaagacacaaacatttagtccagtgtaataggtaaatagaaaaagtttaactgtaattttatgtaactcttttcttctttcatatgatttaaaagacagttgcagcaattgttaaactgtgttgatgggtttataatgtacaaagatgtaatttctatgaaaataataatacaaagagatggggagagagtagagctatactggagtaaagtctcagtatattattaacttagcgttaatatgaactagattattttaaattaagttgttaagtatagttccagagcaaccactaagaaaatagctaaaaaattatagtaaaagaaacaacaaaataattaaaacggtacactagaaaatatctactgaatacaaaagagagtagttttggaagcatatagaaacaaagacataaaaactgtagagaagagctactataatggcaaatgtaaatcccaccttaaactctctaataaaaaggcaaatgatgtcagaaaagattttaaaagtgattcaactctacactgtctacaagagacacattttagattcaaagaaataaataggttgaaagtagaaaagatgaaaaatacactatacaaacagtaaccaaaattaaaaactgtgagaattaaaggaaaaatataaataatttaaaaattatagttggagaattcagtatctcactatcaaaaatagatagaacacctaagcaaaaggtcaacaaggaactagaagacttgagcaacactacaccaaccagccttaaacatctataagatactccattcaatgacagcagaatacacatttttctcaggtagacacagactattttacaagatagacaatatgctaagtcattagacaagcctcagtaaacttaaaagaatttaaatcatacaaaatatgttctctgaccacaagaaaataaaatcggaaaccaataacagagggaaatttgtggaattcacaaatatgtgaaaattaaaaaacacacttctaaataaccaatgggtcaaaggataaataacaagtgaaattttaaaatactttgaaatgaatgaaaatgagaatgtaacatactaaaacttacaagatatagctaaaatagtgcttagagagaaatttacatctgtgaatgtctattattacaaaacaaagatcttaaaacaatagcctaatcttccaccttaagaacctagaaaaaggagagcaaactaaacctaaagcaagcaaaaagaaggaaattatttcaaaagttagagtaaatgtaaatgaaatggagaattaaaaaaacagagaaaaatcaaagaaaccaaacttggtttttttgaaaagatcaacaaaatgtataaactgaagctagactgaccaagaaatagagcatactcagattactgaaatcaggaatgaaaaaggagacagccctattgtccttataaaagcaaggataagaaaatacactattatagtatatattcttaaaagaaaatacactattatattcttataagaaaatacactattaacaaccccataccaacaaagtggataacttagatgaaaccgataaatttctagaaaaacacaaaataccgaaggtaactaaacaataatggaaactgaatagacctatagcaagtaaaacaattaaattagtaatttaagatattccagtaattaaaaatttccaggcccaatggctttatgatgaattctaccaaacatttatgggagaaataaaaccagttctacacactttacacacacacttctgaaaaatagaagctaagagaacactttctaaatcattccatgaagccagtaataccataataccaaaaccaaataaagatactacaagagtaagaagctacagaaggggagaaaatatgcacaaatcatatatctgagaaagaatctgtatcttgaatatgtaaaagacttaataactcagtaacaaaaagacaaccgtagacaatggattttgatagacatttttcgaaagaagatataaattattaataagcaaataaaaagatactcaaaagcatttgtcagtggagaaatgcaaatcaaaattacaatgagatacaactttatacccactggggacagctatgataaagaaaaatagacaattaaaagccctggtaataaagtagagaatttagaaccctcatacattgctggtgagaaggtaaaatagtatggccacttcagaaaatagtctggcattatctctattcaaaagaaataaaatcatatgacccacacaaaaattgtacagaatattcacagcatatttttcaaaatggtcaaaatcgggaccaatcaaagatgaatggagaggaccaggtgcgctggctcatgcctgtaatcccagcactttggaggcagagatgagtggatcaccttaggtcaggagttcaagaccagccttgccaacatggtgaaacccctgtctctactaaaaatacaaaaaaaaaaaaaaaattacctgggcatgggggcgcacacctgtaattccagctgctagggaagctgaagcaggagaacggcttgaacacaggaggtggagattgcagtgagcccagatcgtgccattgcactccagcctaggtgacagagaaaagctccatctcaaaaaaaaaaaaaaaaaaaaaagatgaatggagagacaaatatgatttggtatatataatggaatatcatttggcaataaaaaatgaattactgatgcatgctcaacatgtatcaaccttgaaaatacaatgtgtcaaggatgccaatcacaaaagtacttatgttatataattcaatttatatgaaataggcaaatttatacaaaccaaaaataaattaatggttgcctagatctgagaggctgaaagaaatgggggatgactggtaatgtaggtaaggtttctttttggggtgatgaaaatattctaaaattaggttgtagtggtggttgcacaacccaggtaatatcctaaaatccactttagtatgtcatttaaagtaattgtgcacttaaaatgaataaatttcatgtaatgtggattatatcttaaaacaactggttttaatttttttaagccaatgaagaaatgaagtgctagtttttatgtttattgcttccatgagaatattatcatctagaataacatgtaatgtattgagtatcaaactccagcatatcacctaataatcacttggccttaaacaagttacttgaatgttctcagatcctggaattttcacttaaaaatggaggaaataatacatcacaggggttttgagagaatgtattaagtaatggcacactttagatccctaatgaatattaatttccttcattccttccatcaggggccatacactcaagagaaaaataatagtcagggacaattcttaaattacgaatagggaattcaataaatacaacaaaccaaagattatatataaattttatgtttttgccaatggaggggaaagataactaaatgaggcaaggagaagaagaaaaggtggatagggaaactgcacgaaaagagagagagaagtcagatgaacaagcacaatgaaatagactcaaagaataacaacttatgtaattttaaaagacatattgggccaaattaaatggtatttggatcattctaattaaaattaaaaccaggctacatttgcttgttcagaaaaattcatctaaaggtggaattttgctagtggcccacagggctttatatctcaatttggtttggaatctgatgaggtgattaagtagaaaaccatagaaacataaatgtcaccaatagaactaagcaaatacgtaacctctactgcactatcaaattttttcttgcactaaaaatttaaagcttttttattgacttttcattgtattaattgtatgctaaagaaacttagaccaaaatatactttcatttgaatgagtttcaatcactggtcttagaaagaacattcaataatatttgataggattttaccgctgtgaatggattttttaaagaaggagacatactatatagaatagcagtataaaagaatataatcactgaaagactaatttgtagttttgaagacatagcataataaagttcttacaatataataacctagtacatcataggctgataccatactagacagtacatcgcaggctgaatactgttctttcatgagatttatctttgaaaataaaagtcatctagtttctacaattaattaatcgtgtatccttacagtttatattagctaaatattctcagaatacaatttttaagattcttgttttatctacatcgcaaagtttattcttcagtttttgcattttcagttgcattaatattatttgaatgtgggatagataggatatgttttaaattcttgctattaagcattgatattggggcttaataatggtttctctcaatgtcctactcagagcaatttaagtcacataatcccgaccagaagcgtatctccatggttgttttctatatccctagtacagcagtgataaagccatgaatgctgaatgtgccgtgttttttcagccaacaatgggcaaatgacatttctaaagctatgtatcagttcctacttctcatcattaatcccctgtcccttccaaacctcaactgttgctttaaaaaaaattaagaagacaacaataatctcttaatgacaccctgcagcagctttatggtggaaagggaaaggggtcatgtttactggcacatattttctttgagtgttttctccctttcgcagctcccatggaaaatttgctaacatatgtacttgcttttgttaatggcaatagtagatttaatgtgtttaattccctgctcccttttcttcctctaagtggaaaagacctctcaagcagtgtttatgtttcaccttcaaagttttagctggaaaaatgtttttccgtatttaatgaaagtttggtgactttctaaatttaagcaatttttaaactctgagtttaaaattcccccatctctaaaatagagatatacctaacaataatagccttttgtggaagattatctgagcaaaataaattagaaacatctaacaatatttcttattatttttataatcttcattctgagcccagattctctagcaaacagagaccaagataaaagcttattggccattattttattcaagagtataatttcagggaagtaggaggaaggaaaaagagagatggcatccaaaaagtgagaaatatatatatatatatatttatatttatatatatgggattgcaaagcctgacgcatcttggtaccaagcaaactgcagacatttttgacaatcttaagctaaagcctagatgaatcactgcatctcagggcaatccatttggggaaataaacagaaggattgatctgctagttcccatctccttaagttcaaagattcacctcgagggacattaacttccccacacttccaggtggcaagtgcctggattctgagatccctggaatctgacatctcaataccaacagggaggccctggaacaggagggaagaatttcaaagcacaggctgtggagacagaatttctgtcagaattgtccatctcgacttctcagagcccatgctggtcacaccgcagtaacagggccctccaagacaggtgaggctgaaagaatggggcaggcacagagaattatctgattcactctcctttaaaacaaaaggcaatatattcatttgtcaagtgacaggaagtcttttgaatcaatgtattcttgttctgtttgggagttaaaggcagtataaagaagcttgattataatcacttacaaaaacctatgaaaaccagattttttaagatgttgcaactaagtacaacttctggcttttattataagtctttttagaattgtatttttaattgacaaataattgtacatatttatggggtacagcgttatggtttgatacacatatacattgtagaatagtcaaatcaggctatttaatgcattcatcactgcacacacttatcatttctttgtggtgagaacattaaaattcactcttttagcaattttaaaatatacaatacaatattattaacaataatcaccacactgtgcaatagatcagcagatcttattcctcctgcctaactgaagcttcgtgttctttgaccaacatctcccctttccttgtccactccaaccatatcccacagcacctgggaaccactactctgctctacttctgagtttgacttctttttgattccacatgtaagtgtgatcacatagtaattgtttatctgtacctggcttacttcactaaaaataaagtcctccatatctatccatgttgtcacaaatggcagaactttcttcttttttaagaccaaatagtattccattgcatatatataccatgttttaaaaaatctatttgtctattgatggatgcactctgttcccctttcttggctatcatgactaatgctgcagggaacatgggaattttacagcgttggcttttttatcaacataaatgacttaatgttgatgataaaaaacaatgctgtaaaatatttgaagaggttgattctaagccaaatatgagaaccagggcttatgatacagcctcgggacatcttgagaacatgtgcccaaggtgattgggttacaccttaattttaaacatgttaggggcacagaagctacaggcaaagacataaatcaacatatgcaaaacatgcattgttttggcctagaaaagtgggacatctcaaagcaagagcttccaggtcataggtggattcaaagattttccgagtggcaattagttcaaagagttaaggtttgctggtaaatatctcttattagatcttaaaaggtgtcagactctctggaaaagacctaataagggaaagagatgctctatagaatgtaaatttcccctacaagagatggctttgcaaaatcacttcaaaatacgtcaaagaaatctattttggggtaaaatactttgatttccttcagagtctgctgtcatgtgatgctatgccaaagtcagggtagaattgggcatcttatttccacacagagtctgtttttcagtcttatgatctctattttaatattaatgctagtcagttgtccctaaacacaaaagataggagagtataataaggcatgtaagacttcccttccagtcatggcctgaactagattttaagttttctttgggatcctcttggccaagggggaggaggtccattcagttggttgggggccagggagctagaattttatttttgatttacaatgctgatttcaattcctttgaatatgtacctagtagtgggattgctggattattataaatttttatgtgtattacaattttgttaattaggtcactgtcttagttagtttgaactgccataacaaaataccatagactgggtggcttaaacaacagaaatgtgttttctcatagttctggaggatggaaaagctaagatcgaggttctggctgatttgattgctagccagagctctcatcctagctggtagtcagccaccttctctctgaattctcacatggcagagatagagacttctctctctcttccttttcttataaggccaccaattttatcaaattaggaaccctccactttataacccttttgactttaattatctccttaaagtcctgtctccaaatgccgttacattgggggttagggcttcaacatatgaatttgagaggaacacaatttagtccacagcatttgcatatcacagaaaacaaatccatagaaatgttaatacaataaagaatttgagtggtttaaaacctttttatttttgtgaatgctacaattaaaatatttctgcgtgcaaaaaattgtgagtttttcttgtatagagtaaaattttctgatcttaaaagcaagacctatgacaagtagaaaatattaatgaacgctgaaagcattatatccttgtcattttcagataagaaaactgtagttagtgatgcttttcaaaattgttacatttgtgaaccagcaaatgtatgcacacaggattatctgagcctaaacatagtgtcataaccttaaattgaataagttagattaaattatttttaccagaaaatttatggctgatttccatacaataatccatttagtcaattcaacaatttacagggctgaaaatatttattgtaacttgaaattcattttatttcaagcaattaaatcacccagaatcctccagatacaaagtgtgttaaatgtaacctttaaaatgaatgaatgagctgaagacaataagggaagtccagggagcagaggaaaaggcaagagcagggtaccaaggagaagtataacgttgatgcttcctcacaacttgagggcaactacggattcagacacctggagtttgatgccagcacaaagcaggaaatcggactggagatcaagtcatacacagctgggacccagaaaggtatacacttggccttggagaggaaggaggttaggagagagtgacttacaagaaaacatgacctgcagtgataaagagtatagaaggatagatgcagccgggcatgttggctcacacctgtaatcccagcactttgggaggccaaggtgggcagatctgaggtcaggagatcgagaccatcctggctaacatggtgaaaccccatctctactaaaaatacaaaaagtagtcagccatggtggcatgtgcctgttgtcccagctactcaggaggctgaggcaggtgaatcccttgaacctgggaggtggaggttgcagtgagcagagatcgcactactgcactccagcctgggtgacagagcaagactccatctcaaaaaaaaaaaaaaaaaaaaaagaagaagaagaaggacagatgctagatagatagatagatgatagatagattaaaaaagagatatagagataaaggtatatttctcagccttggttctgggtggaggtttaaaaataatatttccttgagattttgtaaatgtaaactaagtcatatttagggttatggagccagaaatcacactaacagtagagttcacaaagctgcagagaatattttgtttgtgatgaatctagatctttctagcacccaaagagatatatcccccactcaagtcatccagaactcacaaatatgaactcaagctcaaagacacacaaaaaaataaggaaacaagcctcaaagtgctggagtctacagaaacaacaaggaacataaccagttgcatgagatttcagatatttgccttatcagatgcataattaaaataagaataaatgaatagatgttgtatttaaataaagaagaaataaagaggctaccaaaactgatcactcatatttgaaaaagaacaaaaaataacttctacttctgagaaattttaatgaataatattaaatggagcagttaaccagtagaatacaactgacaaaaagattatgaaataaatataaacaaatatgcatatacatatacatatatctgataacctgaagtatatttattgatatatatattaccttatatgtatgcatgtgtgtatcatgttgaactatatgaaattgccatgttgtatggcaaaaacagtcacatataggcaatttcatatggttaagcctatatatgcatattggattgaagatgcactgtataatataggttttccatataaaggtgaaaaaatattcttttgctctaagaattctcagagttctgtcccacagcagatagcctacatgagagtaatttttttatcagaattgtggaattcacacacaggtcatatgcttagttctgctcatgataatgatgctcaatagttaattggctttgtcaggcactcgtctatatcttcccaccttcctctccaacagtcaagtttctagacccaaggctcttgtttctccaaaactgcttgcagaaatagctatgccttctttgccatttattttaggtcaccacttattagtgacatctgatattagattcttgtgagatgaagattggagactggcttaagtatctgtcaggaagcttctctattttcagattatattgcatacaaaaaccttgcaagccaaatctgtttcagaattaaaataacatgagcaacctcaagaaaaattattccatgtgtgcacacgtatcaagaaaaacactgcttccatcatgccaccccacttcattgcttgcagggatcattgaaattcatttactcagtgatcagaatctcctgaaccctgcctccagacctcatttccaaacatacaccctaacctccaaaacaaatttggtctttagccttgtccaataaaaatagttattgttaaaagtccaaactctttaacatgctattttttaaaagcccggggttggggaggggggtgggtaagggatctccttactccacagaacttctaatttcccagacaatcagttgttcaagaacacaatgccattcctcatgctttctttgcctataagctgttctcacccacttggtgaaatctacttcccccttcataggtcaacccctcagtgaagtcctccttgatgtcttcagcagcatttaatggtttttcctctatgtccccttagtactttcttcatatctctacttgtctctcccactagactgtaaattcacttttgtcaggaccatgccatctgagtaccccagtgtctaaaacataacctggtactatatatttctgctgaataaatgaattaaaaaacaaatgagtgcaagttatttaaatcagaggaatcatgatagaaacattaatattttaatatgtaacagaccacaagaatgttaaaagagtggtcttcaaactcaaaagtgtatcttcccaatgacaccagccttagaagaacagtttctgtgttactattgtcatgctggaattcaaagggtttttcttggttcttatagagactagagcagtacatctccaaggctaattattcttctgatctcatggtttgatttatgtgaattgtgacaccctataaggaaagtaaaaagagatccacctagttataaacaatgctcattatagaacaacctccagccgagccaatgcagaaggcctcagggaatactaaaaaaaagatagtggattttttttccttgcaagcacaaaatattttttaaccataaaaagcaatgtgcaggtttgtcatcctggtgaaaggatgattaatttccatcgtgttagaatataacatacggattaccctagaaagttttaaattttaccaaaaaaaaatcaaggaaaaaatgtaaattgcagaatgattattgcatataaattttatatacttcttttagataatatagaagagatagccactcacccaccctgagttttactgtacaattctgtttttttaattgaaactgcactgaagcttttttcttcccgtgttttaaactgtgctgaaattataagatttgaaaagcctttgttaatagctagagagtcctgccattaccgaatgccaagagaataatgaaacacctaaaatgataaggcactagtgtctgagcagaatagacctttaattggaaaaagttcatgcattaatattcaacattaagtggtgattaatagatacaccatgtgggtattttttattttaggaggatagataacagcatgtccaattttaatgtaaatctagtgacaatttcagtgtgttattctaaaatgctctatctgattagtttcagaggcgtaaaaagaaaatcttttctagtgagcacatcctccgtaagtgttaacagcaaagctccttaaaataattttgttctctgaaattgttgccatagctagctggaagagtttcatgtttaataaccacatgtgatatctggttttttttaaatgaaatccgcataaagtgttcattttttctccattctagaaaaaaaaaatctactcttattgacctctttccttactctcactgactgatcaaggaaaaaggttttattttctctgtctttttatctattttgatggtatttttttttccaacgtgattgtgccagtgcactccagactggatgacagagcaagaccctgtctcgaaaataaataaagaatttttttttttttttttgagacagagtctcactctgtcacccaggctggagtgcagtggcgcgatctcggctcactgcaagctctgcctcccaggttcacgccattctcctgcctcagcctcccgagtagctgggactacaggcgcccgccaccatgcctggctaattttgtttttgtatttttagtagagacggggtttcactgtgttagccaggatggtctcgatctccttacctcatgatccgcccgtctcaggctcccaaaatgctgggattacaggcgagagacaccacacctggcctctccagggaatctttaaatagccaggtaataagaattctcagagtgaatagtacactgaatgtgaaagtgaagaatgacatccaggataacttttctctctttgtattcagggggctcagtctattaataaagagattttgtctaaccatgttccccacatattgctgtcaatagagtaaattgctgttatccatttaatgtgataagctcattatttctcacagcttcatctatcacccaatcccatcctttcaccttaaatctagacttctaatgccaaacaccttctggatagaatttgtgtttaactccacatctgaggttaaattttaatctacccaacgaatgtaggtttccttccaacattgcctgtttcttattaacacaatcagttagttaccctggctcaagaaattgagaagaaaattggacttatttgatccttcacttcatgtttctagagtctccaaatgaaagtttccttaaaaaactttttcaagccttgttttaatctagatcccacaccaaagcagaacaagagaccaagtcttatataaagttagtttatttgagaatataattatagagaacatacatgagaggcagcagttttgaccagggaaggagaaaaaaaaattcaaatcatgctattgatgagcttccccaagagcaagtgttgctcaatctcacaggattttctggggagccttatgaaataagtttgagaactaatagcttagggacaacaggggaaagcatttatccattggtccccatccccattacttaaggttggaatttaagtaatgcacttctgcttgtgcatgaatgaaggccaaatgtggtcccatggtgtattagtctgttttcatgctgctgataaagacataccagagactggataatttataaggaaaaagaaatttaataaactcacaattctgtgtggccggggaggcttcacaatcatggaggaaggtgaaaggcacatctcaaatggcggcagagaagagaagacagcttgtgcagggaaagtcccctttataaaaccatcagatctcatgaggcttattcactatcacgagaatagcatgggaaagacctgccacctcccagtgggtccctcccacaacacgcgggaattatgggagctacaattcaagataagatttgggtggagacacagccaaaccatatcacatgggtatcccacaccatggtaccagagaagtctcgtggcagaaaataagaattatatggtctaggcccaaagtgagataccataaggctggactggggcaaagctaattgaaacatttattggaacttattagcacagcagtggctgggtaagagatggtctgagaggataagaaatggccaatataccctgtcttagtctgctcaggctactataacaaaatgccatagactgagtgatttaaacaacagcaatttatttctcacaagcatgaagtctgggaagtccaaggtcaaggtgccagaccattcagttcctggtaagggtccttttgctggttttcagacagctgtcttcttgctatatactcacatggtgggataaaatgagagtaagctatccagtctcttcttatgaggacactaattccatcaacgaaaaccctacccttatgaccttatctaaagtaccttctaaaggccccagttccaataccattacattgggggctagagttcaacaaggaactgtgggaggatgtaaacattcagtctataacacagcccatcccttgcaccattcagatccaaaatgccttttataaagtgcaagcaatcatagagttccccttcaagttcatttaagtcacaatctctgaaaaggtttagtaccagttattattggaacaaattccagtcttcactattgcagccaatttcaaggtcataattcatatttataatctcccttctttactgtttattctattcatttccctcaccatttgtaacactttggctggcctagggttctttgctagttggacccagacttttacacttgagagatcccagctcttagttgagctgcatttgttatatttgtccactcacattttccctagacctggaaacacagatattcacccctcatgaacactgcgattccacacacactccttcatgtccccattgcatctcaccaatcctagcacttcgtagaaattagggtcagtccctctcttagaatagtcattactcaccttggctaccgcaatggcatgggcagcctaaagtgaccaagtggtagctgtagtttcaacttaaagtgagacagagtaaaggttccactttgtcttctggtcaaaacaatctctttctagaaattaacaccatgaatcctgcaaaacctgtttgtggggatggggagcacagatttcacaagtgggtcactgggaatgatagtgagatgagccaattctacttttgccccttggttctgggaccaatgtattttagctactccagacagcaccatataacagccatcgactgagtgcatgtatcacatccaagagaacagcaacccaacccataaggtattatacccaagtttttgtcttcactggggcctctagtaaccattcaattattctggttctaaatgatgagatatagacagacaagtgggctgtgtgtttatatgcccattcttcagtcttctgtatcataaaactagtctcctagactgagaaaatttagtgtaagaaaccatacaaatatatgtatcagatgtcttataagccctaggacaataatgatattagcagtgaccccagaggaagaaaaggcaaatccgtatgagaaggtgtcaattcatgagaggattaatttctgctcctccagggaaactgagtctaatataatcaacctgccaccaactggctatagccatattcttgaagaatggtgttacaatgagggcttagcatcattttgtgtgctggctagttggcagtagttagataagctttaaagaaggggagcccaggccaggcatggtggctcatccctataatcccagcactttgggaggccaagatgggtggatgatttgagatgaagagttcgagaccagactgaccaatatggtgaaactccatctctactaaaaatacaaaaattagccgggcatagtggcgcacacctgtaatcccagctacttgggaggctgaggtgggagaattgcttgaacctcggaggcggaggtttccatgtgctaagatggagccactgcactccagcttgggtgacagagtgagaccctgtctcaaaaaaaaaaaaaaaaaaaaaagaagaaaaaagaaggggagccctgctgtagaacctgcatagatatctccctattattgtagtcactctgttcatggccccatcctgctagcactggggttgttaaaggaagaggcttgctgacatccacaggacaaatcttatgtatctggttaatgagtgcctcttgtgaggtagatgctccctgatgggcattaaaatgagacacaaatgaacactttgtggtcactttcatagatccaattgcatgtatctttctatgattttgttgtttatttctaattgtctttctttggagtcttaaccaactagccaaaccattaactgcccagaagcccaaaactcagatcatgttttcttgcatgcagagcgaactccctattgttatctttgaagttctgccttccacatgttttcttggagccatccttggatgaacctatagtgtaatgattaaccagtaaaactaacatgaaaaaaaaaatcacaccaacatgtctatgaatcaggctcaaatttctgattcctttgtcatttagtcacagggaagcaaatgatgccatagctatgagtggtgggtaagagactggtacctcacagataccttaggagttttcccacctgtttgtataatttactacatcttctggaacttctcaggcccaatattgaatagcacattcataatggatcattgctcttcctgctcaactttatgacatagtagattcgataatatccagctcagtcccatagtcaatttgtgttccaagattgtgcatgcagcctctaccagaattcagtatcatgtcaggtcaggaattatttttcaaatgttccataattctctgttatagaatgaatggccttgctctagtacactaggattttttttttttttttctgagagtcttctgtttaagtttgtcttctgcaacatacaggcaacttgccaggacatctaaaatcctacccagttcttcctaatcatgtcaaattaccatttatgtcactgtcttagtcagctttctgttgctatgactgaatacctgggactgggttatatatgaagaaaagaaatctatttcttacaattttagaagctaggaagtccaatatcaagagatcccatcttgtgaaggccttcttgcaggtgaagggggactctgcagagcccagaggctatgcagggcatcacatggcaaggaggcttaagaaagagggcctatctggctttttataacagatccgctcttgtgacaaccaaccaactcctgtgataacccaatgatctattaattcattaatatattaagccatgaatggactaatacattcatgaggccagagccctgatgacccaatcatctcttaaaagccccacctcccaatactgttacattggagattatgtttcaatatgagtttcagagggcacaaacactcaaaccacagccaacatagtgagccaacaggatgtgtttcagaatattaaaatgatgaaagtcccaaagactgtttagtgacagaaagcaggagatttaacatagctctgagataaagcaataaatgtatattattcttcatctgtgtaagagtaatctgctttatttctcttactgagagggactgagggatcacatccaccaaaccagtagtgccaagcagcggcataccaagtgccagaggctgagttgatccattcttgaaaagatactaccttcaacttgtaatttgtataatcatttagttactttttagagttcattgtcatatgccccgatctattggttttattcataggctgaacaagaattaattagtgttatgaggggactaataacttatgcaagtcttaagtatttaatagctgtgttaacctctgaaattccttttgccatgcagtacgatttctgattaccatctttgctgaaatgggacaaggtggggatgcagattaaggagattttacttggcctttccaaatataatggctgctgcttcataatcaggtagtcagtgtaaggttcttccgtctatagagtatatttatccaaattatatatttaggtacctagggaattaactacagggcttgtctagtttctgtaagatttatttgagatagacttcaacccaaactctacttatcaactgaagacaacacaggaatgaaagaaatcccacctaacagaacagatgagaactctagtaacactactatttaaaaaggcggcaaagaaaaacactcagcaaaagggacagaggaagagagatcagaacagagaatgaatgagagtaatatgcaacaaacctaggaaagaaaatattttaaagagaaagaagtgctcaccaatgtgaaataccactgagtatcacaatgggataaagaatgaaatgaggcaaatagttgtggaaaacaggaagacattattttcctttgctagagcagttgaagcagaagagcaggagcagatgtaggatcacggcagggtgagaagtgtctggaaactgaggaaatgtaggcaatcgagtttaaatatttcagtaatttggcccttggaaagaggaagggtgaggggatgatggcttgaagaggaggaagaaacaaagcaaggtttttgtggttgttcctgctgctgttgtttaggattgggatggtattaatatgtcttaatcagatcacaaacataagtcaaaatataagagagttcacagagattcttctttatcccaaaagtctccattcttctaattagaagaatgttaatgataaaaaaaaaatcttcctatagtctctttcttgtattagaatcattggtctcttatattggctgttttcatgtcctatatcttaattttattttcttattgctggtggcttaatgtagtaaattttgcaaaactattaaattctagactacagcatgagagaagaaaggaatagtcacaattacctggcctaaattgaagctgttcaaatttgaattattattgcttttgaggagacagcagcctatttcagtttattgttccttaatatatgacagcactggacaattaaagatcacacacacacacacacacacacacacacactgatgatggaaactcttgtattgcaaaatgggatattctggtgtgccagaaaagattgattaagcaatgaacctcagacaaagtgtatggttgtttccaaataatcaggcctttgggattattaaggttataaatgaaagtaggtgtctaatttctgatgaatgcatttaccactgtgaacacagatcaccagtgtgcacaagcatacatctgtgtgtgtagtacactgtttttagaagatcccatattctatagaagttaatttcctttattgctttttattcatagagtgactctgaatgtgttctcatagaaataaatctgaatatatgtgatgtgtgttgtgaagatgtgtgtgaattcatacagaaatacgtaggttcaggtataaatgaacatatttgggcatatatatttgtgtttgcatgtgaaaattaaggtttagtgacaagtgctgaactcaattgtgttgcacttgtgtctttaaatataataaaacattttcttttaaatgttggaaaataattattaggcatgtatcattaactgataaaaacataaatttcttaagaaatgctatagccttaaaagttactaaattacaaaaaaaattaaattggagttattgaaaaaaaattgctctaactcagccctcttttatagtaaagtattaactataaaacatgtgaatccaaaatattattcttaaattgatgtgatattaatgtatgtttaggaaaaatcaaaagggaattcttcattgaacaaggaatctagtaacagcacttcatagagccacatcaggcacctacaggctcattctctattaagtttttcatctaacataggctcgctcttcaacactgtatggacttttatgattctatagaggaagaaaataaaatggaagtcaaggaagcatttttattaggccatttactcctcttaatatagtctttccctttgagcatttacaataaaaatggacttaatcttttgccttcccatgggaagtctaacaaaaaatggaattgtagaaagaccacatatatcaaagtatttttagaaactgctctttcaggaagtggctaagttctatggctgatataattaagtcaatctcagggagcttcaccattttttgacacccagaagcttagctttagcatgagttggaattttttttcttttcttataatgcgccactaaattctaagaccattagataattgtcctcaatagaaagttcctgtaatacattgaaatcatataatattttagccactggcatatcataaaaatttataacccaaagactacatttatttctaattatatttgctttccttagccaccaagatctaagtaacagataatatttatatttctaacaactgtgttttatttatgcaagcgaagaacagaaataagctttcattaagaaacaactatgtgcctgccactgtgaaatatgctttcacatatatttctgactccttgcaataaccctaaaagattaatatcattaactcattttatagacaatacaaccgagaagttagattcagatccagatctttctgattgaaaagcccctactttggactgacagagagaatgaagacttacttcagtttgattgtcttgaatgggcttcagttattcactgttctccaagccagccacacttgcctgaaattggatttcacaggttcattttacctccaactgagaatatggacatccacaaccctcagtgctggcccgtggaagtctcaatgacccacaaggcatagggtttgtggctttggtcctggttcatgtatccatcaaccaaccattattgagcacctagtattttaggggctaggaagaaaacagaaaaagtttcagcctttgtggatcttacattctatcagttctatgtgtttaggtgtagggagatatagataaatgcataaataagtctctgaatactctttgaccaacatcaccaaaaccatacctgcttaaggacttaaatctttttaaggtaggccttatggaagttggggatatgcattattatagcaatggattaccatctgccttgacccatctacaaaccaccccagtttgtagttaccctgaataatttaagagtcaaaggaataaaccccaagtcaaaaccagtgtccccaaaacaggggcatgaggcgaggcaagggttaattgttgctcccaacacagtgctgctcccatctttaatgtgaagataaatatgagagcgaaaaggagaaatctaaagtggtcgtgatgggtctgatttaagtgaatgggagccacttcaaatgctaacaacatcattaggagcacataaataggctgctcattgtgtcggtaaaagcggttgttcacagcagcacaatattgtttgaatgttcgaaacaatctcttaatataactccccaccaatttttgttttggtttagtgtttttaaatcatagttctttggcaccctgaagaaagtcttgttcccatgtgcatttttactttctctcgttatgttttgtctttgaccttctgagcgcagtggagaaaacagacgtgttccaattccagggctactatttatatgctagctatagctatactttttccaaaaaaaaaaaaaacaactctccgaatcttggcttttaggaagttcatttttactatatgaacaataacgcctaccacagagtgttttgagaatcaaatgaaacttaacttgcctaaatgcctaagtaggcatctggtaaatttagctaaatccctggaatatctgttcggtttcaacaccatatgaatgtaatattttacagaaactctttttttttttattttgcgcctgattcaagtagatcttcaatgaatatttatgaattaaatattttcaacataatgcacataatgaaagtaactatgtacaacttgatggttgtcatatttggggcatatcaaatcattgtaccatgagtgtattaattcaggatcaaaacccagttttcttagtactttttctctttagagtgcggctcaacactagaagagctctttaaacatcagagctgctccacaatggaatgaattggatagttaggggtaaactccacatttctgcacatattaacaaaaaggctgaatgaacacctatcaagaaggtggtcggacaggatttccaaattagttgaaattggccccaaatgacttccaagttgtcccctctcaatgatctcataatactaaatacatagtgtttcatttagatgcaagtaagaaaaaagaagctttgatttcctattgcatatttcacaggggtactttgagcactactccattccaaattccctttatagaaaataataatccctcacaataaaattccctgccaaggcactattctgagctttttacatatattaacatatgtagttctcacaaaaaccctaagaggtatgtactggtggtattgctctgtcacacataaagaaagtgaggcacagaaaagctaaattacttgccccaggtaaagtaaaaaagtaattgttggagctaggagttgaatccaggcagtccagctctgaagcccactagcatgcagtaccaagggcctcacataataaaatctggcttctcatagatccagactttgtcccactaatctagaagcactttgaaggcaggggccatttctgttttcatttactactgcacctacagtacctgacatataatcgttaattaatgaataattttgtttcatgtataaagattatcacttatttttcatatcttgtgtcatagaaaaacatattgcttagctttcataccaaggtattatttactatttagaggtaagaagtgtttcagaaatatttgtactgcattcagaatcaaaagacctttggcccggcacagtggctctcacctgtaatcccagcactttgggaggctgagacaggtggatcacttgaggtcaggggttcgagaccaacctggccaacatggtgaaacctcatctctactaaaaatacaaaaattagacgggcgtgttggcgcatacctgtaatcccagttactcaggaggctgaggcaggagaatcgcttgaacccaggaggtggaggttgcagtgagcccagattgcactagtgcactccagcctgggtgacagagcaagactcttgtctcaaaaaaaaaaaaaaaaaaagagccaggttcgagggttcaagcgattctcctgcctcagcctcctgagtagctgggattacagacatgcgccaccacgcccagctagttttgtatttttagtagagacagggtttcaccatgttggccatggctattcttgaactcctgacctcaggtgatccacccgccttggcctcccaacgtgctgagattacaggtgtgagccactgtgccaatgtgccccattttcttaggctaaagcctgaagtcctaaacaagacctacaaaaccctgtgtgatgaaacccccagcagcctcacctgctgcaccttgtaccgctgtgcctattgttccctgcctttagtcaatctcaccgtcatttcttcttcatgcctgtgtcattcccatgtcagtggctctgcatgccattccgttggcctagaacatgctctcctttccccactgccatccttacctagttcattcctactccacaaaagctactctctgacaaagacacagtctccaactcctccaactgaggcaccttgcatcatgacaggctttcatcatattctatacatttccattgtgcaaagtaccaatattttaattagcttattcagtttcttattcatttgttcaacagattcttgtaaatgagcacctattttacactgggtacttttctagtcacaaaatatagccatgaacaaaatataccaaaactcctaccttcatgtatcttccattctagtgagtaacactaagtatcctcactaaaatataagttacatatagtctgtgactatttctgtcttattcactgatgcatcccctagcacctagcacgaattgttgcttatggtatatttcagcaaaaatagcttgggtaatgatagggaaacaaagaatcttaacattttagtggcttaaagcaatgaagtgttttcgcttttttgttttgtaagtcattctatatgcccatcaggttgactgggaatgcttcctatatgcccatcaggttgactgggaatgcttcctatcttgccacagtcattcagaaacatgggccagtggtacagacattatctcaaatattgccagtcatgacagaagagagagaaaactattcagagatttaaccagtagttaaatgactccccagggttttagccagaagttaaatactccagcttagacatgtgcaagacacttccacttacgaatcactgctaaaaactagtcatctccccatatgcaactataagtgactgcaaggaaaagccatattttaattgacagctgtactactggctatctcagatggaaaacaagaaatatttgaggaaaagaagactgaataacaatgaacagtagttgtgatatagataaaagccctacctctttgtctaaaatatacctgttcataggatgtgcatagcatggatagattaggctaatgataacataagtttgcattctttcagcttacaaagtctactgatagtttgattaaacacaaccaagaatgacaaatttgctatccacaacatatggagtagacatcctacagacaaataactgagaattcacagtatattaaaaattgtttattcatatgaactacaccatatttcataggtcaatttcattagactggctcacatggctggtctggcttagacacagtctacagagttgattaaaaagtaagattgattgcacatcttgttcttcttgctgactataattttgtattttgcctgaacattcaattttctatgtttaattaaaaattaattaaaatttgttagagtataaattgcatctcatcatttcattgaatcctaactataggtcatgcctcttaaacgcagaaatggtctaacattttatttcaatatgaagtagaagaattgtcaggattattttggtgcccagatggggatttggtattcgtttaactaaattctgctttaatgtagggcatgaaaggaggctttgggacttaatttagaaggtttagcaagagtgataagaaaacccaataggaagccgggcacagtggctcatgcctgtaatcccagcactttgggaggctgaggcaggcggatcatgaggccaggagatcgagaccatcttggtcaacatggtgaaacctcatctctattaaaaatacaaaaattagctgggcatggtggtgtgtgcctgtagtcccagctactggggaggttgaggcaggagaatcccttgaacctgggaggcagagattgcagtgagcagagatcatgccactgtactccaggctggagacagagcaagactccatttcaagaaaaaaaaaaaagaaaacccaataggaattcctcctcaaggtataagatttttgtaaaatctgtttgcttctgcctagtggaatcctcaactacaaaattctgatgattataagaccttctgaaggaacaatccacaatactatgtcttagatcagtgcttcccatctggggtccatggacatacactcaggagcctaagaattctctatgtaaattgttaaacgttatgtttctatttgataacaatatatattgttcaaattttataaattctacataatcagggtgacaaatgacaaatgttgtcatttgcctttatgtttgttatttcactgacaccaagcagtactataatgctttagttattctaactatttaatatagtagagaataataagagaatagtggactcaaaccaagtatcatataaatgataagctaagtaaaggatagttttaaaataagaagattaacgtcaacataactacataaaactaaaaagaacctgtactgtcacagtcagtacaaaaatacacccaccaaatgcactgtagagtcagcaaagatcatctgccatgttaaggcaatgctgacaatttaaatcttgagctttttagttttatttgattggtaaattgtgttatattccatatgtaccataaacatttgatttcttattcatctgagagtttatatctgatttgacttcactaagaataaaattcaaaccccttactatgatatataagtccctgaatggcgtggtctcttcctatctggcttgttgccaccttgccacactaccctttgacatcacactccagcttcatcggcatttctggcagttctttttctactggtgtgtcttctgcctggacaactcttcagactctcaataaaaatacttcttggccaggtgcgatggctcacacctgtaattccaacactttgggaggccgaggcggatggatcacctgaggtcaggagttcgagaccagcctggccaacatggtgaaactccgtctctagtaaaaatacaaaaattagccgggcgtggtggcacacacctgtagtcccagatactctggaggctgagtcaggagaatggcgtgaacccggcaggcggaggttgcagtgagccaagatggcgccactgcactccagcctgggtgagagagcgagactccgtctcaaaaacatacaaacaaaaaatacttctcatttctccaatttcagcttaattatcccctgtttggtgtggccctacttggcttccctatttaaagggaagtccatttactgccctacaatcacttcttaccagtgtcccttgttcatttccttcatggtacttagctcaatttataattttttattttgtttacctgattattgcttgactccccacctaatcaccgaacatagaatagacacacacacacacaccagaatgtgagtttcatgagtacagagatcccatggtcttattatttattttataccaattccttaaaagagtgtttagggccaggcactgtggctcacacctgtaattccagcactttgggaggccaaggcgggcagatcagaggtcaggagatcgagaccatcctggctaacacggtgaaaccccgtctctactaaaaatacaaaaaaatagccgggcgtggtggcgggtgcctgtagtcccagctactcaggaggctgaggcaggagaatgcctgggagatggagcttgcagtgagccgagatctcgccactgcactctagcctgggcaacaaagcaagaccccatctcaaaaaaaaaaaaaaaaaaaaaaaagagtgtttggttgtttggtacataaaataaatagtatttgactaaataacaaaatccatctctcactatgtccagaactatatttcttaaagtctttgctaatttttatgagaggaaaatggcatgttattattttaatttgcctctgtgattactcatggcattggacatttaaatatgtttattggctatacataatttgtcaggcaatttcacatactgtactttgcctagttttctgttgggaatttttttatttatttgtgttatttgtataatcagaggaataatattataatcaacttgtgtattaaaaatgtctccactttgctctttggctttcaatatgttgtgatttctttgggtacccaatgctctccttttacggcatgaaggctgttcagtgtttttccagtggaagttattaatcatacttcatcagtgaataatctgagactaagagaaaaaaaaccttacaaatgactcatgtttggtagaatctgtctaactctaaaatgcatattcttttcactctatgtgtcaactgacttccatacagttggagaagcaccttatctcaacatttggcaacagatagttgtcttagtcaatttgagcttctattccaaaaataccatagactaagtggcagaaattggtttctcacagttttagaggctggaaagtccaagatcaaggtgctggccagtttggttcttggtgagggctgtcttcctgatttgaagatggatgcctccttgctgtgtctcacatgtgcagagagagatcatctctctcatgtctcttcttataaaggtgctaatcccatgcatgagggtttcaccttcatttcctaattaccttccaaaagctccacctccaaatatcatcacatgggggattaaggcttcaacatatgaatttggggtgacataaacatttagtccatagcagatagttaagtaaatctatatttctatgcatatgtttaagggaggaaataagtttcattgctttattgtcatattcacatgaatatgtcatgaatatcatctaacaaaagggatccagggatcctgagttttagaaagcctatcttgatggtttctaatggaaattgcttatttgcctgcattaagtttgtgccagccaactgaaacttttatgtttctgagctttggaccaaacttttatcatttcagtgtggtgacagtgtatctcatattaatcagaaactctaattgatcagaaactctaattgatatgagttctaatcagaactcatagttccatatgcctttggttaatacaaatgggaaaaggcattattttctaattacctattaggtagacaaaaatattttctaacctagaatccatgaggggagaagataacaatattactctttgcacaaaaaattttaagtcattatctaggaccatctttattcccatctgactgtacaaagtattggccgttaagagaatgaaggactttaaaatgactgtttatcatttttaatttattagaagtcagttaattattacatactgaaccacaagcttatttaatactagaagatgagttaataataaactgctccatttcatcgagagtgatggaccaatacagttaccaatgaagcagaaccaagggagaaagacatgaggtacagtgacaaagaagtgggagagagttgtaatacaatattttcaattgtggaatcaagtgcacatttaaatatttttgtgctattgctaaaggaaatgctatttttgattaagttattaaagtcattaaatttaattttttattctttaactaaattattttatattaatctgtggtttggtcaagttgtctttggcctaccatcccacaagaagtcagtgacaatgttgggaccagaattcaggagtcatcagagtccattgttgtattcttataaccatacttcactatctcagaggatgatttgatttgtaattaccacaattacacatgcaatctatcttctgctggccacttctgtgtatgcggccattgcacagggatattgttaaaataaattgcataacacatgtagggatacatgcagagataaatgatttctgtaagcccagaaaagatataaagagccatgaaactttaaatgaaattcgtgtttctggagcagccaaatcaatcatgatccccagcaagaacatgctttgatcagcatcaatttttcttacagtcttacatacaatagtcatcttgaaatactgtcatttaaaaaattaatttccatagtgatttttatccttgttttggtgttatagcccctttatttattcaatttctgattaggctgattatatgcatttttttctctaatggacctccttagttgaacaggcaataatgccataatatgcgattaaatacaattatgactttcttctcaagggcttgaaatagtcacagtaaaaaataaatgctataaatgcaaagtgccctggtagaattgtgcttatagagggaaacagcacaaaatgtcagataaatgatgaggctcagaaaggatccttataacattttgttaactttctgtcagttttcattttacataacaagataaactaaaaaacaacaatacgagaacaattttgggtcaatacgaagtgaaacagaagaacattttgtctttccagattggtttatctcatcactaaagtagcatagacttagcgattaaatagtataatgctgatgaaaataggagctaaaacaaagacatggaagtagtccatggtttggtacataaagtgtgtttctgtcatttgttctttgcaatatttaattcagtcacaatctcagtgatttccttgagcttttggatcacagaaatgagaatgctgctgttcctccactgcagggctctggacccctcgttgtttacctgaagataagcttcatctctcagttaatggcaaaattatattctgacctccaatctagtgcttttgttaactcagcattatttagaaaagtctaaggacaagtgtcagtctggaccctggtgtggctgctatgtgaaattcagtttatctgaaggctcattgaaattcattttgtgcataaacaaaaaactaccaggttccccccacccccaattcatttgatcaccagatctgaaagtattgaataaatccgtaaaacctagtgcagtgtctaattctgaagacacttcaaaatattagtcttggggcaattctgggtactgtgagagaaacagaaaaatcagaagatgtatttcttccttcaggtactttaccatctacttggagtgccaaagcagcagaacaactagagaataaaagctatgtgtgtattgtgtaaccagcttatgtactatataacccacaaccaacatccaacctgcaattacagctagggtttctaacttttctctaaaataacccaaaacatttttactcctcttcttcttcattattctgaaaattgagcaatataaaatttttaaaaagaaggggaaaatgaaaactagaaaggaaaagcatacagatgactatttcttcaaatttttctctgatctttgtgtgagagacttgaaacgaattgtttatttatcaagctcattcactttaccttcctagcaatttcaaagttgactgctcctacaagatgaggaaattaaatgatgagagagaagtaggcactgatgggatgggatgagggatttgatgataaggactgatttgatctccttaaaatcctagactctagcccaagattattgtcttaagtattctcttctgttatcatccaattcagtctctaggattgagatactattgttctaagaaagaatgtatattttatatctactatatgaatctttccctccttcagatatgcctggatgcttctctgtgggggtgggtgatttttaaagatgttagtcattattggtctctactagaatcacctgttctttttttttattatgccacattggaaaaagaaagataaattcagtcatttttcctttatactctatggaaggctgcattatcaagtatctctccccaaataagatcaatcatatcctgttttgataaactggccatagtgttactttaccttctttctttatgtcgtgttgagaaagttttttaacctcaagggaagtcaaagtttttgttttcgttgttgttgttgttgttgtttgagacagagtctcactttgtcgcccaggctggtgtgcagtggcatgatctccctcactgcaaactccgcctcctgggttcaagtcatccttctgcttcagcctcctgagtagctgggactacaggcgcccaccaccacgcttggctaatttttgtatttttagtagagacagggtttcaccatgttggccaggctggtcttgaactcctgacctcaagtgatctgcccgccttgccctcccaaagtgctgggattacaggcgtgagccaccgtgccctgccagaagtcaaagtttctgtgtcaatgttttcacaaacattatctctgaggtgtggaaatatgtcttatttcccattttaaaagtgatatataacaccgttagcttctcttagcctcggtatctttaaccgtaaaatgaagtatagatataaacatttgtccaatctctccaactagattataaacctcaagagataatgaataataaataatgccactttgtatctctagtacttaacagagtgcctactgactagtagatgctcaataaaagttgagaataattatatttccatttcttcactttcttgaataaggtggatttctgtattatcctataattattatgtttaaaataatatattattttatagtaataactaagtcagatgatctaagttaaaactttcatcggaatctaagaagagaagaatttgatggaagtcagccaacaaatattatgctgcgtcaaaacagtgtagctgtctctcactgtgccaatttattttacccaaggtgttgcaactttgagatacctgacaaaaaaagaggctcaaaggtattgccagtctacatagaccatcatatgttggtcccgtctgctgagaaacgtgggtttatgtggaagtttttcctgacacttagaaaacagcataagccaagataaaatttgctttcatttgtcaatgcaacatcaattcttctacaagcagtagactggagttttaaagtagtgacaacccacaggacgtattcttccatcgtcttatatataacaagctgtttctctccctgtctattaggctattcttacattgctataaagaaatgcctgatactggataattcataaagaaaagaactttaatgggttcctggttctgtagattgtacaggaagtagggcactgtcatctgcttctggggaggccttgggaagcttttacaatcatggtagaaggggaagcagaagcttacatgtcacttggcgagagcaggtgcaagtgagtgcaaggagaaggtgctacacacttttaaatgaccagatctcacaagaactcactcactatctcaaggacagtaccaagggggagggtgctaaacccttcatgagaaatctacccccatgacccaatcacctcgcaccaggcgctatctccagcattggggattacatttcaatatgagtggggatatatgatttggatgggaacacagatgcaaactatgtcaccgtgttaccctcccagtagggacctctagatttaacaaccttagggcaagggagtaggagagcctcatggtaatgattcctgcctgattaaggtataacaaagagttattagttaaagaaaaatgaaaaaaagagagacagacaaacagaaagcaggaataaaaagttttataaatgcaagaaaaaatgtttgcatgaaatgacacaagaagtatcaaatgaataaacacaatttatgaaacgtgcatgtcatagttaattttatatgtcaacttgacttggccatggatgctcagatacctgattaaatattgtttctaggagtgcctgtgaggatgtttccaggagagataagtattggaattgatggaccaagtaaagcaggtggcatactccaatatggatgggcatgattcaatccattgagggctcgaatagagcaaaaagacagaagaatgctgggttcacctgctctctgctggactacttgggttgggacatctatcttcttctgcctttgatgcttctggttctcaggccttgagatttagcctggaatctacaccattgaccctctagctttcaggcctttaaacttcacttgaccttcctgcatgtccagattgcagacagcagattctgggatttcttagcctccataatcatgtgagccaatatgtgataataaatttctttaaaaatatggattagtaaaatttgcatcctaatgaaaatgtaagcattgtgacagagaatgctttagtcagtctcaaatcctaaatttgagattgaaatttaagatagcttaggatgaggaaaccacagtgtccttattgaaggagtgacttactgacttctacatccaatacagctccttatatttgacaataaaattgaaacaataatagtttaaatcttggcacatagaaattatatgtccctgacctactaattttctgtaatcaggatgctagacaattaacttcctaaagaaaacacatggacaattatgcaatgtttttgataatgaagcaatgttagctcactaaatgaagtaaaatctgaggaagctatgagaagtatgaagttgattattatgaaaaagaagtttgagctgtatcttaaagataatgaatgctccttaggtcagtcagtaagttttaaaattacttaactgaaaaaattaagagaatgtttgataatttaacatgtatctttacttccagagtaaattaattatccagatttttatcccactgctctctaaattgttctattcaggcaactatatatggtcaaagttgtatttgcctgtttttctccatgtttgcttccattgtctacacaaaaaacttaggctattattttatgtgaaaataaaaaatagggagttacatgcagttctttttccgctgaccaaagaaagttttcttcagaaagagcagtcccattttttacttatttaaagaatccacattctttgttcttcctggacatatgccttttgcttagaatgggaacagaaaaggtgagactgcctctagagaagctgaaagcaaagtagtgggtctgtaagatctcaacataatcaacagtagctgtgtattcgtagctgtgatacagaatgctgtcatacgtctcactaccactccaaagctttaccatgctgcttagcacattgaagcttcatctcagatcttgccggacttatttgatatttaagatggagagtctaaaggacaaaactaaatacttccatgatgtttaaattgggcgacagaaatacaacctacttagaaagtggtgtcatgttattccatttttcaagagtttaatcctcacattggttatttgctacgaagactcaaggcatcatttcacttgacttagcctagccctatcacagtgatggcaaaataagttatattagcccagcagcatgcatcagacagtctgaaaacattctaaatgattaccactgaataagagaaaagagagccatcaagcctcattgagagaggcatgtccagtcatctaccaagatcatttaccaccctgttcattgttttactcagcagacaccctcacgcagctctcttcagaccctgtgtcagcgaaattacaaaatgtccttgggatcattcacacgcagttgaaactatgaatctttaatctggaaatgccaaattttctgggaagaaaagcatttgaaaaaatgccttacaatgtcattatttcctgccctaagggctactcctccttttgaaaaccaatttttagaaattagacatttttcaatactttgtaagtccttaaaccaatgtacgatgtcagctgcaatattttatgtgtttcaagacaaataaaattcttttttattaacagttatatgtctggcccttaaaatgctgtaaaataaaatgcttcactgtgtgaaaggctatcatggggtcattggataagttaccaaacatatttttcctgtttttaggacattttaagtttagcttttgctgctgttgaaataaagaaaacccttaattaacatttctgcaacttctcatttttttgtcatcctctgtataactagttgagtcattacatgagggtaactctaataaacaaatctagtaattgttctggataacattttattttgtatcttcttataaatgaatatttgatgatctttacattctgcagaaagatttacactttcaaatgctagccattaattagtgaaagcagtacaacattttataaaacacatttagtatttattttttaaaacattccagtgtatagaggctttttgttgttgttgttttgtttttgtttttgtttttgttttttgagatggactctcactctgtctccaaggctggagtgcagtgacgcaatctcgtctcactacaaacttcacctcccgggttcaagttattctcctgcctcagcctcccaagtagacaggattacaggcatgcacaccatgcccagctaatttttgtatttttagtagagatggggtttccccatgttggccaggctggtctcgacctcctgacctgaggtgatccacccgcctcagcctcccaaagtgttgggatcacaggcgtgagccaccatgcccggccttgtttttgtttttttgagacagggtctcgctctgtcacccaggctggaatgcagtggcaccatcttggctcactgcaacctctgccccccaggttcaagcaattcttgtgcctcagcctcccaagcagctgggactacaggcgcctgccaccacgcccagctaatttttttgtgtgtattttttatagatatggggtttcaccatgttgctcaggctggtctcaaactcctggcctcaaatgaacccacccacctgggtttctcaaagcgctgggattataggcttgaacctggcctgattaaagattcttgatacaattaatgattgggtgtgatttatgtagtgaatgattatatgctttaaataagaatacattcatagatttttaaatcacactttaagatcaaaaaaagattttaagatattttaaaagatggaggccaggcacggtggctcactcctgtaatcccagcacttcaggtggccaaggtaggtggaccatttgaagtcaggagctcaagaccagcctagcaaagatgataaaaccctgtctctactaaaaatacgaaaattagccaggcatggtagcgcacacctgtagtcccagctacttgggagactgaggcaggagaattacttgagcctgagaggcggaggttgcagcgagccaagatcgtgctacggcgctccagcctgggcaacagaccaagactctatctcaataaaaacaaataaataaataaataaaaataaaagattgagacttttttaaggggtgaaaatatttcatttgagcaaagcattcctcagctaaaaaaaacaagttttaaaatttctgatttaggaaccagtaatatattgaaaactgaagtttaagtgtcaatatgctaaataaatatttccatttccctaagtacaaatcataaattgcgaagtaactagaaaggaaactattgatcttcagcttatctgcctttgtgcagatatttatccggttcaatatttgactaacttgtctaaccgtaagaaccttgttaaaatactgatacccagaagtaatttaacatgtcacgacatacgtttagaaaggtctcctgtttgcgttagaggagtgttcttcaactttgaatcacatatgaacaacgttcataacatttaaggggtcttgttaaaatgcagatttcgatttatgtattacaagtttctgggtgatactaacactgctgttctgcagaccacatcttgagtagcaaagcattccagaagcattcaagatcccagaacaggacacctcatctagcaggtcctccacaaatgtttattagtcaatcagaatctagctaggtgcagtggcactaaacgtctttttttcttttctccttttttctcccttgccctagcttaaagctgtgcatagaagttattttattttatcctggtaaattgagcacttctgtttgttttatagaggtgtgccctttctgttgagtatctttctaagagccattatggtgtgactcatctttctgacagtatttattttaaattttaatttattcagctgcttcaatcacattcataagttatcttttagaataccttctctccttcacacttaccttggccagaaacctgatcatctgaatacttgtaagagaaccaagaaagtatagactaattgtttattttaaaaagcacaatgaaggaagaaatggatgtgatttttttcttggaaacgggaatttaatcacctaatagagtctcttagaaaagtaccattcccaaatctgttcttgattttgaatactaaattgctctaaatccacctaatggttgtttaaacctatgacaccatggagaatgtgagaacaataccgtctatgaacctcttcaagaataagctcaaaaatgaactccaccaattgatgtggaaagtatttcatgcatgggacgttctaaccagggaaatgggaaagagctggcatagcaaaggtggaggggctaaggaagaacactgagagatgggacagagatggcttgccaattcacgcgtcacatgagaacaccaaaagattttggaaaatccataaataacctaaattctcttttttcctggcccgtccagctacctcccccccaaaaaaagaagccctaaacagcctctttgctatgtctcagctaatcagcttatcagcagctcacataagaaaaggtaaataatattcgctatttcaaattgttcctctctccacttttccttacataaatcagggatttgttaggtgaaatgaattttttttttttttttgagatggagtctcgctctgtcgcccaggctggagtgcagtggtgcagtcttggctcactgcaagctccgcctcccaggttcacgccattctcctgcctcagcctcccgagtagctgggactacaggcacctgccaccacacccggctaattttttgtatttttagtagagacggggtttcactcatgttagccaggatggtctcgatctcccgaccttgtgatccgcccaccctggcctcccaaagtgctgggattacaggcgtgagccactgtgcccggcctatgtgaaatgaatttattacacactccattgattgtataagtaaaatagcctggtaaaaattagctgcatgtctttttatcattctttgaaaaacgagaagtgtttagtttgaagtatctaagtaatgacaaccagcctgaactattaaaaggatgtcaggaagaagagagcaaacatgtcctttttgctacagaatgccaaaattataatcaacaggtaacaatcgcaaggataaaccttgtttgcctaacaagataaaggactttcttaaaatcagaattccaataaagtctctcatttaaattcaggggttagataacttagaatgggacaaatagcacttatattttaatctctaatttatttgtctgtctgcaccacttgaggccaggaactatttcttattcattcttgcctcttctgcacctaggagagtgtctagctcatattcattaaataaattttgttgagcagtactgaaaggcacagatttaagactttggaacctttcccaatactatgcccttgtcgtgttgaatgaacgaatgaatcatgagtttcaagcctaatgtttcccacatgtcatgattaatggtcaaactaaatcttggttcctctttctctctctctctctctttcttttttttttttgagacagagtctcgctctgtcgcccaggctggagtgcagtggcacaatctcggctcactgcaaggtctgactcctgggttcacaccattctcctgcctcagcctcccgagtagctgggactacaggcgcccaccaccatgcctggctaattttttatatttttagtagagacggggtttcaccatgttagccaggatggtctcgatctcctgacctcatgatctgcctgcctcggcctcccaaagtgctgggattacaggcatgagccaccgcgcccagccggttcctctctcttaattcagtttcccagggtctttactgacagccctctgttaagaactgagcagtttcttgtatcctatcagtggttttgccacttccttctttttttttttttttccccaccaacatgctcctctctttctctaagtgaagttgtgcagttttttttctctaagctataaacaactacacttgggatcccaggccttcccttcattacccttatgaatatgcctttgtgtcagtggttggccagagacaaatagtaataatagaaaatcaatatactgtatggggagaagtggaaaagtgcctggatataagttttacattaaggttcggtctatacacaatcatattgattagatgtaattgatagattatcttagtattattcacatgacattatttgtgccttcctgagaggattctaccctcccatgattcgtggaactatctaaacaacttcctaggaatgatcctctcctttactcctacacagtccaactacatgcaaaggtgcccggcacatggttaaaaaacaatactacctgtgcaaatacagacgctactcagcttataatggacatacagcctgataaacccatcataagtcaaaaaatacatttaataccctgataagcccatcataaagtcacaaaagcataagtagaaccattgtaagtcaggaaccgtctgtataaggtatcaagacaaataaaagtgaataccacacatactacttgtgaacttttaataactctgaacacaaacagcttgaaaacaataattggatagatggtctttaattcatgtctttatgaaaatagcaaaagagtatattgagaatgattgaatcaaatttaacaaaaccttgcttctcagtgtgactcctcgaccatcagcattgaaatcacctagaagcttactagaaatgtagaaactggggcccaccccagacttactaaatcagaatctgcatttttaacaaggtccccaagaaaatcagtacacgcattatgtttaagaagctactctaatgagtacgcattaagtattgatcacactccagttccttcttagaaaagaactgacggcacggcttaaccagtgtgactaaaggaatgatctcagtgttggtctgtcctaaattttcctttgtgtctaccctgaactgagattcgccagggcctttaatactaggatttagtcttcctttatgcatgcactcaaattagagcctttgtcatctgagtctttacagatgatatctctcaacagtgctgggagtgtggcctaaagcaatgtaatactaagtgaagtcagaaaactggctacccatctgcaaattgtttgttacttgtctgtcataatatagcaactttggtagaatatgcatgatgacataagaagcttgtgccaaaatgtaaatcacctacatcactaggcacactcttaatttcagctgctatttttttcttagtaaaactttttcaatgaaggaagtagcatgttgatttctactcaagcatagcttgttacctccttgtggacaagaactttgaatagcacaggcaaagtgattaaatgcagaaggctgctctacttgctgcagtgtgaatgtggttaatcacaacaggccctacatattagagcacaaattaattatggctatagattaactgctttgttaactccataatttctctggggttcacagctagattcccagtacctggcacagagatggccttcagtgtctgttgagtgaatgaagtgcctagctcaactctcattgtttacctgttgttgtagttgtttcttctggcttggatttctaaagctcctgaggtatagatactgttgattttacctaaagaggcttcagcagaagagaacaatcacacaagaactagaaaagacaaggaaggttttatgaggaaaatgaacattaatctagaatttgaaggaaaaatgggacccacatcagcatcatagagaaaaggggattcctggcaaggagaacatggaattttgtggaatgcacagaatgtaggaggtaggaatacatatggcatttcaaggaatgagtgtgccatacgtcagccaaaggctgaggcaatggagtactgggaggaagtgttaagaattatggatggaccagattcttactttaacatcttttttttcccctaagcctaatgtgcttccaaacttgcctcttttattaaatgatattcataacaaaagcaatactaaagtccttccttgcctgtttcctctacacacataaaaattaaacatttaaataaaagtagaaaaattgtgacacttttttaaagcttcaagagtaagatttcacatacagatgacacattttctacaatgtaaaatttagagcattactaacgcatattaaatgctagatcagtctttcaagttacagtacacagaagataaaaataggtgcgatttggaaagaacaaaggtgaactcgaagcatacagtgaataggcacaaatcagctacaaattttagcagatattcatgcgcttattgaaataagccaccttttcctgcatttgtgccgacaagtccatttatcctttttaagatgctccagtaacgataggagcattttgggggcgggggaggggggctaattgatgtgatctaatttttcagactcaggagttttggagaaaggtcagtgtaacagaaaagctgcccattagaaataacatctataaactgtcagaaaagagtgcaagccagaagatgaagcaattcagattgcttcccttcttttccaaggttcttgggaaaaaaatttcattacgcataagaagtatagctaaatacttaactgaagttaaaacaaaatcatgttttctaacagttcaggtgaatttcaagccatccaggccacaagataatgatgtcctccaagtctgacctacagggaacttttcttctaattaataaacagactacagcaagaaaattaatttatgcaccgcatttacttgttgatgcccttcgagagcataacatttcagtaggcactgtgtacacgagatacagcagaagaatacgtcaaagctagttctttggtgttttttttttcccagagaaaatagaggtaatccaacattagacagaatttgtcgagattactagatgtacattcaaaacatccattcaacaaaccaattgaattagttgcatataagagtgtcccctctgggccgggtgcagtggctcacgcctgtaatcccagcactttgggaggctgaggtgggtggatcacgaggtcaggagatcgagacaatcgtggctgacacggtgaaaccccgtctctactaaaaatacaaaaaattagctgggcgcggtggcgggcgcccatagtcccagctactcgggaggctgaggcaggagaacggtgtgaaaccgggaggcggagcttgcagtgagcggagatcgcaccactgcactctagcctgggcgaaagagcgagactccgactcagaaaaaaaaaaaaaaaaaaaaaaagagtgtcccctctgaattgtactcttcaggattccctgggtgcctttttaaaatttaagtctgctactgcctctttcataacttatggggcagagccctaattccttagcatgtcatgagaacttccaaatccaggttctgcctgcttattcaatctggttccactctcatgccagccacttcatacctaatcctccaccattgctaccgccagtgtctgaatgcatctcacctgcgtgcattttaccaagattctcccactgcctggaatgagaccacacctttttcaccctgaaacacagccattccaattgtggaaactcaactcaggcacctgttccttcccgtcttaccacatttcctgaccaactcatgccaccattgaatggccccttaagcttaagtcctcttatttttgcagtgattagacgaaatactatatgtaaattatttagcaccatgtctgacagtagtaaataactatcattatatcacatgttattataactacactggagagacaatataacatggtggctaaatgagtaaaacttgacatcatactgcctatctttcagtacttattgttctgtgaatttgtcaagttaatgggccctcccttctgggtcagttttcttacctgcaaaatgggtacaataatagtttctacctcacggggcgtttgtaagagttgaatgagttagcacagaaaaagcacttagtgtctaccacatactaagtatgcaataaatgttaactgtgctgctgctgatgatgtactttttaaacactttaataaaaaatttcaaatatatgcaaaattagagacagtggtatgcatatactgaacacccagctttagcaattatcaaattttgccattattgtttatttatctatttctctttggtctatttttcattaatgtagtattttaaagcaaattccagacattatcatcagtttccctttaaatgcttctctaaacaatgatgactttctacatagaaccacagttccttttacatccctatcttgcaaatacgtctaaataggatatttcatttaacttacttattttcctatctttccttctgggctgtaaatccttgaaaccagtggttgtgatatttaattcatttaagctgtaattcactggctagaacacggtagtagtgcaataaatgtactttttaaagagagagagggaagtaaaaaagagagaagggagagagttaaggagagagggaataggaagggctcacataacaaaataagacattaaacaaatgttgaccttagaataggcatagtacaactagtgcctgaataagcagtaagtaccaaatgctgtgatcctagagaggtgtctcagaaacctatgcatagccaagtttaatttgccagcaggtttttacttcattgactggtcaggtagagaagaagaaagcaaaaataaaagagtgtattattctgtatcacaatggtatcagattgtttattttggagtctgtgtctatttctcatttccaataatttatgatatcatttaccattattaaaggaaccttatttttaaagccctgtgacacctagtgtgaagcagaagagtttgcaaagtttaaacatcatattgttaaattctggagtggctttaactagctgtgtgatcttgggcaagttacttgctttctctgcttcagttcttcatttttaaagtgtgacaggattagcacctatctcataggcatgacatgcttagaacaatacctgatacatgaaaagaatttttaaaattttatttattatctagttataagagaacaatgaaataaaacaaatatgaagctcgcccatttaaagaaaaaaaaaagaatgatttcattgaagatacttcctctgccatggaattgctaaatgaaactttgcagcaattccaaaataacttgccccagggagtaggattggattttgctaaactgaggatttaagatttacaattttttgactgtaattcattcttacctctgccaaatgtgattgcaaagggaaagaagacatcataattgtacgaaagggttttaaccaggttttcttgttttttgtttgtttgtttttactaattgtttcagggcatttgaggcaattgtaagagcttacacatggtaaccactacataaatattaaaatgatggcttggtacaaaaatgactttatgattaataaaatcacaaaaacttggaaaaagagttataaaaattctccataattgagtgccaactttgggcctaatgttttatatagtaggtagaacccaataactgccaattatttggcagttttgatgttagaaaaggccacgggataaagttcggacaaaatacattttttctattcctccagatagtagggttctcatttttcacagaggaaattagggtttagatagataggggacttgtataaaccacatgctacaaagcgaccatgtagaaacgtgagcccaggttttcaggctcatcttattagtggctaattccaatgtcctttgcatatttaggaaatgtttgctataataaagaagctgggcaataagatattaaatattttgaaaagggtaaatatttagtgatttatcaaaggaagcacaaagcactgagtactttagcagaagaaatggattaaagatgtgagacccatgtcacataaaccaaagaccatttctcctccagataataatgagattgtcacatctatcaatttctatgtatgtattccattgtacatcctctctccctaaattttaaaaagttatgatcatgttgatatgcaaagggaatttatgtgtttgtttaactttttgaggagaaagtgagaaagagaaaatattttacattccaggagagaagcactttagagaaattgaagcaaaaactgggaagaagtcagggccaactggtggaaagtcccccaggatgcaagagaggagcactgagccctgacctacttctcactaattgctgcaaacctcccataaattccttgcccttcctggtcttcagattcctcttctataaaacaagatggctggggaaagactctctgaggtttcttggagtttttacaatttaccgatcttgtgaaattagaccattaattatcttttaaatgtatgttttacaaagtgttaagatggaagaaataaactggtaaaatataagatggtttgtaatcataaatattttccatatttaattatagtttatttctcatagaagtgtaaattgaggtgggttacagtgttaaaacaatattagaccagtttgaaaaaaaaaagctagaaagttctatgcacttacatattttgtgataatcagatattagtcaccattctttatataaacccaatgttactaattacttaagctttaagatgaatgccaacattttgatttattcacatccataacataatttggagaacctagaaatttttttgtttttacatttgtgcaatgacatttcaggtttggttttagacttccttcttttctttcaacatgatgctgagaaacacaagtaataggataatcacaggttcattcctagccatcgcttttgcctgtcaatatcctaattacttccctactccacttagatgactcagagtccatgccatgaatactgatgatgagagatgatgcaatggggagaacttattgtagctccatcctgtcctttaactttcattgtttctccagccaagaatttaagggcacaagttagaggagagtctggtcatcaaaataaaattcgttagccttttaaaatatgtcaggctaataggacaagcagcctgcaaggagaagcatccctgactttgctggacagcatttccaattatcagcatcttctggcattttaagttataactgaatattctcaaataaatgttgcaagaatatgaagtgtagcataagtattatcttttcagtgaaatctattcttatttatttacatagagtgtattctattttaaattatatatttatggacataaaattcacatatttgacaagttttttgaagaggcttttccactggagtaaaaagatggaaatttttaaacagcatttgattggtattccattttcctttaatatttgaaaatgttatgttgatcatattttaggtaggaatggatctattaactaccatggaatcaatttgtagttatccatgaaaataaaacaggaagaatttttaaataaatattcactctttatttacaaagatttattaagtctctgctatgtgccagtcctagagaaataaactagtgatggcctggatcgtttaggagcttacaatgttttgggagacatgcacatagaatgattaaacgaatcaggagatggtgagttccacagctgatgtatacacaaacaaataatgggtgcatgaaagagggtcaccttatctcttctgataaggttatgaaggtatcccagaagaaaaacatctgagctgagtcttaaaaatgcaagagaatattcccagatgaagaaaggggagcaggccatctcaagcagaggagacatcagttgattttcagcaagtatgtagagtgtttaaggactgattgacaggtcaacgtggcccaagtgaaaatggtgaaagttagttggacccaactgtgcaggtcgtgaagtcagattgtgaggatggctcccatctcatctgggagaaagagatggcttcctcaggcatcaagtgctttcttcttaaagctgcagttatttcaccgctatttaaatttgtgttttcccgatggtcagagactacagtcagactgcctcttggatttcagtgatctttgatttacctgtttacacctttcacatatttgttgttgtttgcattttgacttgtagaagctctttacaaacatgagtagtcatcctttgtcatttttgttgtgctcatactcccacggtactttgctagttttgttattttgtctatgattttaccccatacacaaggtttattttataagtttagctaacaaatacttattatgtaccaagttttattctaatgtttttttacaaatgttaacacatttaatcttcataacaatcctatggggaaggtattaacatgcctatgttacaggtaagaaaactgagctacatcttgaaggtcacataacttcccaaggccttactgtggtaggtgtgaggccagggaatgctacaaagccctgctttgagcctccactaagctgctttctttcaaatttgtcttctgttcctttatgatacctgtattttatatcttattaaacaaggccttgcccagctcagattataaaataacctcctagacattcttataattttatacttctgtgacttttgggtttagaactttaatcaatctgcaatgtattcttgtgcatgatttgagttagaaaccttctcaaatgttacattatttattgcagtaaccactgtttctctcatttatttgaaatgataaattattgcaaaatagattcatgcattttttgtaacttttttattatatttcactgttcaatttgttcattccttcactaataccatacattgctctaattactgttactttttagcattgaaattgatgtttaagtgttccctttttaaaatatacttgtcactgttctcatttatttataaattcctccaaataaatatatacaattagtgtcttacattttataaagttggtttgttttggtggagtagattaaatattgacttgggatgcaatatacttataaaattaatttgaagaaaactgatattgtcaaaataattaactttttcatactagaatatagggtgtcttttcatttattaaggtctttcttgtatttcactacatttttagtttttttcttaagtcttacacaatgtttggtaagcttatttctaagtattttatcattgttttccacttttaatgagatttcaaattccattaaaatttttaattggatcctgctgatatacagaaaaactattaatgtttgcatgtctttcatgtatataattgctatattaaattatcttattaattctagtagtttttcaattagttatcttggaatttttcttagtcatatccgtgaaaattgttagctttatctcttcttttgcaatgtttacactttttaattatattgtctcattgtggatatgtacttataatgaaaactattcgtgataatattcttaattttctagttcctggttttaattgaaattctttgtatatttcaccagttagattgttcttacacagtagtttgatttttattcctagactagttattccattctcacatttaaatgacactttcgctgctttaggttctcaatcttttgtctcagaactttctagcatcttgtgtttcagggaaggctgaggccaatctgagagttattccattgtgctaccttccttggttttaaaaattatcttcattcttgaaattcaaagattttacccaaatttcacctaaatgtgtatagatttggagttaagttttccagagaaaataccagacactcagttaaattaaagttcagataaataacaaataaaaactatttcccagctgtatgcatttttatttgctcaatctgataatcctaatggggtattgactgttaatatattattatcattattaattatttttgttactgtttggcagtcaaagggatattttaaaataaagtcctttttcagatcagaccaatatttttcaattacttctttgacacagcgtagcaggtcagaaaactggttcttaaaaccattgtgtatattggatgtggtcttacatttaactcccggacaagctgtttataatttggtagtatgtcttaggctcttagatgctcacatgctagaataagacaaaaagaattaggccattcctttttctctttattccctgttctttctatctggaaaaacagatattggaaattcttcatctattccctatgtctcataacttttctattaaatgtatatatttttgtcttttatgcctcatgttttgggagtttatcttcacccacattaattttaatatgtatgcctgatgaatttattaaaaatttctacttttaatgagattgcaaattccaataaaatttctaattgtatcttgctgatatatagaaaaactattaatgtttgcatgtctgtcttgtatataattgctatattaaattattttattaattctagtggttttttaattagttttcttgggaatttttcttagtcatatctatgaaaactgataattttatctcttcttttgcaaagtttatacattttaattatattgtctcattatggatatgtacttataaaacaatttgtgataatattcttaattttaaattaagaatctttttaatatcttaaccttacatgtataaatttattaggtctgataattttattattagaccttcactaaaatgttaaagtttagctatcatggttttaatttcaaaattttttttcttgatcttaggttatttctttttcatagcaatttgttcttgctttatgacttttgagtttttttctgttttagcattatcatggtttcctctaagactgatcaactttctccttttacataagcatatttgttgattttcctcaaatatctggtgaaacttgatttccattcttatgttattaatatttataaatgaagtatcggtttatcaatgtaggtaactacagtggttttaacaattgttatgaaaggctggttttgcagcaggcttcttccctgactaggagagagaaatgtgtgggtctggttttccttttcttgttatgcaagcaggaagaaccagaaaagcaggggcactctcatgattgcaaaagcaagtgctcatctgggtggtacttttaagtgctttggcaaaggatgaggtaaaattcaaagacaacagcatcactgttttcagaacttcattcagagccattacgacaaataatttggttgcaagggtgtttgatacctgaaataacataaggattcttagcactctcgttgtctgttcacaattgtctgcaaaaagcaaggcaaagcatagaggtcatgcatggtgttatttttcatttgtgggaggagaatacatgttcttattttgatattaaaattaggaaagactagtggtcaaaattgaaagtatagagctttactgtgacataattcagtttcttataaggggatcatatataagagtaccccaaagtactttgtattgtgcttgcaacttttctgtaagttaaaattatttaataaaaaaggatttttttataatcaagaaatctaaagatggaaaattatgattagatttaggtttaacttaaagtgacagaaaacacaaaatattactgtttcaaataagatagaatttatatcttgcctacataatgtaagcggtcatccaagcctggaatggtgctccttggtgtcaggaacttgagttcattctgtcttgcagcctctccatgcaggaattccatgttcagggtcatcccgtggtctaagacaaatgctggaatttcagcatttccattcacattccagccagcaggaaggagaagatgattgccaaaaaagtgcactcctttcctctaggaacactttctaaaagttttactttcttcctgcatcccagtgtctaggaactggtcacataaccatatctagctacaaggaaaactaataaatacaaaagctgctaattacttctcagcattcctgtacctactaaaaatcataattattgtagaaattggatattgaagacaacgaagaaaacaatgaagagtatttgccacaccgtttgaacagggcagtgtttgtagaatctcttgaagctcatccattccaaagacatccgtgagtgcttaccatgcacgaagcactgtgctggggcttgagatagaaatgttgagaacaacacacttggtctctgtgctaatggagttttaggctaatgggaaaagtggggattcaaaacataaggaaacatatttgaatattaataaaagctaagagactgttaagagggaaattatcacatgttctgagaatgtgtcacggaaggactttgccaagccagggcaggatgatgatgatctaagaaggctttcctgagggcatgatacatgtgttcaaatccacaggatgaatgggaatatgcaaaggagaggctagagtaggaatatcaaagaaggcagcatatgcacaaatgtcacagggaaaagaataataatccagttaagaaactgaaagttctttatggctggagtacagcaaacaaggaggaaaacaggagaaaatgagactagaaaggttctcaaggttaaaataatgtagaatcaaatgcaggccacatacagttatttgtgtcattaaagggttagaggcagagagcaacatgacctgttttatacattgaaaaatgttctgaatgcaatgtagaaaacaactggatgagtgtaagaggagactatgctaggagttcaggcaaggtgggagagagagcaatgtggacagaatcaagagatattcaagagattaaaaacaatagaacctgatgataatttagatacgaaagagtgaaggtaagagaggagttgaaggtgattcccacatttccagattgtacaaatggatgggtggtggaccatttattttctgaaacagagaaatatcaactaccaattagaggaaagatgttgatttttggtttgatttaagagccttgagtttgcggtgcctttctgacgttcaagtaggcatttcagataggaagttaaacatgcaaatctggaacaccgagaaaatagcaagcctagagatacagatttgagaggtttttgcacataggtagttggtaactaaatcacagtttcagagaggagtccctacagagatagcaggcagagagatgagaaaaaacaagaatctgggacttgaatctaaaaggcaggcagaagaagggtggcagaaggcagcaatggagactgaggagggtgggtgagaaggtagggatctgttgggagtttgtactatgatagaagccgagggattctaaagcactaaacaggcaaattcctccttgacttgacttgacttccttccttaagtcaaggaagaggagggctgaaagaaaaaattgagagtacagaagggttctgaaatgttactgcaaagataagatgtgacaagtatctcttaaagatggtggtagtcatgatggtggtggctgtgtctgtgtatctttgttatgcatcaatatttgaaccacttggggagatgtccgtcaaagaatacaaaatttcagtttggcaggaggaataagttcaagagatctattgtacatcatggatgcttagtaacaatatattatacacttgaaaaatttctaagagtagatcctaagtgttcccaccacacacacaaaaagtgtgtgaggtaatgcaatgttaattagcttgatttaaccattccacaatatacacatatatcaaaaaattatgttgtacggtataaatatatacaattttgtcaattaaaagtaaatgaatgaatgaatgaattaaaatatttggagcactctgaagctgaattcagaaataatgctaaagaagacttgactttgttaaagacagaatttttatagaatatatggaaatagtaattattgcttaaaaactgtattcaatattttgatattgacctcaataaaaaaatgtgtaatcaatttttgaacttctagtcactcaggggacagaatggttaccatttgttgtcctaaagcaagggtagcataggggcttgtcccaggaacaatcagttggtcttcaaccaaaaaagtggatatttccatcagggacatttgcctggacaccaccatgttagattctaaaaatcaaacatgtgtcccaccctaactttgcctttagtccctgaaagaatggacgtaggtttgagagaggagaacagtgagggtcatccctcttcatctcaggagcaattaactagttattttgctcactttgggaagaatttgccttcaaaaattataccttttggaaaactataccatataattatttatcttccttcaaaatatgaattatttgatctttttctcacttcaacttttcaaaaatttcacataaggagccctattcaattatctccttctgtaattaaaacattttagtaggtgtgcaaccaaattgccaaactaagacagatcttgttattttaaaagaacattataatttcaattattctaataattgttattattcgatagagcaaattatgaatgcaattttcaaagcaaatgaaaacataagaaattcatgatttttctatactgctacaaatttggataacttcaaagtgattatcttacatttggcttttactttggaaaatattaatattagaaaaactgcaaaattttggaatctagattaaagaacgatagattatgatgataactgtttatgattcttattttattatttcttttttgaacctgcttttccaatctagataagcatgtctagtctcataccatattcatactgcatattataacatggtgttaataatcttaagtaatattccatggccaatcaaccttttttggacactaatactcattatgagactgagcttaacagctgttttttgtttttgtttttgcttttttagcatttaagtttaggggtatgtgtgcaggttggttatataaatacactcatgtcatgggggtttattgtacagattatttcatcatccaggtattataatcctagtacccatttgttatttttcctgatcctcttcctcctctcacccaccaccctgatgtagggcccagtgtccattgttcccctctatgtgtccatgtgttctcataatttagcccccacttgtaagtgagaacatgcagtatttggttttccattcctgcaatagtttgctaaggataatggcctccagctccatgcatgtccctgcaaaggacatgattgcattattttttactgctgcatagtattctatgatgtatatataacgcattttctttatccagtctactgctgatgggcatttaggttgattgtatgtctttgctactgtcaatagtgctgcaatgaatatatatgtgcatgtgtcttcatgatagaacaatttatattcctttgggtatatacccagtaatgggattgtggagtcaagtggtagttctattttcagctgttttaggaattgccacagtgtcttccacaatgattgaattaatttacacccccaccatcaatgtataagtattcccttttctccgcaaccttgccagtatctgttattttgtgacttttgaatcatagccttctgactggtgtgagacggcatctcattgtggttttgatttgcatttctctaataatcagtgatgctgagcttttttcatatgcttgttggcctaatgcatgtcttctatagaaaagtgtttgctcatgttctttgcccagtttttaatgtggttgtttattttttgcttgtaaatttaagttccttataggtgctggatattagatctttgtcagatacacagtttgcaaaattttcctcccattctgtaggttgtcagtttactctgttgatagttttcatttgtttgtttttgttgttgttgttgttgttattgtttttgctgtgcagacactctttagtttaattagatcccaattgttaatttttgcttttgtcacaattatttttgatgtcttcaccatgaaatctttgcctattccaatatccaggatggtactgcctaggttgtctttcagggtttttacagtttggggctttttttttttttttttttctgaggtggagtctcactctgtcgcccaggctggagtgcagtggtgccgatctcagctcactgcaacctctgcctcctgggttcaaacaattctcctgcctcagcctcctgagtagctggaactacaagtgtgtgccaccatgctcggctaactttttgtatttgtatttttttagtagagacagggtttcaccgtgttagccaggatggtcttgatctcctgacctcatgatccgcccgccttggcctcccaaagtgctgggattacaggcgacagccaccatgcccagccagttttaggctttacatttaagtctttaatccatcttgagttgatttttgtacacagtgaaggaaagggtccagtttcaatcttctgcatatggctagccagttattccaacaccatttattgaatagggagtcttttcctcattgcttgtttttgtcagctttgttgaagatcagatggatgtaggtgtgtgatgttatttctgggctctctattctgttcctttggtttacatatctgtttttgtaccaataccatgctgctttggttattgtagcctgcagtatagtttgaaattgggtagcgtgatgcctccagctttgttctttttgcttaggattgccttggctattcagactctttttttattctatatgaattttaaaatagtttttttctagttctgtgaaaaatgccgttggtagttagcagcttgtttttgtttgttcatttgtttttgaaacagaatgttggtctgtgccttaagtttgaaaatcctccaaaattttctgtcctttcactgaatatgtggtctcttggtcacaatgcagcactgaattccctgttaatatgcatatcttgggttctttttattcagtacacacagaggttgttcccttgaaaatgagtagtccagtaaaatgccctttgcagagttatatcccatatttctagaaataaattctaccaaatattagcactactgaataacacttttaacaatgtttaaacttgcctttttagttgaaagcaaacataaactcagctgtaatatcttaagttcaaatgcactaattttcaatttcatatcaaatttcaaaatacttttaggtttctattcaacactttggttttcatacacaagccacagagtatactaaaactcatttgggtggcatgtttctcatataagtaaaggtaaagactaaggacaagtaagttctttattttctaccagggtgaatggtaaagtagtaaagatcagtatttcctggaaaaggggaaaattgctttcagcaggagtttacaaatccacttggccattaaacatttttcacagatgacatcaaaagtgttattcacataaatgcatgggaatttttttccaatgtatgtaggtgttattatgttaaataaaacacagacccacttaaacatcatttaatttatggtaggcttttcaacaagctggccagatttggttgatgtttctcaaaaactactaaaatttcaataaagtgaatgtctgtgaagtgctttgaaatttaaaagagctgttgaatgtgtgcaaagatttagctatagggatgttcaatgaatcactgattatcacaaagaaaatgtggaacaacctaaatatgcaataataggagtttgattaaatacattatactatatccataataattttgcccttttggttgcaagaatcacagatacagtcagacaatttcagaataataggtgcttttgcaaagaagcattagcatctctgctgcagggcgtagtcctaactcctacccttctcctctcaaggtggtttattggtataatttttaaagacaccagtgccccctgtttttccctaacttagcagagaagatctgacaaacctattcagtcactatcatgtatgaagcatctctcatattcataaagtgtgggcaagaggctggtatagggtaatagactttcccaactataataggataagagtgattgtagctatcaaaaatatgacagatctttcaaaagtatgtgaaattattaatttaatgatgacccgtaagtcatgattttatactatttggcatagcttcacaaaacacaattttcatatgtattgaaaactaaagcaaaggaaaagtataaaaatttttgtgtaactgaactgacatgatatcagtcataaaatctctgcttgacaatctcatctgtcattctttcaaaaataacttatttattaatgtcaacagtgatgctgctttgcactgtattgaatataaatctgttgttcttttggcatttgggctaaggttggctaaattatcttagtaaataaattagcaaagcacctttttttttttctttttggcaatctctctctataattcctctttacctgtatcagtttttctcttttcctcatatttctcaaatatatatcaccattggttcttctttctcttgattgagaatttctgagaaatgttggtccatagtaaccagtattccaaggttagatgaaataaccaggacttagtgagaaatgattgttcagtaccatggatagcagaacacttatttccccaaatactaacacatactcctccaaattttagctgcaccattgaaaacatttctttcaacatgtctttggctcaggctattattttcaggccaagaagttctagtcagactagccaggctggctatactttttaaactatctgtggcaaaggatcaagatttttcccaccactcgatctaccgtgtaccaatatgttcatcatggaaactgaacaacctgctcctgaatgactactggatacataacgaaatgaaggcagaaataaagatgttctttgaaaccaacaagaacaaagacacaacataccagaatctttgggacacattcaaagcagtgtgtagagggaaatttatagcactacatgcccacaagagaaagcaggaaagatctaaaactgacaccctaacatcacaattaaaagaactagagaagcaagagcaaacacattcaaaagctagcagaaggcaagaaataactaagatcagagcataactgaaggaaatagagacacagaaaaacctccaaaaaataaatttataaaaagttaaagcaaacacacaaaatacaagtagtaatttcttttttattattacataaaaaacaaacataatatagtctgccaaaattgctgtgacagttttaaacagccctgtgatggcatccagttgataaaagtgagtagagccccagtatgtgagagaggcagagagtttccctctgtgacttacctttccactggagatccaagcaacccaggccaagagagagcactttgcttctcctaatccctggagttagcttagggagagtcttggagaaactgtgaaggaaagacaccaggaaaagtggcagaagttttctcagaccctggatgagagtaggatgccattttaaatctgggtgcatacaaagtcagccatgctttggtgccctagcaccatggctacagaggcactttagtcttgtgccagagattgaagcatcttatctggagtggggtgggggcctccacagccagaactgtaaaaaagtgtctcagcagtagtctctggaattgtgctctctcccatcacaggcaggaggagagctgctacagttgcggtttcttctgagcagcaagacttgcagccagggccagcttggcaatctggaactgatctgtgtgtgccattgctgagtgccccatcctcctcccctgagatcgtggtgcaacagagccctccctgctccattcctaggcagaaatctgggtatttggaacacctgcttgcctggaccggtggtctgagccacaccacccttccttgatgtatatggtggtacagagagggtctctgtgctccatgcccaagcagatttctaggcattcagagcgctcattcacctggttcagcagcctgagccacctaccctccttgtgcaaagactggtacagagggaccctctctgctacatgcccaggaagatctccaggcattcagagcgcctgcttgcttagttcagcagccagagtcaccccacccctcatgtgcagagatctttgtgcagcggggctctctctgctccacacccaagaagatctctagacttttggggcattgctcaccaggaccaccaagactgtccaaagatcttggtgcaaggaatccctctctgttcacactcaggcagatcaccagacattctgagcatacagtcatctggttcagcagcctgagctgccccaccatttatggacatagatcatggtatagtaagaccctttctgctccatgctcaggcaaatctccaggcatttagaatacctgcttgcctggtgtggcaacctgggttgcacaaccccttctgttcgtagatattggtgcaggaaggccctctctgctccacacccaggaagatctgcaggcatctgaagcacccactctcctggattaggaacctggaacacagaacttggagcaaaggtggtttcctgactccacatttagacacacttctgggtgcctggtagccacccactggattctcacttgatactggtgcttgtgcttgcatcaggggacctccaggcagacctgcccaactggtcccaccctttatggctcctacccccacagtgctgagcagggacctcagaccaatgtgtattctatgaatcaacccattgcctgggcaacagagaacttccacttctaaatacagataccagccactttgaccacagctggctgttatctacaggcttgtaggacaaacttcacagcccaatataaaacctgttgaaagaagtgcatactgctatagaagaaaaactgaaagaccctcctcagcattcttcacagtcacaccccataaagcacgtaagggaaagagaataatagtaatgacattataaggaaagaaagataaaggaaaagtcctacctgtatgaaaaaaaatacaaaaattagaagtgccagtgtctccaggtgagaagcaaccagcacaagaattctagcaccatgaaaaaacctgaatgtagtgaaaccaccaaaagattgagctacctctccagcaatggtccctagccaaaatggaaactcagaaataataaataaaaattcaaagcgtggattgcaaggaagctcattcagatccaagacaaggttgaaaatcaacaaaaggaaatttctaaagcaacccaggaaatgaacaaaaagataaacatcttaaaaagaaatcaatcagagcttctggaattgaaaaactcacgtaaagaattccaaaatacaaatgaaatctttatcaatagactgaaccaagcagaagaaagaatttcagagattgaagagtggtcttttgaactaacccaatatggcaaaaataaatatgaagaattttaaaaatgagcagtcctcatgaaatatgggattatgtaagaggactaaatgtatgaattattggcattcctgagagagaaggaaaaaaacaaacaacctggaaaatatagttgaaagaataattcaagtaacatgcctaatctagctaggaagatagatgtccagatacaagacattcagagaatacctgtgagatactatgcaaaacaaatatcaagccatgtagactacaaaccatgtagtcaccagattgagcaaggtcaacgctaaagaaaaaatcttaaagactgctagaggttttccttaggcaaagatcttaagatctttccttaggtaaagatcttaaagatctgctagaggacagatcatgtacaaagagaaccccatcaggctaatagaggacttatcaccagaaaccttacaagccaggagagactgggggcctattttcagcattcttaaagaaaagaaattccaaccaagaattctatatctcaacaaaggtttataagtgaaagataaataaaatattttccagacaaacaagtcctaggggaattcattaccactagaccagccttaagagagatccttaagggagttctaaacatggaaatgaaagaacgatacctgtaaccgcaaaaacacacttaagtacatagcctgcagaccatataaagcaactacacaatagaaactacaaagcaaccagctaacaacctcatggtaggatcaaagcctcacttatcaatattaaccttaaattttaatggtctcaatgcacgacctaaaagacacagagctgcaaggttgataaaaatacaagactcacttcttatccaagaaaacaccaaatagcagatgacgctggtggagcgagggggcccggaggactcgggggccctgggatggggaaccacagtggctttcgtggaggttttggcagtggcatctgggctgtggtcacagccatggacagagctggggctgaggccacggagctcactgaggcaaggccgaggatgagtggatgcccgtcaccgagctggacctcctagtcaaggacatgaagatcaagtccctggaggagatctacctcttctccctgcccatcaaagaatcagatatcattgactttttcttgggggcctctctcaagaacaaggatttgaagattatgatggtgcagaagcagacccacgtcggccagcacaccaagttcaaggtgtttgttgccattggggactacaatggccacatcggtctgggtgttaagtgctccaaggaggtggccactgccatctgcggggccatcatcctggccaagctctccattgtccctgtgtgcagaggctacaggggtaacaagatctgcaagccccacactgtcccttgcaaggtgacagaccgctgcagctctgtgctggtgcacctcatccctgagtccaggaacattggcatcatctcagcccctgtgcccaagaagctgctcatgatggctggtatcaatgactgctacaccttagccaggggctgcactgccaccctgggcaacttttccaaggccacctttgatgccatctctaagacctacagctacctgacccccaacctccggaaggagactgtattcaccatgtctccctatcaggaattcactgagcacttcttcaagacccacaccagagtctccatgcagaggactgaggctccagctgtggctacaacataggatttttatacaagaaaaataaagtgaattaagcctgaaaaaaaaatacaaggctcatcagtctgctgtgttcatgaaacccatcttacgtgtaaagacacccacaggctcaaagtacagggttggagaaagatctaccatgcaaacagagaagaaataaaagcagcggtcacagcccaggtgctgtggctcacacctctaatcccagcactttgggaggccaaggcaggcagatcacttgagcccaagatttcaaaacaagcctggacaacataggaaggccccatcctttaaataataaacaaaaaagcaggggtcactattcttctatctgataaaacatactttaagccaacaacagtaaaaaaaagacaaagaaggccattacgtaatgataaagggttcaattcaacaagaagtcttgactctcataaatatgtatgcatcaactttggagcaaccagatttataagcctgctaaaagacttagacagccacacaataatggtaggggtcttcaacccccaactgacagcagtagacaggtcatgaaggcagcaaactaacaaagaaactctgaacttaaactcaacacttgaccaactagacctaatgaaggtctagaaaacactcaacccacaaaccacagagtatgcattcttcttatctgcacatggaacatactccaagattgaccacatgctctaccataaagtaagtctcaatgaaataaatatcaaatcaaccatactctcaaaccacaatagaataaaaatagaaatcaataccaagaaaatctcttaaaactacacaattacatggaaagtaaataatttgatcctgaatgacttttgggtaaacaatgaaatcaaggcagaaatttaaaaattatttgaaataaatgaaaacagagacacaacataccaaaatctctgggattcagcaaaagcagtattaagaggaaagtttatagtgctaaatgcttacctcaaagagttagaaagatctcaaattaacgatctaatatcacatctagaggaactagaaaaacaagaacaaactaaccccaaagttctcagaagaaaagaaagaactaaaattagggcagatattgagaatcaaattgagacccaaaaattcatacaaagtatcaacaaaactaaaagttggttctttgaaaggataaacaagatcaatacactagattaacaaagaaaagaagagagaagatccaaataagcacaatcagaaatgacaaagaatgacattacaactgatcccaccaaaatacagaaaatccttggagaccattatgaacctctctacacacaaaaactagaaaatctagaggaaatgataaattctgggaaacacacaatttcccatgattaaatcaagaagaaattgaaacattgaacagaccaacatcaagttctgaaattgaatcagtaataaaataaaaactaccaaccaataaaagccccagacaagagggatttacagccaaattctaccagatgtacaaaaagctggtaccaattttactgcacctatttcaaaaaatcaagaagggagtcccttctaacacattctacaaagccagcatcaggccaataccaaaacctggcaaagacacaatgaaaaaaagaaaattgcaggccaacattcctgatgaacatagatgcaaaaatgttcaacaaaatgctagcatactgaattcagaaacacatcaaaaagctaattcaccatgatcaagtagacttcattcctggaatgcaaggctgattcaatgtacacaaatcaataaatgtgactcaccacataaagaattaaaaacaaaaacaatatgattatctcagacacagggaaagcttttgataaaatccaacaattttttgtgataaaaaccctcaagaaactaggcatcaaaggaacatacttcaaaataataaaagcaatctatgacaaacccacagtcagcatcatactgaatgggcaaaaattggaatcattccccttgagaaatggaacaaaacaaggatgcccactctcaccactcctattcaacatagtactggaattggtagccagagcaatcaggcaacagaaagaaataaaaggcaaccaaataggaaaagaagtcaaactatctctcttcatggacaatatgattctatacattgacaaccctaaagactccaccaaaagcctcttggaactgataaatgacttcagcgaagtttcaggatacaaaatcaatgtacaaaaattagtagcagttttatacaccaatagcattcaagctgagggccaaaacaaaaatgcaatccgatttacaatagccacacacacaaaaaaatacctggaagtacatctaaacaaaagaagaactacaaaacactgcaaaaagaaatcagatgacacacacaaatgaaaaaacattccatgctcatagattagaagaatcaatatcattaaattggccatgctgcccaaagcaatctacacttttaatactactcctatcaagctaccaacatcatttttcacagagctagaaaaaaaactattctaaaatttatacagaccaaaaaagagcccaaatagtctaagcaatcctaaaaagaaagaacaaagccagaggcatcacattacacaacttcaaactacactatatgctacagtaccaaaacagcatggtactcttacgaaaagagacacgtagaccaatggaacagaatagagaacccataaataaagcctatgccatctgatgtgtagaacacctaaagccatctgatctttgacaaagttgacaaaaataagcaacagggaaataattgcctattcagcaataaataggactgggatagctttccagccatatgcagaagaatgaaactggatcccatatactacaattaactgtatacaaaaattaactgaaaattgattaaaaatttaaacataagacttcaaactataagaattctagaagaaaacctaggaaacaccaatctggacatcggcctggggaaagtattgatgactaaattctcaaaagcaattttaacaaaaacaaaaaatgacaagtggacctaattaaactaaagagcttctgcacaccgaaagaaactatcaacagagtaaacagacaacctaaagacagggagaaaatgttcacaaactgcacctgacaaaggtctaatatctagaattcacatgaaacttaaacaattgaacaagcaaaaaacaaataatcccattaaaaataggcaaaatacatgaacagacacgcctcaaaagaagacacacaagaaacatgaaaagatgctcatcatcactaatcatcagagaaacgcaaaacaaaaccacaatgagatagcatctcacaccagtcagaacggctgtgactaaaacatcagtaaacaacagatgttggcgaggctgtggagaaaagggaatgttcctacactgttggtgggaatgtaaatcagctctgccaatacagaaagtagttttgagatttctcaaagaagttaaaacagaagtgtcatttgaccatgcagtctcattaatgagtatatatcaaaaaaaaaaaaaattctaccaaaaagacacatgtactcacatgttcatcacagcactatttgtgataacaacatcaaggaatcaacctaggggcctatcagcagtggaatggataaagaaaatatggcacatatagactatggaatactatgcagccatagaagagaacaaaattatgtccttttctgcaacatggatgcagctgaaggccattatcctaagcaaattaacacaggaacagaaaaccaagtcctgaccattctcacttataagtggcagataaacatccagtactcacggacataaagatggcaacaacagacaatggggactactcaaggggagagggagagggtggggcaaggtttgaaaaactaactgttggctactgtgattaatacctaggtaatgggatcatttgtatcccaaacctcagcatcacacaatatatccagataacaaacctgtgtatgtacccccaaatcaaaactaaaaattgaaaaagaaaaaaaaagttttaaaggcaaatcctccattgatatacttactttgttacatataacgccatagacaatttattcccctcccccgcccaaatttgtttgccgaaacgtaatccccaatgtgacaatatttgaaggtaaagccttcaggaggttatttgttcccttataaaggaggccccagagagatcctcctcccctcccaccatgtgatgacacagcaaaatgatgaccatctataaaccatcatgcaccaaatctaatagtgccttgatctttgacttcccagctcccagagctgtgaaagataaatttctgttgtttataagctatctagtccatgttttttttatagctggctgaacaaactataatagatgacttataagtagttttcacactggccttattccacagaccagtctttgaatagtaatgactaaaaaaattaggactttttgtctctcaatgggttctataattagcaaccacaataatgtttcaagtacccaaaaaatgtcatataatgcaatcacttaaaatgaatataagcaaagaatatttactgatgtgctgagtttcttccatacattaatgggaaaaagcatattagaaaacagtatgatcccacttttattaaagaacaagagcaggtttaaagagtcagaaagtataatagtggttacttctgggtaatggacttataaggattttttttcctttgttgtttatgtttcattagctatatatgctaattttgtacagtggtcatatatttcttttatctaaatattaggactcattgaaatggattactattttaaaattgattattcattcaatatttttatatttcaatctagggtctgttactgagtccctaagtgcttttataaatggctggataggcacctctgtaaataaagtacgtagccttagaggctgaaacaatgtaagtgcacaggaaacatttattgtaagaaaatgaaaggagtgaagttctttggttcttatttttaaagcattatgtgtcaaaaatgtatttggttgagtgtcatcaatttcatgtggcctaacctaatgttaagtggagttacagctaagtaaaatgttctgtcccgctttgagttaacaatcaatcatgtgcttacactaaatggtggataatcattacttttatttattttataaaaatgtagtttggtatctccatttagaaaaaaaattacttcattaaaatgaatcaacttaaattgacatgggcttgttactctaaatttctacttgatttccttattgtaaattatcttcaataaattaatccttatctccctaggccaggtctttgacatgtctggaacaaaactcagccaaatattaaaatgggaggacagaaacagttcaactgaaacatattagcaaaatctaagttggatgaatttatgctttttaggatgcagagcactcatgaaattgacatttgtaaagcagcatttgtagcatattgattaaaaatattcaatatatggattttttaaacagtgaaccactcattactctaatgcctcattaatatggtgtcaatctattcagaacaatgcataatagcagtgcactttctcagcatgttattctattgttcaatttgaaaaacaacaacaacaacaaataatctcaagccttttccttaaatgttgggggtttgtttttcaaattatatgggttttgtggtactagaagttcaaattttactaatgtaaactacatttctctaactaaagaatcatggtcaatgtagagaaaattattattatagaagaaattgaatcagaaaaacacctttcaaaacctcctaattccctgccctgtccacaaaagagatggaaggcaaggaggtcaccacaagacactcagagcagcatttgctgcagcaactaaaataatgggagactcattccgttcttccttatttacctggaaatataagtaggaaaagatattttattttataattaaaatattttattctaatatttgctagggacaggaagatagaatagggaggaaggcaaatatatgatgcccgatggattctttggaataaaattccatagggaatgttcctagtattaggaaaaatcatttttaacatatagtaagcaagttacttgggatgtcataagtaggatagaagtcatatgaaagttataatagaagtccttttttcttagggtaaataaatataagtaggaaaagatattaatttttttatttattaaaatattttatttatataaaataaaagtaggaaaagataccctcaaaattcatctcactgtgccagcagggagccgttgaggaaaagtctattttcagtagggaagcttggaaagagctggccaagttgcaattctctcaagaaagtaacacctgcagagagcacacattactcatatttgggatactcatgacacatcatctagccccctcctccctgcatgttagcacacggtgagcacacccactttccagtgacttcttggtgttttgcttacagaagcctacattcagcatatgaatcatctagccctccgcaagaggctgcctggaaagaataaggttttagagaaccagccctatggattgatcattggttctgaccacacaactattatgacaagtgaaatagaataacaacaaacggctatgatttttgtctttgtggatggatttcatgggggggagggcagcagtagaaagtataaatgacatgaaagaaagaatattaagctccaaaattgtgcttaagtaaatctggaataaaaaactgcagcaggttcttattgctcaattccagcccatttgcagagaataaaaaggcaaagcaatgtgggtgaaaagcaaggaatttgccaccttagctttgaatactatttcatttatgagtttaactgtttccccaccagccttcactaatttcacttgatctccatcaagaaagatggagaaggttttgatgagcaaggcagcactgacaaaattagatgtaggattaaaaaagaaaaccaatccacaatgtaatgaattactaaatttaaagacaactagtgaattcctgggcaagcatgatggatgcattcaaacatagattcttgaatttgccacaatcctatgccccatagctatgacttttcaccaaaaagcaaatttttaagagccaaatttgccatcgatgtgagtgggttgcatcttatagtctttgaacaaaaaggacaattataggtacattgagttcctggttccttggaaactaatggtttcattctctgcagattgatcacgtcaaattcatcaggttcatttccaaaaataaaaatcccctgtatgagggaaattgtggatttcatgtcagtcttctcaggaaatatttattttatttcaaactataattccagttgatctgcctagcagaaacaagtgaaattgcttctgttatcattgagatagagtgatttccattttcaaatattccaaatggcatttacttgtggtaactgtaataatagagtaatacatttacagcaatgtgatagcaatatagaactactctgaaacacatgctgtatatctcatttctttagcctataagatatcaaaatgccaaacattacatacatatgtaattctcctacttaccacattccaggtaacttgcttacactgtatgttaaaaatgattttttcctaatactaggaactttccctatggaatcttattcaaaagaatccacctggcattatatatttgccttcttctctattctatcttcctgttcctagtaaaaaaaaaaaaaaaaaaaaagcaccgattgagaaggaagtgtggtaaggaacagaaaatagcatcatctgtcttcacttacagaaaggccttgcactgtaagtattcatcagacatttgttggatgttttccataatcacctcatacctgtgaggatggctattatcaaaatgtcaagagaaaacaagtgtgcacaaggttgtggagaaaagagaaaccttgcacactgttgatgggagtgtaaattgctagagccatagggaaaaacagaatggaggcctctcaaaaaattaaaaataaaactaccatataatccagcaatcttttatctgggtatatacccaaaggaaatgaaataagcaactccaagggacgtcagctttccatgttcattgcagcactattcacaatagccaagacataaaaacaatctaagtttctgttgattgaaaaattgattaaaataattagggtactatgtatatatacaatggaacattattcatccttaaataacaacatggatgaacctggagaacaagacattatgctaagtgaaataagccagacacagaaggacaaatactatatggacttacttgtatgtggaatctgaaaaaaaaggtgaatacatatagaatattgataaaagaaaaagttaggcagaattaaatttaaagtttaattgagcaacaaacgattcgcaaatagggcatcccccagaatcacagcagattcacagagactccagcacagccacgtagtgaaagaagatttacagacaaaaaaaaaaaaaggaaatgacatacagaaatcagcagtaaggtacagaaacaactagaatggttacagcttggcatttgccttatttgaacagtttgaacacttagcagtctatgagtggctgaagtatggccactgggattggccaagactcagttattgttacaggtgcatactcctaagcttggttttcagttttgtctgacttttaagctaggttacagttcatccacatggactcatatatagaagtatggagtccttctcagaccatatttagtttgctttaacagtataatggtgcataccatggacagggaagaggaggaaatgaagagacataggtcaaagggagcaaacttgtggttatataggatgaacagaccaagagatctactgtacagtaggaggactatcattaataacattgtattgcaatactgaaaatttactgagagtagatgctcttactatagaaataaaaatatggaaagtgatggatatgttaaattgcttacctatagtaatcatttcattatggctatgtatagcaaaacctcatgttatacaccttacatttatacaatgaaaatagtattgtaccagtgttaatttcttagtttggcaaatgcaccatggtaatctaagatgttacagtagggcaaattgagtaaagaatgtacaggaactctctgtactatctttgctactcttctgtaagtctaaaattatcctaaaataaaatggttctgcccctaacaaacttttgtcatcattttcactgccccagaggatcagactaagttacctccaaggctccttttaattttaaattgacaatttatgattcaagtaaggatcacttcctgtgtgaaacattattttatttatccagctaaatacaatattgctttttcagttcccttctctttttcttgtcatgctctctatgttatacatctatgttcatgtcttatggctcctattatatttgctagttctctaagcgatgctgcatttttaacttgatatttcctacagccctatggcagtggcctgcattcaggaaattccctctaaaattgaatgaattacaaaagcaatattcctgccaatgaaaaggttttgtactatgaggaatttaccagtttttcctctcctgaatattaaagaccctctgccagaagtagcttaaggaaacgactctttcccattctctattcagatcctctccacttttggtttctagcccttcatcctgtgttggccaaaatgatttgactactttatagaaagctgtcgttttaccaagaacacaatttttaagcctttccatccataaatgtttcatttaattcttaaagtttaggccaggcatggtggctcatgcctgtaatcccagcacgttgggaggccaaggcaggcagattgtctgggctcaggatttcaagacctgctagggcaacatggtgaaactctgtctctacaaaaagtacaaaaattagctgggtgtgtcgtgtgtgccaatattcccagcaacttgggaggctggggtgggaggattgcttgagcctgagaggttaaggccatagtgagccatgatcgcactactgcactctagcctgggtaacagagttacatgctgtctcaaaaaaaatttttttttaaataaaaaaactaccaagccagcactacaagaactgctaaaaggagctctaaatcttgaaacaaatcctcaaaatacatcaaaacagaaccccctcaaagcataagtctcacaggacctataaaacaacaataaagaaaaaaaaggtattcaggcaacaaatagcacaatgaatagaatggtacctcccatctcaatactaacattgaatgtaaacagcctaaatgctccacttaaaagatacagaatggcagaatggataagaattcaccaaccaagtatctgctgccttcaagagactcacctaacacataaggactcacataaacttaaggtaaagggatggaaaaagacattccatgcaaatggacacaaaaagcaagcaggagtagctattcttatataagacaaagcaaactttaaagcaacaatgttaaaaaaaataaagagaaacattatataatgataaaaggccttgttccacaggaaagtatcacaatcctatatacatatatatatatatgcacctaacactggagctcccaaatttataaaacaattgctactagacctaagaaatgagatagacagcagcataataatggtgggagacttcaatattccactgacagcactagacaggtcattaagacagaacgtcaacaaagaaacaatggatttaaactataccctggaacaaatggacttaacaaatatttacagaacattctccccatcaaccacagaatatgcattctactcatcagcacatggaacattctccaagatagaccagatgataggccacaaaacaagtctcaataaatttaagaaaattgaaattatatcaagcactctctcagaccacaatggaataaaattggaaatcaactccaaaaggaactttcaaaaccatgcaaatacatagaaattaaataacctgctcctgaatgatcattgggtcaacaatgaaatcaagacaaaattaaacaattatttgaactgaacaataatagtgacacaacctatgaaaacctctggggtacagcaaaggctgtgctgagagaaaacttcatagccttgaatgcctacatcaaagagtctgaaagagcacaaatagacaatctaaggtcacacctcaaggaactagagaaacaagaacaaaccaaactcaaacctagcagaagaaaggaaataactaagataagagtagaactgaatgaagttgaaacaaaaaagcatgcaaaagataaatgaaacaaaaaactggttctttgaaaggataaataaaactgatagaccattagtgagattaaccaagaaaagaagagagaagatccaaataagctcaattagaaacgaaaaaggagatattacaactgacaccacagaaatacaaaaggtcattcaaagttactatgaacacctttatgtgcataaattagaaaacctggaggagatggataaattcctggaaatatacaaccctcctagcttaaagcaggaagaattagaaaccctgaacaggccaataacgagcagtgagattgaaatggtacaaaaaaaaattgccaacaacaaaagtccaggactagacggattcacaggtgaattctatcagtctttcaaagaagaattggtaccaatcctgttgacactattccacaaaatagagaaagaggaaatcctccctaaatcattctatgaagccagcatcaccctaataccaaaacggggaaaggacgtgacagaaaacaagaaaactacagaccagtatccctgatgaatatagatgcaaaaagtccttaacaaaatactagctaactgaatacaacagtatatcaaaaagataattcaccatgatcaaatgggtttcattccagagaagcagggatggtttaacatatacaagtcaataaatgttttacactacataaactgaattagaaacaaaaaaaaatcttaaaagtctaggctttctgcctttactacacagagttgatcaacttcatctgctactttttctagctctaaatctgattcacaatcattacaacccaggaaacataataggtgcaacactcttttctgactctttaatagattgtttccatttggaaaaaaatctcatttatttgttggatatggaagctgtttcataaattttccagatctgagtgagaaaaagaatatttaagtgaagattacccataaaattttgaaacacacatccctttttttttcttggtagaagaataagatttcaaattttattttcaaaaacccatcatagaaaataatttttgttttctgtatgcctagcaaggagaaaatctagatccagatttagaaaatctggaccggctaatttttgtatttgtagtagagatggcatttcaccacgttggccaggctggtctcaaactcctgacctcaggtgatccactatcctcagccttccaaaattctgggatgacaggtatgagccaccacacctacagcatgggtgacagagtgagattcagtctcaaaaaaaagaaaagaaaagaaaatctggaccatagtctgacatacttcctaattgcccggagaatttatgaatttatattgagtcttaacagtgaggccttagacagtgattcagtttcctcagtgctagtaatcaaattctattgcttgtgacaaacacagaagataactttagcagataatataacatagcagataactaagtgaacaaatacacttttctatagcaagcataatctagcaaatactaccttgttttttattgtgtaagaacacttaacatgagatctaccctcttaaaaagttaagtgtatatttgttttgttaactataggcacaatattaaacagcagacctcaagaacttatgatcttgcataactgaaactttatagcctttaaaataggaactcttcattttctcttccccccagcctctggtaaccacaattctgctctctgcttctgtgtttgactgttttagatacctcagataaggggaatcatgcaatatttgtccttctatgactggcttatttcacttagcaaaatatcttcaagtttcattcatgtagttgcatatcgtaggacttcctccttttaaggctgaataataacccattatatgcatataccacattttcttcatttattcatccatcagtggacatttcattgtttccatatcttggctattgtgaataacagctgcagtgaacaagagagtgcaaatatttcttcaagatcctgatttcaataattttggataaatacctagaaataagattgctggatcacatgctatttctatttttaattgtgtaggtacctccacatagttttcatagatgcagcaccatttttcattcccaacaacagggtaaaaaggttccaatttctccacatccccaccaaactattatcttttgtgccatcccaacagttgtgcaatgataagtcactgtggacttgatttgcatttccctgattgtaagtgatgttgagcatttttccataaggttttttggccacgtgtatgtcttctttagaaaaaaatgtctatttaaggactttcccattttttaatctggttatttctatacttttgctaattaagttgaaagagttccttatatattttggttattaaccccttatgagatacatggtttgcaaatattctcttccattacatagatcgtcttctcactataataatcatttcctttgctgtgcagaaactttatagtttgatatagtctgttgtctatatagtctgttgtctatgtttccttgtgttgcctatgtttttggtgtcatatccaacaaatcactaccacaaccagtgtcatgaagcttttctcctatacattcttctaggagttttacaatttcatgtctcgtgtttaagtcttcaatacattttgaaataatttttatgtagggaaagataagggtccaatttcattgttttgcatgcagatgcccagttatctcaacaccattggttgaagagactctcattttcccattgtgtgtagtcttggcatccacatctaggatcaataaaacatatatgctcgtgttaacttctatgctgtctattctcttccatcggtctatatgtctctatgctagttgaattttgattactgtaactttgtaatatattttgaaatcaggaagtgtgatgcctccagctttgttctttttcaagattgctttggctattcagaatcctatgtggttccatattaattttagaattattttatttttctatatcagcctaccttcagatatcaacacttccttctgtcagataatatttgcacatcctgttctctgtagcctggaatgctctcctcctctcttttcactgccaccattataccacttatacctgcttaactgctatccatcagatctctgctgaaaagtaattccttagaatgtttttcagtaacactgttcacctccccactgccccttcccccccacacacacaatacctgaaatctctgcctacctaaggcaggtttttcctgagttttttctcaatggtataacatttgggactttgataggaagtatgataaatttgcagattgcacaataagaagtaaggacatttgaacaatattaagtcttccggtccatggtccatgtacacaggacacctttccaattgtttgtgtctttttctttcattaatgttttgtggtttttagtacaagtcatttaccactataattatgtttattcctaagtattttattctttttaatgttattgtaaatgggactgttgcttaatttccttttcagatattaaaaatgattcattattaatatttagaaatgcagctgattttgtatgttgattttgtatcctgtgactttgctgaactcatttgttacttctaacagtgttttttggtggaaacttcagggttttctatatatcaggtaatgtcatctgcaaacggggacaatttgacgtcctctttttcagtttgaatgccttgtgtttctttttcttgcctaattgctctggctaggacttccagaggagaagtacctaatgtagatgacaggttgatgggtgcagcaaaccaccatggtacgtgtatacctatgtaacaaacttgcacgttctgcacatgtatcccagaacttaaaacataatttaaaaagaagggtggtaaaagtgggcatctttgtcttgttctggattttagagaaaaaactttccattttcagcattgagtataatgttaactttgagcatttcatgtatgtcctttagtatattgagttagtttccttctattcccaacttgtttagaatttttatcataaaagggtattgaattttatcaaatttcttttctacatttattgagatgattgtgtggtttttaccctttattctattaacatggtatatcacattagttgattttcatatgttgaatcatccttgcatcccagggataaatctcacttggtcatggtgtctgatccttttaatatgctgttgtatttggttggctagtattttgttgaggatttttgcatctatgtttatcagggttattggcctgtagtttgcttttcttacagtgtctttgtttggcattggtatcagagccaaggtattttacttggtattttaatatttggcctaataagatgagtttggaagtattctgcttcctagattctttggaagaaattgagaacatctttaaatgtttggtaggagtcaccatttgacttttctttgttgaaaagtatttgatcactgattcaatgtccttactagttataggtcttttcagattttctattgctcagtaattcagtcttggtaggttgtatgttcctaaaaatacagccatgtcttctaggttatccaatgtactggtatataattgttcatagtagcctcatgattctttttatttctatggtatcaattacaatgtctctgcttctgttttcatttatttgtattctctcttttttccacagttatactattggggaaagttatactaatatcttgttaatcttatcttttaaacaaaccaattcttttattaaattttaaattatttttctattatatatttcatttggttctgttctaatctttattattttcttccttctgctaattttgggcttaatgtattctttttctggttctttggggtgtaaaattaggttgtttacttaagatgacctttttcctatgcggatgcttccttccatttctcctgcccttggacatcagactccaggttcttcagccttcggactcttggacttgcatcagtgctttgctcggggctcttgggcctttggccacagactgaaggctgcactgtcggcttccctgcctttaaggcttttagcctctgactgagccaatactggcttcttttctccccagctcacagacagcctattgtgggtatttgccttttgatcatgtgagacaattctccctaataaactccctttcatatattcatgtatcctattagttctgttcctctggagaaccatgaataatacagcacataactggaacttgaggtttttaaaatccatttagctatttctaagtcttcatggagagtttaatccatttacctttaaagtaatcattgctaaggaaggatttactattgccttgttgttaattgttttctgtctgacctgcaattcttttatctctggttatcttcctttgtattttttaaaattttttatattgatattttatattgaaattttatattgatattttatgtaggtattatctttgtggttaccaaaggtttacataacacaacttttattatgttatctattttaagctgataacaacttattttcaatcacatacaaaaatccctgcccccacatactttgttatattattgatgtcacaattcacatgtttttatattatgtatcttttaaaatatttttataggtgtggttatgtcagtacttttctggcttttaacttttatcctgaaagtaaaagtaatttacacagcaccattacagtattacagtgttctgttttgtctatatatttatcttcaccagaaatttttgtacttccctttccttttgttctgtcatttcacatcattttgtttcaacttaaagaactcccttaagcatttcttgtaaagcagttccggtagtggtgaatttcctcagcttgtgtttctttgggaaagtcattatctctccttcatttttgaatgatggtgttggccatatatagtgttcttagttgacagattttttttctttcagcacttttaatatatcatcctgctctctagtgacatgcaaggtttctgctgagaaatctgctgacagccttatgcagattccctgtatgtgataagtcatttttttcttgttgctttcaaaattctatttatctttggtttttgacaatttgattataatgcatctcagtgtggatgtctttggatttatcttatttggagctcttaggcttccttttttcctccagatttgggtaatttccaaccattatttctttgaataagctttctttccacttctgtctctcttcttgtgaaattcccataatgcatatataggccacttgatggtgccctataagtcccttaagtgagcttttatcactctttttcatttttttctttttgttcctctaactgaataatttctaatgttgtgtctccaagtttgctgatcctttcttctgcttgatctagtctgctgttgaatccctctagtgaatttttttagttattgtattcttcagctcattgatttctgagctggtttcttggtagtcttttttaatgttttctatttctttgttgaaattctcactttgttcatgcatgttctattgacctcattgagcatctttctgatggttattttgaattttccatcagagacataatatatctccattgcattaagtttgatttctggagattaatcttgtactttgttttggacatatttacctggttgtttttcccttggttcttcattttagtatatctggatgttatacaaaacagctacctcttccagccttcatggactggcctcaaacaaaagaagaccttcacctatcagcctgaccagagattctgggggcttctcaaatctgtatgctaggcaaaaccatcagctatgttcttagtagctcccagatgtctagaatatgctgggactcatctgcattctaagacaagtgagacagaagccagttcctcaggcaatccctggaaaaattgaaacgttaaatatgtgatccaactcttttcttcctcaggaagtagatgagatctgtcgtttttctcccacttgctctgtgctgagcaagaccctcccaggtctgtgatgggggccggcatgctagttcaaacagccatctttatttttagtagctccaggtgtctggaaaattgctgagtctcatttgcactctgagacaggtgagacagaagtcagatccttgggcaacccccaggaaaatcagaatgttgaacacataatgtagttctttccttccctctccggagagaagctgggaactgggggtttcctcccaagcatatagcaatacactgagggtggggattatggttagaggatgtctcaaagtttcctatcagcttcagtgtggttggttttttgttcacttcagatccaagagcttctaaactggcttctgaatttattgcaaaaggagttgacctgtgtattggttgttgaatcactgggtttatgatgggaacgaagatccaagtcttcctattctgccatcttgctgatgttactgtcctctaattcttgaatgccttctatgtaacagagaattttcatgcacactatctcatttacttttcttaaaattctgaacaccaagttgacaaaaactaaatcgtaaagtataagatttagtaaaaatgtaggctcaaaatttttaatcacaaagctggtaagaggatttgaactcaggtacccaaagcagagtgtagtgctcctctacccagggtgtcaaggagatgtgtcaatgtgtagcacatggtttatgttccttgggtttatttaaagcctctgagcctcatgtgtgtgttgctgtagtagtggaaaccactatcttgctaagaaggcttcacattggatggacagcaaattaccttttccattcattcacctattttcatgctgaaaatacttctcaatatttttgagtcaataaacaagaatgacttgttaaggctaggcttaccctagatggctcaggatcttgctggtggaactatttatgcctgcaaactatgaaataaaacttttgaaaactaaggccttgctaccagcatgtgtcttgtggatcagcagcattagcaccacatagaagcttattagaaatgtggaattgcaggccgtatcccagacctcctgatttcatatgcctttttgtttgaaaaagccctactctaaagcacaatatacattttgatgcttttctcatgatgtaataattttctagtatgtttgtgactaaatgcagtcaagaaagccctcaatttcttatttttctatgttcccttattttaaaataataaataatgaagagagtcttcattgcctgttagaaaacaatcacttatttacaacaatagctttacaagtccagcaattcatctaaatgcccaatttgccctgtagctctacagcatgcccacagagccaacctaggtaagctatattctttatgggaaaaaaagagaaaaataagttgatttggtaagtttttgaagttgaaacattgtaatggaaatatcactggactgggttcaataagacctacgtttaagtaagaattttccttgaaccatcaagatattcttggacaggactctttccttttctgggtcttgggtttcctcatgtatattaagaagttggcataacctgtgctccaaggtcttttcccacgcagaacatttgctaatttttctttaatagatctctccttgttccccttgtaaaccaaaaataaaattctcaggccccaaccatctaaatggacttcctcttcatccagggcactcttaaattttaacttgagacaccagttcttgtcatgacaggaagctggaggtcagacatgcctcactctacctctctggcattaatatgaatacagactttaagcctgataagaaacattttacagcccattctctctgaagcctactaactgaaggtttcctctgcaaataagaactttggtctccacaattctttatcttaacccagacatttctttctattgatcccagatctttacataaactcaaccaattgtcaagcagaaaattttcaaatctacctgtaagctggaagcacaagctccaagttgccctgccattttggaccaaaccaatgtatttcttaaatgtatttgattgaagcctcatgtctccctaaaatgtataaaccaaggtgaaccacaaccaccttggacatatgtgctcagtgtctgccaagggctgcgtcacaggccatggtcactcatttggctcagaataaatctctttgaatattttacagagtgtgactctttttgtcaacatcttcatctcctcccccactgctatttcctagtccaagtccttcatttattgctatagcttttttttttttttttttttttgacagaatctcgctctgtcgccaggctggagtacagtggtgcaatctcggctcactgcaacctccgcctcctgggttcaagcaattctcctgcctcagcctcctgagtagctgagactacaggtgtgcgccaccacatctggctaatttttgtatttttagcagagatggggtttcaccgtgttggccatgatggtctcgacctcctgacctcgtgatccgcccgcctcagcctcccaaagtgctgggtttacaggcgtgagcaaccatgcctggcctgctacagcattttaactagtctcctgattcctgctttcttggtttcctgcttcctcagttcaactagtattcctttgttcccaaaagaaaagctgaccatgttcatctcatgcctggaacactttaacagccccaaggctgtttctgttgcttgaaggtgctatgctcatcttctgtccctaaccacactgctactttccatcccctcttgcctgaaatataccacacacaccagcctctttacttagcttaatgttgctcatcttttttcttttgagacggcatttcacccttgttgcccaggctggaatgcaatggtgcaatcttggctcactgcaacctccacctcctgggttcaagtggttctcctgcctcagtgtcccaagtagctggaattacaggcatgcttcaccatgcccgactaattttgtattttttcagtagagaccgggtttcaccacgttggccaggctggtctcaaactcctgacctcaagtgacccacccgcctcggcctcccaaagtgctgggattgtaggtgtgagccaccacacctgcccttgctcatcttttaagtgtcatcttcaccgtcactggtaaaatactcttgctgccatggtgctctgtgcttttagtcataatatttgttgcttcttactgttattgcttatttgtaacttatctctgtgagggctgagaccagtgttccgtgctcacaatcatgttcttgtagataataccaagtaagcactaaaaataattgcttgaattgcctatatgaattcttgtcttctacttccattgttgattaaataataataagctctaaatattgctttaaggaataggcataattcactcaagacatgtagagaaattcctggcatatattattcacttaatgtatgctagctattacaattgttattattcttttctctctttaattacagcagtcagtatgggcttaattataattacctgataactaaaaatttctttcttactttgaagctaaatggaatacttaaaaatgtagatgcattaatcaattaaacaaatgcatcaggttaatagtatttcttattccaatgaaacaaagaatcatattgttatatactatatatataactcatcatattattataaattatgcaccaatatatttgcaaaataatgcattgaattattattaaattcttctgcaaatggtgtgtgatttgttttctcaaagcttaacttaatgggaaaggcttgagagaaattgtcattgtaaagaaaataaatcctggatacttatgacctaaaaggaaatctggcatgtatctcttaatattcttagaaattactcaaaggttcagcttttattaattcataactcttcaaagttatgaatcaatagatcctaaactccaatctcccatccaatatttgaatctctgtggcaccatcttagcccggtgaatgaacagccactgcatggaaagggagaagattaaagctctattagttcccatagcaacatatgatttattaaagttttatctatgatttttttaagaatgcattctctgcaaatcagaaacaaattataacatagtcatagaagaaaaaatgaagatggatggtggataaggaaacaattgagatatttatattagtttccttctttgtcaggcattaaataattatacaggtaggagttataaccagaaaagatgcaaaatatcagtcttattctatcaccattatatcattcaatattactcttattcccaatttacaagctttcttcattgtctcctagctattctttgttgatattctttctctccatctgattcctccttcctccctttttactttcatgcttctcttcctactagctctctttgtttgtccaggtattctttcatttctataatacaataatatggttttaccttaataacccagaaactgaactataataataaaaataaatactctgacacaggaggggtaggctggacagccacagtgagaatatgtggttaaaggctcaaaacatgtaggctggttatgtggatggatagataaatttaattttacagatatttctcaagttccaaacagtaaagtactatgctgtatactgtgatagatgataggtgaggtctcattttctgtacttcaatggctaaaatctcccagaaattttatatacagaactaactaaacatagcacaaaggagatggtaagaaacaatgcaaagagaggaagaagtgagaaaaaagaggcacagcagaagagagaaggggaatcttatgcagggaggaggaaatagaaataaagtagttaacaaatggaaaattaacatggactacaagaaaggcatgtttcagaacttcaagcacattaacattggttttttcaaatcatgtggatctaacacacagccactggtgaaaatgctgcgtgctatgactttattcagtttttttgttttgttttgggtttttttttggagactgagtctcactctgtcacccaggctggtgtgcagtgacacaatctcggctcactgcaagctccacctcctgggttcaagggattctcctgcctcagcctcctaagtagctgggattacaggcacatgccaccacgcccagctaattttgtttttttttttgtatttttaatagaggggggtttcaccatcttggccaggcaggtctcctgacctcaagtgatctgcccaccttggcctcccaaagtgctgggattacaggtatgagccaccgtgcccagctgactttatttagtctttattataaattgaataaaacctttgtaaatagagatattttgtttgttgtaacctgtgtggattattgtaaattagcatgatatacttgtttcagaccaccaataacagccatcttatgaacagaggctttcaaataataggcaaatgtgtgaaaagagacttaaacatttctgtaaagaattctatgaaaattttcaacattgtcattagaacttgtaccattaaaattttctaataataaaaatcatttttaaaaattattttaatgatgctaaatttctatttttcactttttgaaatacatatggtagcaagcaataagaaaatatttaatgatgacatgccaattaacaagttcaatatgtcaagtaaaagtaataatgtttccttaacaccaaatagcacagcatgatttatataaatgcccatccttccaaagaatggaatcctttcacttggtgcaataagttgaatactgtctttttacagctgttctcaaagacaaagatatttttgagcttcatttataaaacataaatatcatattgttgttccagccttcttgtaattcaaaatagcatcagtgctggctgaacatattactcatgcattggaaagttagaaatggtgacaatttgaagttaacattgtgaaatgaagatgaacgtgcaaaatgttctagctatattctgttttatgtgaataacctgaacatatttcttctttatatattggtttaagaagatgttataaatacctaacttggggacagaagaattttagtaaaggagaagagacatttaaaattacttctacgtcttactctaagaacaatctgccaattagtagagttgtatgtttccaggtacacagccatgtgtcctaagattcagacagaaggttgtgagtttacaggaagaaagaaatcgattctttctggggtatcctaaaggcttctcacagaaagtggcacttgaatagtgtcagatatttgaagcagggacaggatatttcaacaagaaggaatgcataaataggacatagacagggaagcagccggggcatatggagactggggagtttggctatttaatggggttcatggaggttgtgacagagaagtagtgtcagataagatggatggtaaataggggactaattgtggaaggttttgagtgctaagctaagtaattcagtttttatttggtaatgaataagaaaccccatggttttttttcccccaagttttaaaatgctgaatacacacatgatcagagctggctatttattggatacttagaatgcacccagctatgttaggtggtttataaatattatccaatatgatcatcacaaaagtatggttgaaagaagtattaaccccatttttcagatgagagaactgagtctcaggctatataatttgcctgtgtacaacaatctaacaagctgatttttttaatcaaaatctttttgttcattactctacataatcctgttgttttcataattctattgttttaacaaaatcctgttccactataatcctgttatgcttcataatctagtattttgaagaagataaaaatagaaaagattgagaatatgtcagagactattttaatagcgcaagaagtaatcattctgattcagttatgtttgtcactagttcaagtaacggcaaatctgagttaccatggtttctgaaaaaatgcacattgaaaaattgtatgatggttattttagatttttagcatgatgttgaggtttcctatgcaagggaaattttaaatttgttttttgcctgttggatttcttatgttattcagaaagttttgcaatgcctataatgggaactttcctagtaatatgcattaaatgtaatttccacctttttagaccatcaaaattaagcacatagtgtgtgtaacatctaaactatggcaagcaccttaattacatttttcctcttaatctcacaacaaccttgtgatgttggtgtccttctcccattttatagatgaagaacctaaggctgagagaaattctgtctgtatacgatgcaaccaacgttcatattcagccctatttgtctttaaatcactactgtttccactacagccaactgccctgtaactcctcatgtaataaaaacgactgatcttaaagtgataattcatatttcatgattgaaaaagaataaggaatcatccgtggcacaaacctgaaatgcagggagtgtagaatctatgttaatacataggctttgggatcaaaggaatgtgagattaacgctcatatccaccatcttaaagctgtgtggccttggatgtattacttaatctttcagaggctcgactgctaatctgaaaagtgcaaatagtaatatctacttcagggagttgttaagaggattaagtgaaataatgcctaaaaagtacttaacacaaagtaggctctcaataaaagtaagctctaggtgcatagcacactatgctatttccttgattctcatagcttcatctctgagtcaatcacttccaaatattaggtccaaacctctcttctgaattctggatccgtgtatcccatcacctacttggcatctgcacttggatgcccacagtcatctcatactttatatatatcaaactgaactaatgatatatgtcaccctccttccttccctgctagtatgtgctctcctgcttttatggtagtgaggtaggggtgagtgtgtgtgtgtgtgtgtgtgtatgtgtgtgtgtacaaaatcaacactgtaaccagcccacaactaatccattcttaagtcactcagtgctaagggatatgccttctaaattccccccaataccaccctagtcctagtggccatcatttctctcctaactaatgcagtcatatccactgctgcctatactcaccaaccagttagccatactctaaccagagggaccttcctgccccttgagttttaagattggcttaaagtcttattccactttgatggaaatccaaatcccccttggagtttttgttaatttggtgtaaacattcattcttataaattcttcttccctcaggagccaacttccacaaatactgcttctgtgccctaacacctccaggtgaaacccagccctttctacaagttccatggatgatccactcatacaaagcatttgtgaacgttgggactcagggtgacggagaactatttgctattcagaatgtgaactccccaatggtgcattagatatttccagtcttgaatgtcctctgccctcctcaccatctggatgtttccattggcagattgccccttcttcatcccagcatcatatcatcttgggggctctcatcttataccctttttttattccagatttctttattctttattctttattcaaatccgttgtaatttgaatcccagtttggatgtctggtttttgtttgcttgcctaggttcctcaattcaccccatcagtatttccttctatcccaagtggttagttaccaagtatttttccaataaaactttccacccccaataggaattctggagccagcaagtaacatcataaagtttttgcttctattacagaaggtaaatcagatcatcccacacccctgctgaataacccataagtgtcttcccatcgcctttagcataaagcctctaacttttttagaagggtctacaaagtttcccatgatgccacctctactggccattcaaatgttattttggtttctcatccacattgtgctttctccagcacccaggccttcacattcactgtccttaggtcctgttctttctctccaactaatcatcaggtcaactcttaccagcccataggtctctgcctaactagcacttactctaggctgcagccacctgctaggagctccttgatcatcaaatatttcttaacaatgctttttccacttgcaattatctagttatttaaaataatgtatttcctctctctccacagactcaaaacaccactagaacagaaaccagatttcttaactgtcatattctcagcaagaagcatacagcaggcactcaattgttaaaaactatctgaagtaaacattgagtcaagcatctgtgtaaaggattgccctaaatctcccttaacttctgggctttaatttattctgcctatatagggatcagtctttcagaagacccagaaaaccttagtgaaggtggagggcttattaaactatttgctttaaagttctgacaattttgttgttgctgatattaacaacccaacaagaaggggagttaaagggcagtgcttacaaaaggtcacaatatactgcctaaatatgctgtgagcttcgtaagtaggctgcactcttgttagctatcatcaggatttaattaactggtgtcacagctgaattgacatttcatgcctgtggggaaatttgactgaactcatccattccgaaataaatgattagcaccaccatctttcacattatctttcaataagtgggacagctacattttcacaacttgctggggaaaaaccattttcaaactctaaataccagtaagcatggaaaagaaggatggaaaataataaagtcaggcaaaatgatatttgtgggtgcttcattttatgaaaataaaacttgtttcagaggcagaatgaacctgttaggaacccctgtttttcataacaaattatgccagaagaatgttgcatagttttggaatttgcctgatcactgaactgttgagaacaaatgtattttatgggttcctgggttgtgggccgaccccctacccagtcagacaccagccaagcacagcttccaggtctttaaacttctcagcacagtaggccctaaaactgttcccatggtaaccttccatcaaacaggcgagctgtaaaacaggtgagctcaggctgtcatttgcagacaaaacaagaaaaagaaatactgactgctcttgttcgtgatgccacaaagagaagtaatactgattactgaataaatagactgaaagtcagaatagctgttgaactaaataggaatcatggcgttagtgtcctgacaaaaaaaaaaaaaaaaaaatacagcttctaaaatgtgtatgtctcaaagaaaatcaatgagaaaacagatcacaaattttgtagaaacattagttactgtttttggaggatctcctaaatatcggatccttggatggaaaatttgcatgtatggtttcatttgtccctaccccctaaaaaactgtcataataagcttttagtatttccatgatttaccttaaataactgaggttcaaagaataaaagtgagagactgtcacttaagtgggatttgaacccagatctctgtgtctccaaaatttctgtttttttcatgatgctacactttttgaggatttatcaggcatattctagaagaagtcagtcacagtttgtgctgagggaatttgccaccaattaagtacagatatgaaaggtagcatttgggaaatcatcttggctccaggatcttacagtctggggactgtagtacaatagagtcacaaaatctgtagttataagaattgccttgagtactagctcctccacaatataatagggtagccttgagaaatccatttaattctttgaacctcagtttcttcttctgtgaattgagacagtaacttaacggaatgttctgaggatcaaaggagaaaatatatttgaaagtgctttctaaaatataaaatttggtatatgactattattattaccctacatatcacataaaatcttggcacttctttttggcagaacaatttcttttcacttaaaactggcaggttgaattctttcctcaagtgtgttttgtttaatctccaaaattaggagctgtgcagagcttccagcctgagttcattttagaagtcaggaaataattgctgcattattatatatattgaactgtcattttacacatgcacacatggcaacttgatgagaaaatatcatttgtacttattttaaattaatgcttaattggtgacagactttagctatcacctacactctggttgggccaagaaaatagagtatgatctagaaactgaaggacaaaagatgagtaatggtcaaggaaatggcagtgcaaggaattcaagggctataacctggcagcctacaggctggggcagacctgccaatgtattttctttggctagcaggggtttattttgttgtaattgtgctttttaatgatgttcttaaacagtgcatgtaccctccagtctgctaacattccatcatttgtatcctcttacacctggctgcctctcacatgtatattacctgcctgacagtaattgggagatgggagtccctttaccaaacaacaggcaaaagagatgagttttcttcattttgaaaccataaagaatgtatctattgggaagctgaggtgggcagattgcttgagcccaggagtttgagaccagcatgggcaacatggtgaaaccctgtctctacaaaaaatacaaaaaaataagcagatttggtgtcgcatgcctgtggtcccagatacttgggaggctgaggtgggaggatcacttgagcctggggagtggagattgcagtaagccgagatccggccactgcactccagcctgcatctgatcatttaacacaggaaagactgagcatgcaataggctcaggcaccaaatcccacaggagtagagaactggcatactctatctgaaaggatacatttaggatacatattaaaaagtctagtaatccacagcccattgtaaatattctaattcaacaagcatttaagaacctgccatatgatcttcaggaaagtttctggcacagagtaagtatgatgtaagtagatgctctttgttatgtcatcatcatcatctttattatcatcattgctattattattggtcagacacaattctaggaagggcaaaggctcctaactcctgtcttcctctttgctcccaaatagagggtatccccagtgttctgctcagtttctgatgcatgcttgttgcccaaaatatatctgaggaatggctgcataaataatggaagactagagagaggccatctctggcctttgagatcaacagccaaaatctgctctgacaatttctgagagttgtgaataattctagccaggtgtcagaaggaacctggcgagtgtagccccgggactctgattttcctgaagaaactgaaaagaaagaatacccaggtggaaaaggtaccctggtagctggacaggatgtttagtggatgcattatgcaatgtctgcagagaatcatggccataagtgctatgtaagcaccaaacatcattaatattactatttaaaagaactgagcagcctattccttcctaggtggtaacctgagcacagcagaattttaataagtctgatcatttattgggttgccagctggagcactgaccatgctctggatgtacgtcacacagtctgatttggtgcaatcaacactggctctgactcagcatcttacctgcctgaactattgcaacaccctccttactgcctattggccttacatcatcccagtcagcctgttattctgcatactcctaattatataagtcttgctaaactgtaatggaatcatatcacttttctgcattacaagagttcatgatttcctttggcctaaaaaatatccaaactccttagcaaggcgtgtcttggtcttgggtcaccagcactctattctgatcatcctccgttgatctaaacactctagaggtctctggatgctcttcccgcttaacaagtgccttttctgaaccagattcccctggcaaactcacgagcatctttcatacatcacttgctccctgaagccttccctcacacccatctgcaggagcagaattgagggctttcttgtctacatgtccgtggcactgaacagttctcttgtattggccaggatatttggatgcaaatcttggaagtctagatcaaacaaattaaagaatatgttgggctttattcactcgtgtcaccaaactgcacagtggctgagcctttggatgagtgtgaccaggacctcagaccaaatcagggagtctaccactagcaactatcttcatggggcagaaattacaaacacttcagctctgcattcatacatactgaaagccagaaaggaacaagagctccttcccatgaattctagttataaaacttcagaggaaccactctggatggcctggcttagtccacatgagcatcacaggaaggggaccaggtgccatgattcccctagactgcttcaaggtgcctgctcagacccagtgacagggtaacatgatcagcaacccttgtcaggccctcattagatttagagtgggaaagaagcagtgtcccataagaaggtgcaagctcagatagaatttcagacaggcagaagagtaggtgtcatctggactgtcattcaaattcgataactaataacacttcagatcctaactgtgtctgtgagtttgcctctcactacagagtgagctcctagagttccagtacccatcttactcatgtgcctctgctcacacctagcatgatgcctgttgcccggttgccacttagctcatgcttgtgtgttattgaattaacaaatggatagctctccagggccctgtgaacaaaacatccggtgaacgtaattaccgaattctgtagtgtttggaagttagttaaacaaatgtttataaaaccgctataatttaaaagacattgagtggctcatgcctgtaatcccagcactttgagagtctgaggcgcacagaccacctgaggtcaggagtttgagaccagcctggccaacatggtgaaaccccatctctactaaaaagtacaaaaattagccaggcgttgtggtgggcacctgtaatcccagctactcgggaggctgaggcagcagaattgcttgaacccaggagacagaggttgcagtgagccaacacggtgccactgtgctccagcctgggcaacagagtgagagactccatctcaaaaaaaaaaaaaaaaaaaaaagcatcaagtgactcaaaactaaaatataacacaataacctttgaaatacaactagtatttattgagttcatagtgttagcatttttacgaaagacattttatgctcacaaaaattccatgagttttagcaattagccctattttataaattaagaagatgaagttaagagatgcttggacttcccctagttctcacaggtaaaaggctacagaggcggaagagaaacccaggacttctgatctcaaggctattgctttgctcttaagcaagttatttaacctgtctgggtaaaatggagataataactcttgtttctaaggattgctgtgaggagtaaaagaaaaaacatatataaacaaatgagcacatagcctggcccagatgagggcattaatggacaatagtgctaaattttcagtgatggtgggagctttccttcaattctgactagaacatatctctgacccgtttttgtccttgccccgcagcccaggaactcgtcctgtgttattctcctctttagtgccacccactctgtctccagtagcttctctccccgaagactgcttccagaacaggtcacaggctcctgggctccccttcttgctgaagccaagtgcccagaccccttttgctgcctcggttagctggccccactggttatggaaagataagtaccaagaggcataaggatatatggatcctagaccttgtcctgacatcaatttgctgtgtgacatttgtaccgctgttctctcaagcgtaaaatgagaatgctggaccagagaaatcactacattaaatttgttatgtaaaggaaatctcagtaaaaatatttttcctgcagagtcaagcaatattattacttcatctcaaaaaaagttttacatatttttttacattaaccaaataaatcagcattggacttgcctacatttatcagatcagtttctattacttttaactgttccttcctgctctacttctcagcagggattacatgcctgcagcgtacactcagaattttctcctgaacatagattccaggaaaagctaaggtaaagaagacagagtagaaagcaagagcacagatgacacttcttttaggcgcactgcctagatcgcacttggcctgctgtcttcctctcattagtcgcaccaactgaatctgattagcccactctgatttatttttggcaacctggaagtgcatgggccaatgcttattttcatggctgatacaatcatccccaaagctgtcgttagcatttggaagattagtccctttctctggatgattttattgcctatgaagcatcacgacacacattagacatgtatttcttaaacactttacaaaattgagtctatttactcttcttcttattatcacaaccaccttctgttattggctgctaaaacatagagaaagaattcttcataattacatatttgatgcttatgaacttattgttttctgagttagtgaatcatctgctataatcaacaagaactaaaagccagatttcaatgctactggttactcagtgcctgatttgtctacattttgcttaacagactttcccattatgcaccaaacagtactatctaggtgaaaagtgaataataaggaaatataaataaatattttctcctaaaaatgcaactttcagatatgaagcacaatatgtatatgatttctatttatatttgtggacagtaagatttattagtaaggatcattatttttaggtctttgagatacaaaaattctgagattccgaataagtcctaaagtacgtttagtataaaaaatgtatcatgaaaaatgaaacacactttggcaaattttccaataggttaaaagtaaaaggattttccatcagctctcggtgaatttgaaagcatatttataaccaggattccccattcactaagcatttaatgaataaacagccactgaccaccagcaaacttgcagctctggaggcaggactgtgttttggatccccagtacttagcaggctgtgtggttcttagtagattcttaatttgtatcgactagatgagaatatcaattagtaacttctatcatgggtatgattactctttcttttcctcgtacccaagtctcctctatccaatgaggacatctcagctgttccagatcccctcttgtaaagtctgtctacagaggattgtaaggaaagcaaaaagatagaagagaagaaaagataaaatttgcagagagagaagtttaaagagagaagggcgctatgataggggaaaaatgagaagtttaagaagtattgctggagacctcgggtgctctagttgattggggtctaatttgttgttgctgtggtggtggtggtggtgccagaatttaagaagtatttcaatgctgatgaattttccttaagaggaagggaagatgatgaggcaggagatgttgaggccaaccgacatattacttgtgttccctgcttgatcccggcaatgcattcaccgtgagatgaaggagggctctttgttttgcttaggaaggctagagggagggctctttgctttccttaaaaaatgcattgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctcagttctcaaaagaagacatttatgcagccaaaaaacacatgaaaaaatgctcatcatcactggccatcagagaaatgcaaatcaaaagcactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcacacataggtgggaattgaacaatgagatcacatggacacaggaaggggaatatcacactctggggactgtggtggggaggggggaggggggagggatagcattgggagatatacctaatgctagatgatgagttagtgggcgcagcgcaccagcatggcacatgtatacatatgtaactaacctgcacaatgtgcacatgtaccctaaaacttaaagtataattaaaaaaaaatgcattgtattccccacactaaagtaagctgatgatggtagaggaagaattagtgcccctagtaaagacaggatccaaccccactgggttagctgtagcagcaagggtatgggggcattaaggaggagcaggagttagccttcagagcgtgagtcgggacaaagtggcaagaacaggagcacccttgggcaaagcagcccaccaggacaggggctgatgacttcactagacagtcaagtgctcccgctgcactttgggtctgtccatcataagcacacattgtgctgatatcctccatggcaccatcagagggatgagagggcatcccatctacctttgaggcctggaacctctgggtgcatgggtatctcttgcacagctgtgacccaccaccacactatacactcatcaacaaatgttcctcacctggcacattgcccagggcttgctcttggactgctggcactgccctgctccaccaagcaggggacaaccatgactcagctgctctgtgtttctgatggccaagaaaattgttccctacattctcaattcatttttcacacccactattgattcgacacccccttgggacactgacaaagcaaagttggagggtatgggtacaagagcagactgcacatagggccatgaaccattaacaatgcaatacttctagatttggtgcaggaggctagaatgtctgtgatcaccagccaataggttttaacagaaagtatagtaagggaaaagagatcaagcatctatgatagcaacctagacctttctagtcatattaaggatactgacaattgcttcaattactaatagaagtctattaacttcaaatcctagcttatgaaatgctgtggttgaaaaatgtcaactctctttaaaaatattctacagatgaatgagcctggcttagtcaggtcttaatgtgcattagtgttaatcccaatttatgttatacaggtaacaatctaagatcaatttttctttttaaggattacaaacctttgcgcatgtgtgtttaatttgggtatggggaagggagaagaagcagttagagagttctgtttaccctattggcagaaaagggccaacaggcacaggtcacaaccacaggcaaaaggaggttagagtagcctattattaaattaattttttttttctttgagacagagtctctctctgtcgcccaggctggagtgcagtggcgcgatatcggctcactgcaagctccacctcccaggttcaccccattctcctgcctcagcttcccgagtagctgggactacaggtgcccgccaccacgcccgggtaattttttgtatttttagtagagacagggtttcactgtgttagccaggatggtctcaatctcctgatctcgtgatccgcccgcctcggcctcccaaagtggtgggattacaggcgtgagccaccaggcccggccattaaatttaattttttaaaatacatactcttctcatcttcactcttcaccttcaccttcaccgcactgaatgtgcggaaagactccagggaggaacagaagatccccaacccctctattctagggatttcatatgtaaagcctgagacggtgaggatgaagaataaaaaattgtttatgaaggggaagaaggcatctgttgctaccttaaccgtcagatactatcatccccagcccctttttgcttccttagaaagagcccctgggaatcaatttgactatagaacaagcccttcctctagaggggcactcaaaccccaacatggaattggaagctctggggttaactgaggaagaaggggagaattgatagcacctcagccagcaggggagggggtctgcccttcattaatctgtaatcagccagctggacagacggcagcctgtgtttcaattgctcccatgtgaacaatgactttttccttttatgtgttctgctccccactatttcatagagagcctccctcacctccactggagacactaggtttcttgatcttttcttcaaagagaagggaggggagaggaggttgtaggtggggcaaagcccatctcatctcttcatctaagtcagagcatttgctctcctaaaaggaacctagaagggaagttctccaagttcttgctcagataggagcagatttctctcccccagcacaggtacaagacagtagcagaatacactggtcttgatgagtgatgccatcagtactgagtagcagagaggaagatttcaggaggcagggaggtagggcacatctggcgctggtctcaccctgatgcagaagcctagccctgcactgttctcctcttcagatgagtatgaggatcaccacagtcctgttcactgtagctgaatgtgcggaaagaccaggcacccatgagccaaggggtcttccctcagtcttggtgtgcaggcggcacactacttgagccctagatatttttaaattcctttcggttgtgtgggctgcattctttaggacattggctaggactaaatgactgaggatgaaaccaaatatgcctatattgcaaggattctcttgattttttttaaaaaaggcctttgaataacacagaactatgttcagttctagaattacttgttttgttgtttctatttctctggtgagaatttttaccctttcattcattatgagcatacttttagtttattaagtatagtaataatacctgatttaaagtacttggctacatccaaaacctggattttctcttgaaaattagtcacattttcttggatatttgtatattgactaattttggactatttcttgaatattgtgagtattatgttataaaggctgtaatatttatgtttcaggattaaactaatatttttgtcttagcaagaaattcacttggttggatggaacctacacatgctttctcgtgggtggcagcttgaaccttaggacaattcttttagctttggctgggctacctgcagcctgacctccccatgcatggctcaggaatcagcctgaggtttggacagactttaggaccccctccttttcaggattacctactcactttccattagcagtggttgccaagattctctcatcttttgcctcaggccagaaagactgagattttgtcagagtttcagctatctcacactgactgaagcatctgccctctggctataagctgatgtagaagatggatggatggatggatggatggatggatggatggatggatgcatggatggacggacggacggacagacacacacacagacagagagacagacagatagatagatagacataaaaataactcattctgtgccaattctgtcaagtgtcaactgccctccaaaatctctctgctttgttcatgattcagtctttagtcagttgtttatttggtaatttgtccagagtatatggttatttgctggagaaacagtcagagaggaacttgcatggccataactgaagcagaacttgcagaagcataattcaaaagaaagaaaagagtaatggataagggaaggagctagtatttgttaagctccatgtataggcagcacattaaataccttttctgttctttttctgttttcttgtgttttatccttcttgcccaaacaatgaaatgctcttatgaactttatgctagcctcacaattccacgtggaccactggcaatatagcatggttcatattttgtgtttgatcccagaagtacattgctcaatgttagaaacctgcccatgtgtctggaataactgccttgatacattctcctagaattttcctaggaggccacagcctcactccctcgtattttttcaaaacatgtaatttcaccacatagctgaaaccaagaacttccctagaacttaagtgtcaaaatgactttcattcattaattgactccttcacaagatgtttattttgtttattacatgacatagtccaataaagggatgttttaaaagttcattctcaatgcctatctcatattacagaaatctgcctaggatcaaccacatgaaaagcacttagcatatgccaggtactgatcctagagctggaagtgcagctggaaataacatgcagttcccgaccttagagtacttatggtctagtatgataagaatattaggaacacaatttagtctattcaatgttaagacagaattaaatttgtttatgccagacattctttataagtactagggcctgtaaaaactggatttctgaaaaataaaataacaagaaaaagtcagtacatttttcagtctataaaacctcttggagagtagtgatgtgtattgtgtgctttggttgctgaaaatatgtgagaaacaaaaatcaataagttaaactgttggtggaaatgtaaattagttcagccattatggaaaacagtatggaggttcctcaaaaacctaaaaatagaactaccatatgatccagcaatcccacgactgggtatctatccaaaggaaaggaaatcagtatgttgacgatttctctgcactcccatgtctattgcagtactcttcacaggaggcaagatacagaatcaacttaagtgtccagcagagggtgaatggataaagaaaatatggtgtgtgtgtgtgtgtgtgtgtgtatatatatatatgtgtgtgtgtggaatatcattcagccttaaaataaaaaggtaattctgtcatttgcaaccacatagatgaacctgaaggacattatatcaagtgaaataacccaagcactagaagataaataccacgtttttactcacaatgctaaaaaaaacttgcaagttgctctagcagatgtcgttactagagccaaggaagggagagagagggggacagccaaaggcttgttaagggatgcaaaagtatacctagccaggaggaatacgttctaatgctctatagtactatagggggactatattgacactttatcgtgtattttcaaataactagaagagtggattttgaatgttcccaacacaaagaaatgataaatgtttgatgtggttgatatgttaatcaccctgatttgctcattacacaatgtatatatgtatcaaaatatcacaggtaccccataaagatgtaaagttgttatgtgtcaattaaaaataagaataataaaaccaaaatcaataaattgagtaatttgttagaggcaaatgcccatatatcgtcaatttaatcagccattccttcactgatgtaacagaaacttaacagtcatgtgttatgtgttatatgacagactcagtgttaggacagtaagttaagagatgaagacaaatgaacatgtggaacaataatgagactgattttttgtactggtgaccatgggcaagtgacttaatctttctgagcctcagtttcctcagctacaaagtgagattaaaagtaacgatacgtatctcatgaggttattttcaacattaaatgagatgtttttatatatggagcgcctggcatagtgcctggatccctgtagattcttaacaagtttcagcaatttttccaccctgctattatagaaaagaaatttgaggctcagtgcagtgaataacttactcacccgggacactacatacctagaagataaattaaacccaagcacatggtacaaagtacatgagtcttgtttgagaccagaaagaaagattaattctgcctatggagtctgagacagaatcagggaggaatatttaaaccaattccatggatgacttttcaggtattgtccataaatacatatttggagacttggagcaaagtttttaaaaagtccatcaaccgctgatcccctagacaccagcagatcctccatctggtctcttcctcactagcatagcttccttcatctttaagagattatgctggttaatctttaatgacaaggatcaacaccagtttctcaatcctgacctttttataattttcagagctagcagatgagaggaaatagacgaaataactgccttgatatattctgctagcatcactccctctaaagtaaaaagagtacttctttaaaccatgtaactttgccagcacagttgaaaccaagaacttctctagaacttgagtgtcaaaatgactcattcattatttactcctccacaggatgtttattttgtttattacatgacactgtccacaaactggaagcagattttcagtggaaaaaaatcctcaaagtaaaaccctgagaagattattaatcctaagaaggataatctctttctgattttctttgtgtaactaaaatacctatgtaactctattttaagaaataaggcttaccataaacataactaatgtttatgatacacaacaatatgtaaaaattatcttagcataactttattgccaattatctgaatataacctccatctctttttattctgtttcattcaacagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaagtaagcatcatgtgtaatattgtcccgtttcttcttattgttcccctgtttcttcccgtagggctcgaattgacagactccacccagaatggcaaaatcacttgccttaatgccaagtgacgtagattcaaagttatgagctatattaagaatacagctgaagtttgatgtttactctttaccttgtgataacaaaaatatttttaaacccaaaaaagtaaacctcaatgatgtagtatattttgagactgagtaacaatttcaaattcatgattggaccatgtaattttctgctatgttgcttaataatgtcatcataacttgtttatttttttccagagcatgtattctcatattaagcaattcagtttggggacaatgaactgatactcctatttaacctgctcaaattcaggtataggtctttggctgagagagagaaaaagatatatttatttatcaattgttattccccacctcatcttcaaaatagctttgccttctacttcttaagaaaaaatgccaagaaaaaaaattactggcattttaaccttcattagtccatgtcataaagagttaaggctgacattgggaaatttttaggaatacttttaactccatgtgattttttttcactttactcactgactttaatatctaatctcaaattaagatgtgactctactgtctatgttgacatgtggaagaaaaactgatatctgtaagacagtagagtttatcactagcacaatataatggctcagcaaagtcccttttgcttgtgttctttagtgtaagttttgcaacagctgcaatttgttaaatgccatctatgtgtgattgttctggtgataaatacgtggaaagacagtgatattatctgttgggataaaaggaagcagaaactacaagaagcaaaaactcagaaccaagctagaggacatatttttaacacatctctcaaaaattaattaaagtctccattggcacaatcccaggatcagtagtgagtcctaaaaattaggaatggcatagacccaagaccttcaaagtttatagacataatgaacagatctactagttgaattaaagggagaacttacctggtaaaatactgtcttaaacaagctctagaaaaagatgaattgcaagtcagatttaggcagcagatataggcacataacgcctacaatacaaactccttaatatcaaaagctctgtcttacttatcttcataatttcataaacacctagcccaagccttatgcttgcttaatagatgatccataaatattagtacaatttagttgagcaagtaataggagagacccggggggaaaaattaaggcacaaagaaaaatagatttaggactgtaatgacggtcgctgatccaacatttatgagcatgcactcagccattcctcatcagttgcagctgaatgattcagccctttagctaactgttcatgaagaaatttgataggtaagcaatgctaaaaaatttctagaatatcacttagcatttgcaatgagttccattcaaaatatattctattttcctttgtgatgtttttctttgacctgtagggcttacaagtgtgttgaatatccaaaaatttggaaattttgcagacatcttttttcactgattccttgaggaagtgttgttgtgatcagagaacatattttatatgatttcttttacttgaaaattgttgagatttgttttatgggtccaaatatggtctttcttgctgtgtattctgtgagcacttccagggtgaagtttcaataagtaccgaccaggtcacgttgattgttcaagtcttctatgtccttactgattttctgtctatttgttctaataatgactgatagaggaatctgaaagtctccacttgtaactgtaaatttgtctatttctcctttcacttattttggtttatgctttacatattttgaagctctgttgttattaggtgcaaaagctttcaagattgctatgtcttcttgataaactgacccttttgactatatgtaatgtccctctatattccaagcaatatgccttgtgttaatttcccttttgcctgatattaaaatagccatagttttcttttttaagtgtttgtgtggcatacctaatccacccttttgctttcagcctacttctgtctttacgtgtaaaagggtttcctgcagacagcatagagttgagtcttgctttttttttccaatctaaaaatctttgtcttttaactggagtatttaggacagcactatccaataaaaagagaatgttaaccttatatgtaatagtagattttctggtagacacattaaaatgctttttaaaaaggtgaaattaattttaatatcatggtttacttaatccattatattcaaaatattatttcaacatataatcaatatacatatttacacattttttactttcatacataaatttaaatagaaataaagttgcactagcctaattttaatcgctcaatagccatatgtagctagttgctaccaatttaaatagtgcaggtttagacaatatatatgtaattattaatatttattattataatataatacaattatttctatggttgaatttgaatttaccatattgttaggctgtcaggtagaacagggagtgagtcgatctagtcaatagttgagctgggtttaaggtattagacacctttcgttcatcacagatttccagttcttcccatgataggctgccaggagtggtagtgggtatttctcagtgtttcagtttcaccctcagtatgcagcaagccctgaacaccggcaccacagaagagctcccccagcaatagactgctgttgcttttcactcattgctaactttttggtggggacagaggatgttcttcgttctcgtggtccagcctcaggcttaggcagaccctgtgatgttagatgggacattcttgacatttttacccctcaaactacaccgacactgaaattctacattaaatccatgggtcagagagattcctgcctcttctccagtggtagcagaaccactgatactctactttgtattagtgcaggactctggtcccaaaagagtttctgctcctctcccaggaacaggcgtcttttgtttctattcatccttcaaaagaagggatattttcctgagaactagaaaggaaagatttttctgcccctccacaatacattaaggcttctcctttgtattcaggaaaggtccagggaagtaagttttcttgctgtcctcttagtggtttcaattatcatctgcacacctgtcacccccatacccccatccccagccccccagagggaggctctctctagtcccctatcctgcctctggtagtcctcatgagcatggggtagaggcccaaggggaaagctagagagagacagtagactctgtttgtgtctgtgtctcccagttagtctagaccagtggtgacctagaactttgggatgatggaaatgttctatgtccatattgtccaacatagtagtcactaatttttaattttaattagttttagttcatttaaaatttgatttaaatagctctatgtagctaatagctaccatattggacagagcaattctttgcatccatttagaccatactcagcctttatgaatccattaaactcggagctgctttcttcttatctgcttcgatgttgtatcctcttcctgctgtgctttgccaaaggtgaaatagtgtgtcgcctctctccagaggggctggtcactccttcgaattcacatcacttggttcacttgctacctcacctctcctgtaacctcaagaatagttatgatttcgtgaattatgtggcttttccttgttgaggtggagaagaagtgatgttgtcctggggctttctacatcttaaggggaagagaaaacacgtattgatttccaaagagtaaaattaattcatgatggtctattaaatattatcttgtacctcatttttaaaggttcaattacattatcccaaatttgaggggcaataataggttgggaatatcagaagtgggaattagtgcacaaatatttctgtgacattaggcatgagctggcatttggtgacatttgggtttcagcttccaccttcataaaagagggaattgaagtacatgatgactaagataaattttgagctctgaaactaacattatctgtcagttaatgatgtgtttttgccatctttatttttctaactgaaagctttttaaacaagtttggaaaacatttgtagtatctgctcacagagttgacatatttctcctgagaataaaagagtacctttatagcagtcatttattgtgtgttagatgcttgtcttgatgaaataagcaatgacaaagcaattggccccagggcagtcctttgatatttcactatagttgttctgagtctgtcactcttagagaaagctgaaaaacatggcaaagaataaatttggcacagcagagtcatttggccagttcaaaagaatttcacaacccttaggctgtgacatgtcattaatatttaattgattgagaaccttcagtatattgcctgcccttcagagggaaggggtagtttctcagcacgtaaaaggatgcctggaatcagttccttggaaattgaggaaatgtcacatacacacagctgtgtcatgtgtcagtgaagttctacagatagtggctgtacacattaaagaatacacatagagacactctacaaatataatattctatacagtcctattctaaataaaaataattcatgaatttttattttagttatcaggtacattctctgtgccatgtcctaggtaccaaagaaataaagatagataaaaatactcataatcaaagatgttatactatagtggaagagacaaataaaaaccattacaaataatatgataactgctattgtaaccagaaaggggtcacaatccagacccccaagagggtgcttggatctcacgcaagaaagaattcagggcgagtgcacaccgcaaagcaaaagcaagttcattaagaaagtaaaggaatgaaagaatggctactccataagcagagcagcccaaggactgctggttgcccatttttatgtttatctattgattacatccttaacaagggggtggattattcatgagttttccaaaaagggtggacagttcccggaactgagggtttatgccccttttagaccatatagagtaacttcctgacattgccatggcatttgtaaactgtcatggcactggtgggtgtctcttagcatgctaatgtattataattagtgtatagtgagccagtgaggacaaccagaggtcagtctcatagccatcttggttttggtggggtttggccagcttctttactgaagcctgttttatcaccaaggtccaccccagtaggtctcagccttattttacccagtccctattcatgatggggttgccctgttcaaatgcctctgacactgtgaaagaattatgtgaaagagactgccttgccttcctagggagcactgggaaggcagcacagaagaaacaatcattgaaaaataaaggaaaatttgccacaagaatgaagaaaggaaagtgttacagagtcaaatggaatcgtatatgcaaataatggaggcatacatagcatggcacacttgatgactgcagaaagttaagatggcaagtgttagctgttccagaaaataacaagaaaggtggctagaaatgttgaagaactttaagtaccttgcagaggaatttagactttaacctataagtgatgagggagaaattacataataggatttgaatggagaaagctctctcttgtagcaaagctgcaagccaagagatcctgaatcctgcattggaatagaaaaattatcaagcaagtatttggggtagtagttcaatcatatgtatagccttaggcagatgattactttctctaaatcttagttttcaaatctacaattcattctaggggttagcaaactttttctatgaaggcttagataataagtgtgttatgctttgagggccatacagactatattgcaactacacaactctgccgttgtaaacaacagcagccacacacaatacataaacaaatgataatggctatattataattaaactttatagacaccaaaattttatttttttatacaattttcacgtgccatgaaatactattcttttgtttaggcacaacatctaaaaatgtaaaagcctttcttagctcaaaagtcaaacaaaaacaggtggcagggcagatttggccttgtggactgtagtttgctcacttgatctgtcgtatcattataatatgtaatattgggataattagagtgcctacttggtgggggcattataaaataatataaagtaagcgccttaacaaagcatgcagtataggatcaatcaagataagaagtatcaatggcattaaatagaaagttactcaaggtgtcagaagtgaaggagattgagacagattgggcagggaaatatcagtgagaaggaggtgactggtttaggacaaagattctgactaaagtgagaatatcaagtaccgtacagacattgaaattttgagcagaaatgaataagaatattaaggtgagaatggaggcagggagaataatttagaaagttgttgaaatgttcgaggaaagaaatgatgagaacttgaactaaggtactggatgtgatggtcaccacctcacttggactgtgggcagctggtgttgccagacctacctcgctggcctgctttgatgtagctgagatgccaggtcaggtctcaaatgatcatctatgcaccaaacagcagctctggcctcagtccagtctcttttccctgtgcctgccatcagaagtgagggtctaatcccagatcctctccctcaagagaactgtgccagaagagacacattcttcagctggtcacatcagaggttactgaacatgaacacaattgcttctttagtttgtattctttagtccagctaaacagagcaatctcagaaagaagcaactcagcagttagcatttaataagtaatacatagctacttttgttttctttaaacaatatgtgctccacatttgtttgtatttcttgtctcttctccgagatagtcacatccagaactttcaaaactttcctattcatgatctctcttgaatgattcaaagataattaaggggcataaaatattgttcaatttgaacatgagttttcattatatgagacacctaatgagggaaaaaatgatcacactaaatgtcattttttattaaagaaaaaactaggaacttatgctaggatttcttgtcaaaatatgcagtccattcttcttgtcatccactttttgctcctaccacaaagcaaaaagaaaagcagaagcacatttccagacacaaagccacaatagttctctaagaaccagaaacaagataaaaactcaaagcagggaaatgggctgaagtaatgggccctctgtgctctgggtctggaaaagacactattgagtctgggccccaatatagtcagaaggactgaaatgctccacgctagacagggcacagagccagcctctctgcttacagcaaagattcttcctgtttgacaaacaaacaaacaaacaaacaaacaaaaacatacataaagacctgaggatgcaggagacacatattcatcttactaccgaggtccaaggctagttactctctgactcagtgaatgaatctatagtgataaccactatatcatccacaatattaagaatggcaaaataatgtcatatgtcttgctgtagactgggtgctttggtgggctgagaggatgcaatggcttaattatttttaaaagcaaggcataataagagagaaatggggagatgaaaaagcatcaaatgagcccagagcctgtgtctcaaaacacatgaagaacttatgctaaaaaagatagatatcaaaacaacgataacagttcagattatattttaaatagcaatttaacaaaaatttaattatgtttataatgttcaaggacataaatgtaagaaccacctccagtttttgaaaccagggaattagtgggaaaaaaaattggcagaaatagtgcagtgctgtgcctacagttccacctaatcaggaggctgaggcaggaggatcccttgattccaggagttcaaatcaaggctggacaacatgatgtgaccctatctcaaaaaaaatttgcagaaataaaataaaaacatatagaataaacatgaataaattaaaatttttataaatgaaaacataattatttaaattaatttaaaatttaatgcatcaaactaggtaaaattaatttgattgattaaatttaaagtttactaattgaaaagcttcagtagataggacaaattctatactgataaaagttataaagagctagtaaattggaagataataccatgcaatttgcctcataatatagcacagtgaggcaattcacaggcatggaagtgggagaggctctagctaagaaggcttaagaattcatgaaaaagaaggagggaatggtgggcacaatatttggagagatgattatgagaatttccaagacttgaaaaatgacatgaattcacagactgacagagcattccaactaagtacctaatagagtaattcaaaactaaaactacgcctaaatatataatgctatattattgttattatatatcatcagattactaaggctgaatgaaaatagataaataagcttgaaaggtacaagagaaaaaaagcgaagtatctacaaaggaatgactattctactgacagaagtcttcccttctgcaataactggtgaaagaaaacaaaaaaacaacatcttcaaagtactgaggaaaatacctgtctacctagaattttatacccagatacatcaagaataaaccacattaagaataaagataaaataaagaaatcttctaatatacaaaccctagagaacttaacacctatagctctgagttaaagaactgttaatagatagatttcagcaagaaaaaaggtgaatctagaggaaagtccaggacacaattttaaaaaatgacaatgggaatatggtatatgacaaagattgtgttacaaattagcaggagaagatggaaaaagaaccccaaaacaggcaaaagaatttaacaattctaagaaaaggaaagctgattgaccaaaaaacataagaaaaaatcattaatctccatgagcaggaaattaaaacaaagagataacatttcacacacctcagagtggcaaaaattaaaaagactgatatcagcgaaagttggaaaatgatatggagaaagaggaactatcatacactgctaatagatatgtaaattgccctaatctatttctaatctaattagaaaactttctgaggctagactatctgacacagatgatgtgtagacccttctattcaggattttcaacctaaggcgacatgccgcaaacatttattgcagcattatttgtaagagtgaatgattaaaagcaattactctactaaaagaataacaggtatattgtgtaggttatatagttgcaaaacggacactaaaataaaatttttagacgttcttgtatcaagagtgataaatcttaaaacaatgttaggcaataaaaacaagctgcaggatagttatgataatttacataataatttaaaacatgaaacaatgttggatgcttacaaatatataagtttaaaaaacatgcatgagaagataaataccagattcagagtaataatttacttctggtcatggtgggaaaagaatggggtttgggtaagttacaggggggaatttcaaatatattttctaatactttatttatttgaaaaattaaaacatctgtggacaagaaagtaatgaacaaagatattaagtgattcaccttgtccaacaactccatttctctgtccagtccaggctggtcataagaaaaaaagggaagtacaatggagtgactgacagggcaaggactatcagcttagattaggatttaaccttgtcatcactgaaatacctgttagtaactatagctctagttcataccacaccacttaatttctaaaaagaaagacaatgagagaagtcactggagagatagtaaaatatttttagactatacgtttgagttcttctaaaaacagtaattcttgaattgaatactcctcagtgatgcttagacatcaacaggatttactgctgacctgggtcatttacactgaagctgagggaaacataaaaaaaacatacaagcaagcattttaagacattctcttagtttaaagtttaagtagcttgttgcagaaaaaaaattggaaaataaaatatctgttctctaatcctcctgtctgtcttgaatttcaaagtttgaccgtggctttgatgtgcagacttcgtgcctcagggcatgaaagattgagtgcccttctaacttctcttttcagtagaagaaaccctgatgaggatgtgaaacaggactgcagcagtgaaggagttactgctccgtggctactttttctgtctcctttcattttagttctcttagggtcagagtcaatagctggatctggtagactccatgggttagtaaattaggctgggttgaaaaaaagaacttgaagcagttcaaaacttctttgggagttttgaactcaaaacagagttttcaagggttggttgattggttgacatggtacgtaagtgagttagtgagttcattcagaaatgttaccttcatgtaggaagactagggatgagacaaagataaaattcaaaccttttaaccagactatagcacatagtctacagtgacatgatcataaaatatactggagtctgaaggtcttcctaacttttttgtagatgctgtttttcagaaaactccaggaaaaatcaaagcatgaacatgtagcttcaattatttctgggtttcttaaagtcaaaaacaaagatagattaagaacctgagcaacaaaataaaatacattcagctacagattgagacatactagatcctcaatagttatttattgaatgaactaagtcaaatttggagttctcatgttattgaaattgaaattttttaaatgtaaagtttaaactaaggacatttctttaggtcagcctatagatgatgtccaagaattctctcaattctaaaagtgtgaatcaaaaatttttttttctgtcaacctaaaatcgtcaaaagggtcagaatctcatttaaagagagttttatcaagcacaaagtgtgaggctggaccacctggaaacaccaactccaaaagaattcagtcagtgctctgaagtagtgaaattgggatctcatttctataggcagaaacagagaagattttatcaggattacaaaaaaattattcatataaggatggcacctggttacagaaatttcattgattataagcagtgtttcttttggggaagggtacatttaacatttttttacacagagtgtaatagttatttataggttttctgtcatccagcctaagcaaagcaggacaagaaaggggggaagttaatctacaacatgggtcattaattaagaaggcaggagatttttgtccctgacatcatttaattccctctagtcactgcacagaacaagaaaaatgaagtgagttaatctgtaatttgagaacagaagttataactatatgtgactcagatcacagttacgtcttttggggttccaacagcttttaaattttacttatgttcatttttcttttctttttttgttttttttttttttttttttttgagatttcactcttgttgcccaggctggggtgcaatggcgggatctctgctcttggcaacctctgcctcccaggttcaagtgattctcctgcctcagcctccccagcagctgggattacaggcgtgtgtcaccacacctggctaattttctatttttagtagagacagggtttctccatgttggtcaggctggtctcaaactcccgacctcaggtgatccacccgccttgaccttccacaatgctggaattacaggtgaccccaaaccaaattatttaacatatcttcttaataaaattcatacaggtaaaatctgtttaatagcttctttagaaaggtgcaaaatgcattatttacaagaattttgcaggagagtgggagggggaggagaggcaggcatatatcgatcatggattttaaaaaatgagtatttttaaagttttccagtgaatgaactactcaagcaaaatagaaatgttttctttaaatttctacagaaagagtggtttgataaacaccacaaaacatatgttttacaacattggacagtttaaaattttatacttcatatggaaaaataagtgctatgttcacaggaagaaataaatgatcatataactatcattggtctgagccaaaatttattttctgttactggtctgttactgatatcaaatttcctttgcatgagaaaaagaaaaataaactaggaatctggagatacagactgtcatgtacttgttaaattaccttggacaagtaatttagtctgtgagtcatcattatatttataggtgggatggagatattttatttgctcttcctagatctcaggactgttgcaaaaggaaaaataaatgtaaaagttcttcaaaaagcagaaagcaccatataaaatgtactttattaattactgctaagaacattcaattcatggttactgaggagtttagtgcccacagacagtgaaaattatgcgtgaatttctggtaggtgtaatccttgcttaattcaagtattgatatcggcctttctctctcctctttcttttccctttctccatttacttcacttctgtagaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaaggtaagcagcaaaaggaaagctgaatcaatgatgaccctcactttttacaaagcttttcccaaatgatgttctctcttactgcaaagaggttttataattcactatttgacctataaatgagccattaaaaataattattgatttatgaaaatcgtgttatgaggaagcctagaacatctggttcattacttgagagtcgtgtgtcatgtgttcagcatgagaaatactctcattattgtcacttacatgttactcttccctaaggcagcatgcctggtgcaggaaataaattcagacttaagtttagaagcacaagtaaccgtttctttctgggtatgatagatgggcatttctgggactgggaagtcagagtggtgccttttgcaaagtttcacttggagatgatccaacatcctcaaatgcaatgctgtatgaccagctaaatgcatacattaacatacaaaaattagtttcgctttttcactggcttgatgggaaccttgaggggaagggagagaaaagagcccaggagaagtaatatttcaaattactcaaaggaacaaaatcaacttctctgggtggaaggggctagagggagagggaagagagggcattcagtttcatttgggagtgaatcctagtgaaggaacttgaatacgctcagggcacatcgggtgggggtgggaggtaggtaatgatatcagagttggctgactgtaactggaaacatgtattggtggaaagagaaagtattgaagcacacagagcatgacatccaggaaaatgtcattttcacttgctgcttttacacactcatttcttcaatggatttagtttttctgagacactatttaaaatatatgcagtggggctgggagtggtggctcacgcctgtaatcccagcactttgggaggccgaggtgggcagatcacttgcgttcaggagtttgagaccagcctggctaacatggtgaaacaccgtctctactaaaacatacaaaaaatctagccgggcgtggtggcgggcgcctgtagtcccagatactcaggaggctgaggcaggagaatcccttgaacccaggaggcagaggttgcagtgagcctaaatcacatgactgcactccagcctgggcaacagagcaaggccccatctcaaaatgaatgaatgaatgaatgaatgaaatatatgcagtgaatttggtttttttaaactttgaaaaaatcaaagaaacacaaattccacaaagtattatgttctttatttacaatgaaaacataatctgcaaattaataaatggaaagttatttgtttatagatcacatgcaaatatatttatgaatgattaaaaagcaattactgaaacttttgttaacaatcataaattttaaaataattaatataatcccattcttaagtcaattactttttcaaactatttttagatttcaattcaataagtggtacttttagttttgttctctcatttcttttgagttggattggatttttagtttattgttattctctttaaagttttctaagtggaatccaaacttttattatttctttttttgggcaggttctgtctgcaaactggcaaataaaccagttttaaattaggctagtttttctaaatgaaaacttttcttggaaaattgctctttttttaggtcataaggtggcaaaataccttggatttttatcttaaagtaaatggccagtgtaaacttaacctctacaatttctttatattatctccttcaattaatacataccccaaaagttcctatcacaaaaaggttaactccaattgtgtttgatctgcttaggaattttgtcagaaaaagcccttcaggattgagtctagacattcaacgtttcatctctagccttctactaactctttattactgcccataacagtagttgaaggaaatattattttgtgaatgtttagccataattgtttcaaactttccagaagtgtgtgatgtttagaagaccatatttttcatgtaattgattttctcttcacagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactggtaagtctcctgaagaatcaaatacagtgaaaaaataattcagttatattttgctgtacatttattttttatcctaagaaatattctgatccagagcaaagaaagaaaatatatatgtttaataacctaaaacagattttctatcaatataaaaagaactgggcaaaatattcaataagaaaaatctaaaatatgtcaatgtaatcatagatttctaatctttgaataaaaagctactatactattaccaaaggttataattaactgacttacccagatctagtagacatcagttattgctgacaagtgaccctatggcagaaaacagagtgaagacattctagtacagattatcagattattaaaggaaaatattgaaattcaaatgtatctaaaacttgcggtgcttgattttagtagcaccactaatatgaagcactattgtaggatggatggatagttgcatggatggatggatagatggatgggtggatggatggatggatggatggatggatggatggatggaataatgaatggataaaataagcatatatctactaagtacccatcaccaatataagcaaaatcgtatgtgcctagtatgcctgaatactcaataggaatgctggagaggccattctgatgagcatcaggaagggattatgatagattacttctaaggtcttgacaatttgaaattctaagatgtcatgattcttattcattagtctaagaccaggaaactatttcagctaaatcactaattcacctaatgtcaacagttaagattctatttatgtttttcattattcaatgtaagtagaaaaacattaattgagcaccttctacctggaagttgttctcagtactgagacatgaagacaaagactgatgagacaggatccttgtgctcaaaaattggtactcataatacacgaatggcactaacacaaggcagaatgagataaatattataacagaggtacaaagttatttaacaacacaaaggaaggagagataaatttttattagaagctcatggggcctagcacggtggctcatgcctgtaatcccagcactttgggaggccgaggcaggtggatcacctgaggtcaggagtttgagaccagcctagccaacgtggtgaaaccccatctctactaagaatacaaatattagctgggcatggtggctggtgcctgtaatcccagctactcgggagactgaggcaggagaactgcttgaacccaggaggcggaggttgcagtgagccgagaccacgtcattgcactctagcctgggcaacagagagagatactgtctcaaaataaaaattaacaaaaaagttcatggaagaggtgataatggaactgctatttgaagaacaagtagaaactgttacaggcagagactacgcagtgcgtcttcataattttctccctgtaagtaaagtgtgcttccataatttgtaaactcattttgagtttatatgtttcattttagggaggtgaggagtgaagctatatttctaacatgtgtgttaacatctctaaaggcaacacatgtatgcaactcttgtaggtgcaactatgtcacatggagtattttcatcttcatagctataagtacactatacttgttttgttttggtttttttgtaataaaaatccaggaacagagatacatttttttgtaagtggaattacgataaactgaaaaatatttatatactctgcttttagaagtggttgaattaccacttcaacaagcataatattgtaagttaatatatttgaagtgtgactagtggtatgttgataggtatacatcatccacaaaatgttagaagtatgtatatggaaaaaaacacagcttatcttgatgtaaatttgtctgtgtatcagaagtaaaattaaattccacttttaaaaatctgcttgtgtacctgactcattaagagattaagtattcactctaattgaattaaaaaatacttgaaaatgaaaattctctctcttacagccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaaggtaaagcagtaggaaatcagaggaaataagaactgatacaaaggaaggggaattgaaatgtttttaaatttgagtttagaaagactgatcatagacagttattagtcaaagaataatggtaatgaaaggggagaatttaattgagtatccaatgcagactgagagcagaaaacccaaatgaatagactggataagaatcagaaggtttgggtgattcacaagttgtaagtactgccaactgtatacatttgactgcccactatttctcatgtctcagaacaatgaggaaaacatcatatttggaaatattttgaattaaagatctaactatcccagaatgttacaacataacctagagaaattttctgttttctcatatgcaaatttttaaacatggcagcaaagtaatacttatgaaaacattactacttcctcaagaatatgaggcatgtgtcctgctaaccagccgctcttgttccctttagggtgcgcccctctagaaaaagcaccacagttttccaaagagaagctgatagtaaaatggaaaatacacagctgctgacatttccatatagctactatattatattttgcattgactaactcagcatctgaggttcattctttatattttagccactaacttaggaaagtagagccatgactttcaacaagtttgggtcatgatacctatctcaattgttgtttggtagatttttatggttatttgttgtttgtttagtttttacagtaatatacttcattttccattttctgatctagtagtttgagtggcagaggttataatttgtaaaaatttgaagttacagtgatagccttatttttagggtgagagtttaaggcccatgtagtctcatatactgacatattgtttactcctattttacttaatagcatgagatacaaaatctgtggattcttctatacaagatgatacagcattcaaccatacccaaatattacataaaatgaaaattcttaattatttgagtcaaaagtcattttcctggaatttcctattttttttaaagtttccttaatctatcatttatttttctgttcctaaatatgttcctacggcaaataggatcttgtcattacaaaaattttttactgcctcttctcatgaaggttctattatgcatttatctgactcagtgtcttcttttgaaggctgttgtagtcaccaactgatgataatgacttcaaatgaagtaataagcagcagaggatggatggactgtgaagcaatgtgaaataattctttctttaagaagatctgaaagcaaatggataaaggaaaaatattaccatgattattatttttttaattttactttaagttcaggggtacatcagaaaatataccttaaaaattagatgtattttaaataaatgttaaagcacttctggatggttaatactaccacaaagaacttacaagatatttgatcctggttattttttagcccttacctcgtgatgagaaagccaacaattgttaacttttcctgattatctacttctattttgtacacataattttgttgggtaggagtacataaagatacacagtgtagacccatccctagttttattgatttgaatgccgtatttgagttttgttatttggaagactgtaaaaatactgaactcttatttattattctttaatggtacctttagtttagaggtgtaattgaacttgacaaaaggagggaacatttaaaacacctaattttttttcattaatcgacttgtctatacccagggcctttccaggtgtctattcatgtatcttctcttttttatatatgatttagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtaagtaacaaagagatcattttacacttactggggagctagaacaatggaactggtgggattaatgatgctcagatgtcaattattcacaaaccttagggatgatgagaagtcttcaagatcaggagaggctgagatccacaagctttggatagcagaggaaatgaatgcttgtttaatagtagcaatcctatccaggggtttaacttgaggattttttttttactattgtgataattgaacatttattaaactgacctttcacattagccataacaaagcctccaaggatgtggacatacagtttgggaaatacgacatttgtttgagcccataacgaaatgatattataggactgtgaaaaatctcattagagtattgagcttgtgaggctcaaaagaaagacaaagattcaagtgtgggtacaccccgatggtctcaataaaactggtgggaaaagtcatagctagagcaacctgaaagtcccagtgtcaagtcctagggtggcctctaccattccataagggtaacaggacagcaaaagctagcctctgaaggttgcacaaacagtgcctgcctctataacgtgtttagctaaactgactatgtttactggaagtatagaggtcaaaaatcagtaacctaccctatcaggagttatatgtgcctccgatcagtagaaagaaaaaccagaaggcaaagaataaaaattgctttcagaaaaggataaccaccacatatcctattgccatctggaaaggcaaataccacctttcgttgaaggacggatgagagcagaagaggagctcagcttatgtagcagcttaaaaatgttgaaaatatcccatataatatttttacttaaaagaaaaaccaaaaatgtcacctctggcaaaagaaaggccttaaagatttatcagatgcgtagaaagggtattcccaactgccttgtgtgtctttcaagtgtgagagaccttggacatgtgattacttaagaaagaggacaaagtcgagtatttcattcttcccataagactaaaaatgcctcacttaccaaatagtttctttctgcaccagtacagatccaccgcacatgtgaacagcctccacgaaaactccacaacaattctggtctttctgacttttctcttctctgaattcctattctgtctcatagtagacagcacaaaacacataacttattagtgtgtggtatttttctagatttattttatgtacatcttgcttctcatgtcaagttgtaaaatcccaggctggagttatactgtttgcatatttattcattcttttgtacattcaagaaatatttatggaaccacttatatctttcatgcactctgctctattcttagagtatctaaagcgactagtgccattgagaatatgtcggaattgctcaaaaatgcaattactttaaagagatgcatcttaatatttatctagaaaaatataggctcctagaagttttgttttttctctgttgctaaaagaatgactttttaaggagattctgttctgtggtaatgagctattcagatgtaccatgtatacttctttggtttaaaaaatggataccgcagacataaatacttacacctaactgggtaaatgagcaaaaattagggtggcttacgtttgctcagcataatgtagtcacacaccagcaaaagtatatttgcagcctgtttttcctgaccaaactgtttcacatattctggtgttgagctgttacattacaatttattatatgtttatgtcgttgcattataatttacatttatgtagctttgaatgccttcccagagatgagaattcaggtaggaatttgcactagactgccaatagccttatgaagaaaacacttttattacccccatttttcacattaaaatacatactgaatcgcagaaatttcagtgacttccccaagtgtcaaaattaagattataactcaggaatatttgataacaaaacccattttcatttagcctgccatgacccatgtccttgggttgattatcaagtcagtcataaggtaaaactattaaataattgaatttgttttgcttactccaacctccaccctctgtgcccccactacactagtactcttcagaacagtagtaacacttcacgtttatgtagttctctaacacatattatctcatttgatcccaacaacaaccttatgaggtaaattaatcagattttcaaaagcaatgactcaagagacaggaggtctgggttaggtcacaagcacttactagctctatgacttcaggcagcttgtttatatctctgggcctcagtttcctcatcagcaaatgtgttagtccatatttacactactataaagaactacttgagactgagtaatttacaaaggaaagaggtttaatcgactcacagttctgcatggccagggaggtctcaggaaacttacaatcatggcagaagacgaaggggaagcaagcaccttattcagagggtggcaggacagagagagagagcaggggaaactgccacttttaaaccattagatctcatgagaactcgctcattgtcttgagaacagcataggggaaaccacctccatgatccaattacctcccatcaggtccctccctcgacaagtggggattacaattcgagatgatatttgagtggggacacagagccaaaccatatcagcaaaataaagcagtgggtctctaaagttctcttcaattctaaaattccatgatttatccatttcacagatgcaatgactgagattcagagaggttaactcatttgtccaaagttgcaccactaataatgaccaaactgagtcttagtgcaattatcgtatctccaaatttttactatttcatagtgctccaggaagtctcatgcagggttgagagcatggattttggaatcagacttcctgtgtgtgaatcctagctctacttactctatctctacctcagttttcacatctgaaaagtgagatttaataaaagtacttatttcattggcttgttataaaagttaaaggggccaggcacggtggctcacacctataaccccagcacttagggaggccaaggcgggcggatcacctgaggtcaggagttcaagactagcctggccaacatggtgaaatcttctctctactaaaagtacgaatattagccaggcatagtggtgggcacctgtaatcccagctactcgggaggctgaggcaggagaatcgcttgaactcaggaggtggaggttgcagtgagcctagataaggctgcactccagcctgggtgacagagtgagactccatctcaaaataaataaataaataaataaataaataaataaataaataaggaatgaaatacgtaacacataaaaacttaaagaaggttatatgctaaaaaacagtttacatgctgaaaagcagtttatatgtgagcatccgtgttttaagctcaaccactactgtgatgtcctagacatcttcccaagagaactacggtagcatccttgtgtctgtggtgtcactgacctgccaggaacaaacctataaatatgtaatgggttccatatctctttactataattactatcattttgtattatcatttcccttgcaccatttacaccaaaccttagtctgtcctccccagtagagcgacttgctccttttcctctcctggatctcagcttaggaatacagcatcaaattaaggagctgagaatgcatcctaagcaaataaatggaagtttcacatttgcatttcagcagggaatttctgtagataataatcaccttaacatgtcttgagtccttactaggtgtcaggcactgtgttaagaaccactttaggaacataagagaacaaagctaaggatgggcacttctgtggagacattttatggtaaggatcctgttgtgttcctcaaattatcacccaggttttagccagcttctttaattgagccagcctgttgtgtgtttcttctctaatataatcacagcctgccttttcgttctcactgttgccaaattcaaatgtttgcacagggtagtagtcgaggctgatttgaatctcaaagtaattattcctagagatcaaagatcctagtagcaaaggaataataagccctgatgaaatgccacattgccacgctcactctttgttaaaagagaagtaagttttctcaggtgaagaatttaccagaatactctcacatgcacacgatgattgaagtggcacttttgtttctgctgttattgccgaggctgctgtttagatcaaggtgaggtcaaggagtagagggttgcagctgggcagaggacctgaagagttgccagtccgaccgccaatctttctttgaatctcattgtaagggcaaaaagaaaacatgattttttaaaccagaatcttttatctcaatcagtgtaacgtgcagcctcccctgtgttccaatttgaaatgtgcaggtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtaaaggagaggaaatgagaatgggctcgccggtccttcctaagcacaaccttacagggcaatgccaaggaggcaattgtaggaagccaggctgaggtctgctgggatgggtgtgttctgtgactgttcccaagagccagaggggccagaaatgactggcaatggctttttgatggcactgtcatctccctttctcttcagaggagggtcatgttctttttcattcattattcaagggaatttgctgagcatctatgatgtgccaggttctaagatagatgttggaaatttttaaacatcctgctcttgcagagcttgtaatctaatgagaacaatagataagtgaacatataatgactgcactgtatggaataaggcctcagcttaaaatgaatgatgagagtccagaggagttcacggaagaaggagctgagcgtgagtaacatggatgaaggggaaagaggatttggaaactggttggaaaaaacatcacagagcaggagacaaccaagcagagggttggagggttttttgtttgtttgtttgttttacttttttccattcttttaattttcatttttactgtaaaagtaacgcattcttgctgaaaaaaaaaaaaaacttaaaaatgtaaagaatataaagtaggctgggtgtgggggctcacacctttaatcccagcactttggaaggccgaggcgggtggatcacctgaggtcaggagttcgagaccagcctggccaacatggtgaaaactcgtctctactaaaaatacaaaaattagccaggcgtggtggcacgtgcctgtaatcccagctactcgggaagctgaggcaagagaatcacttgaacccgggaggtgggggttgcagtgagcccactgtactccagcctgggcaacagagtgagactccgtctcaaaaaaaaagaaaaaaaaaaaagaatataaagtaaaaaactaccccctcaccagtcacaactgaaaagagctttgaagaatatatgggagacagctgtgcacagaggagagtgaggggcaggcagagacggtgtgcaactcagtagtcttgtgagtggctagcagaaggaacgcatatgccagaacaaaccctagtgaaactgtgcaactggagcccagagtggaccttgctctcaaatgccctgagaacctggggcccagtcctatatttctaaattctggccttatgtttttacaaggtcaaatgtggtggttcttggtgtcttacaaacacattttcttccctaaaggcaaaaggaaaaaaataattatcaattcttgtggagtacgttggaaatgtaatgcacagaaaagatgtttgctgtatgacagcaatttgggatgtttccattcctcccaggaaaattaagcatttaatgaaattcaaacaatgataaattgtaaattgataagatgaattcaggaatcgtgttctttggagcactagaaagccatagaatgcttgagaatgaggtgccccttgagttgaattaaattaaggaataaatatgctaaaccgattaactagtaatcacagttcattgtgtaacttattagcttcctttcctgagcatacccaagatgactgactcattacattgacagaaaaacgtgttttcccctacagaccttgacctagaactcaactgcttcaaggtacatttctccccttgccctacttaatgtacacattatatatctttcacataagaataaaaaggctaaaggtagagatagatattgtaaattatcaatgagccagaaaagactagtccaaatgtacttttacaatatcttctcaaaatgcaaataggaaaacagaacatgaaatgtcctattcaggattataagcaagaagaccaatatttaaaggggagtgcaggaaagagaccaccatgctaggcatcatctcagttaccacaagacctttttgagatttgtataatatcataccactatagtccattatgccactaaataaatgtgtagaaaagcaccaatggaaagaagattacataaagtggaaataagaccatctcaggctcaaaggaacctacactatcatctagttcaaccctattatttaagagtccatcatatacaggtgcagtggctcatgcctgtaatcccagcactttgggaagctaaggtgggcagatcacttgagctcagaagttcgagaccagcctgggtaacatagtgaaactctgtctccacaaaaaaaaaaaaaaaaaaattgcctatcatgtacttacttcaattagctatgctgtctagtacatttttctccttattcctttagctgaagaggaatagaactggtatccatttggagggacattggactcaactaaattctcaggaatgaagattaagacagtcaggaaaaatattgggatgctaaatgagtggaaattaagggggagcagagtgtggaagtattttgtaaaaaataaaacacattacttaacatgcagaatgcagaggcattccacttttcctcctccaacacacacccaaggaggtccaggagaaataaaaaggcatggagaaacatagaagtgtaaatataggttagcagctcagtaaatattcagaaattggggaggatggaaattagtgtttttaatttattaccaagtcaggtaatctgtaatccaattacccctttgtcattttttaagtaatatgatgtatatgcccatagctacttcttattttaaaaagtataatatccctaggataaatttattataatggcatatttttgtttgtttgtttgtttgtttatgagacggagtctcgctctgctgccaggctggagcatggagtgcaaagtcatgatcttggctcactgcaacttccgcctcctgggttcaagcgattctcctgccccagcctcccaattagctgggactacaggtgcacaccaccacacccagctaatttttgtatttttagttgagacggggtttcaccatgctgaccaggatgatctcgatctcttgacctcatgatctgcccacctcggccttccaaagtggtgggattacaggcgtgagccaccgtgcccggctataatggcgtatttaaacagctatgattccaggtagtcatttgaatagttagaatcaactcataaaatattatcaaaagaaaggaaccttaacatcaccatgaaacaatctatactccttatgccctttattattctaaacattctaaataggcaaaatgggtgattaatgagctaggtcagcatttacacttatagtcagatgtctacaatgtgttaagtttaaatggagcaatgtttttttgtttgtttgtttttgggggggttattgagatggagtcttgctctgtcacccaggctggagtgcagtggcgtaatctcggctcactgcaacctccacctcccagtttcaagcgattctgttgcctcaacttcccaaggagctgggactacagaagtgagccaccacgcctcactaatttttgtatttttagtagagacgggttttcatcgtgttggtcaggctggtctcaaactcccaacctcaggtgatctgcccaccttggcctcccaaagtgctgggattacaggcgtgagccactgcgcccagcctggagcaatgttgataatataacacattatatggtttaatagcgtattatttatgtgtatatgttagaagaaggtctagaagaaggcatatcaaaatgtcaggatttgtgggaggaggagaacaaacaaaacttccaatttacttcatttgttcttttattgggtgagcaatttttacaataagcatatatgttgtatcatataaagtgtattttaaataaataaaataatattgcttagttgtggataatatgcatcttcttatcatagtttgtctctttagaaaattctctatcaggccaggcacggcggttcacgcctgtaatcctagcactttgggaggccaaggcaggagaggcacttgaggccaggagtttgagaccagcctgaccaacataatgaaaccctgtctctactagaaacacaaaaataagctgagcatgatggcacacacatgtaattccagctacttgggtagctgaagcacaagaatcacgtgaacccaggaggcagaggttgcagtgagccaagatcgtgccactgcactccaggttgggcaacacagtgacagagcaagactatgtctcaaaaagaaagaaaagagaagaaagaaagaaagagagagagaggaaggaaggaaggagaaagagaaagaaggaaagaaagaaagaaagaaagaagaaagaaagaaagaaaggaaggaaggaaggaaggaaggaaggaaggaagaaagaaagaaagaaaaagaaagaaagaaagaaagaaagaaagaaagaaagaaagaaagaaagaaagaaagaaagaaagaaagaaaagaaagaaagagggagggagggagagagggagggggaaggaaggagggagggagggaaggaaggaaggaaggaagggaaactctctatcagatgaagagatatagttgactaaatctgcctatacggcttccagcagaattaaaaatctaaaacttgtgcaagaaaccctgatatgaaagagtataaatatgaaagaaagaatgaaaatcccaatttattaattcaatataatcttattttgtttaagtcagtgggaaataaattttggtatatggctccttttacttacatgcagaggaagttgtaccaattcagattacataatttctactgtgtataatcagtttccagtgcgaaaaggtttaaaattcatatcatatcaccagttctgtatgaatccttaaaatcttaatgggactctaaaaaacaccttacagcatagataagctgtaaacaacattgttctccattgattcatgttcctccttggagtaattccacaattttatgtatccaaaaggccaaaaagttaataagatgaataaagattaatatttattgatactctggtttaaacattctcaaactctatgaggtatataattttattacctatatcttagcaatgaagtaaccaaggtaagaattttaattaaattataaagcataaataaacccccatgctaataatgagtagagtcaggatttgattccaggtagtccaaaaaaagaatgtgtgttctttccaccaagcaatactgtcttaaatattagagacactgaaggtcaaagcagcaccttaaccttttagttgaattatcaattcttgtgtgtgccaacattcaaatttaataaatgcattttattcatctatacgttctcactatttttctctatatggtatttgttacgtatccaaattttttttaaaaaaagcagggccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaatcccagctactcaggagcctgaggcaggagaaatgcttgaacccgggaggtggaggttgcagtgagcccagatcatgccacttcactccagcctgggcgacagagtaagactctgtctcaaaaaaaaaaaaaaaaaaaaaagaaagaacagtaaagaaggtctcatgtaaatgagaaatgttctctacaatattattttagggggctacaacagcctggcagggtgcttaccaggatatctcgatgcttagcacagtgacttgcccatagtgtagattaaaggtcccaacactaggcttccagtcccaacactgcatctaaatatatgaccttggccattctctggctttactttatttattaaatgagcactttggactaggtaatctctaaggtcatttccatttatttatttatttattttatttattttttatttttgtttttttgagagcttgtctcactctgttgcccaggctggagtgcagtggcacaaactcggctcactgcacctctgcctcctgggttcaagcaattctcctacctcagcctcctgagtagctgagattacaggcacctgccaccatgcctggctaattttctttgtattttagtagagacagggtttcactatgttcgtcaggctggtcttgaactcctgacttcaaatgatctgcctgccttggcctcccaaagtgctgggattacacgcgtgagccactgttcccggtggtcattttcatttctataattagatattatatgcttctaagtgacaagagactaaagacatttccgtactgacctttgtatgtaatcagctgacaccacaatttagaatgtcaaactatcctcatggtattgctgatttgattatggttagaggctgatgtgtctctagtgtgcatagttataattgacactgatgggtataaagcagttcacagggcttagaacagacaaaatttgaatcttctaggttcccttcaatgttcacataaactataaatcatcctaattttggaatctgacagcttcagtaaagccttctggatttcaaagtcatctgtgattccaaaaagagtctctgaatattataccagcctctgtgtaacattctgaaatcccagctctaaataaatcttattgggtgtttggtttaaaggtgaactcaagcaaacctattattgaaaatctggttcctggtgcccagtaccaggttgtaatatacctaaggaaaggccctttgattggaccaccttcagatcctgtgacatttgctattggtaagttgctagccacaagaagaatgactgacctatatattagggtattgacggaggggtgcaatgtgcgagctcaaatcattatcatcgtatttggaaggtccatattagttcatccaatatgctaccttcagagtaataaataacaagaattgtatacttggaaaacattcttaatatttattacttggggaaaaaatcagaggcaaacattcttactttagttttcaatgattatacaacaagagtaaagctgtgtgccgtggcacacacctacagttccagctacttgggaggctgaggtgggaggactgcttgagcccagaagttgtttgttttttttgttttgtttgtctggttttttttttgttttgtttttttttttttttggagacagagtctcgctctgtcacccaggttggaatgcagtggtgcaatctcagttccctgcaacttctgcctcccaggttcaagcaattctcctgcctcagcctcctgagcagctgggactacaggtacatgccaccatgcctggctaattttttgtatttttagtagagacggggtttcaccgtgttagccaggatggtctcgatctgacctcgtgatctgcccaccttggcttcccaaagtgctgggattacaggcatgagccaccacacccagccaagcccagaagttttaatctagccttggtaacatagcaagaccctgtctcaaaaaaaaaaaaagaaaagaaagaaaagaagaaagaaagaacgaacgaaagagagagagagagaaagaaagaaagagagaaaggagaaaaagtgagaaagagagtgagaaagaagagagtgagaaagagagagaaaaagaaaaagagagagaaaggaaagaaagaaaagaaagaaagaaagaaaaagaaaagaaaagatgaaaggagggagggagggaagaaggaagggggagggcagggggagggaggaaggaaggggaggaagcaagaaagggaggaaggaaggaaggaaggaaggaagggagggagggaggtaggtattgtatcagagagtgaaaactcgggtcattaagtagaagtttgaggccattgctaagacattccttcttaactttctttttctaccccctgccctcttctttctagttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtggtaatcttcccttaaccaactgtcagtctttcctatgggaacaggcaaacctttatgtaccaaatgtgtctttaagaaattatctataaatttgattattttgtaaatacacatagtgtgttagttcattttcacactgctgataaagaaatagccaagactgagcaatttacaaaagaaagaagtttaattggacttacagttccacgtggctggggaagcctcacaatcatgacagaaggcaaggaggagcaagtcatgtcttatacagatggcagcaagcaaagagagcttgtgtaggaaaactccctcttataatagccatcagatctcatgagacttattcactatcacaagaacggcatgggagagacctgcccccaggattcagttacttcccacagggtccctcgcacaacacttgggaattcaagatgagatttgggtgagaacacaaccaaaccatattattctgccccttgcccctcccaaatctcatgtcctcacatttcaaaaccaatcatgccttcccaacagtcccgaaaagtcttaactaattaactcgaaagtgcacagtcaaaagtttcatctgagacaaggcaagtcccttctgcctatgagtctgtaaaatcaaaagcaagttagttacttcctagatacactcggggtacaggcattgacacagctgttccaaatgggaaacattgaccaaaacaaagaggctacaggccccatgcaactccaaaatccactgggacagtcaaatctcaaagctccaaaatgatatcctttgactccgtgtctcacatccaggtcatgctgatgcaagaggtgggttcccatggtcttaggcagttccactcctatggctttgcagcatatatcccccctcctggctgcattcacaggctggcattgagtgtctgcagcttttccaggtgcacagtgcaagctgtcagtggatctaccattctggggtctggaggatggtgaccctcttctcacagctccactaggcagtaccccagtagggactctgtgtgcagtctccagccccacatttccttttacattgcctagcagagggcatgaggtccctgccctgctgcagcaaacttttgcctgggcatccaagtgtttccatacattttctgaaatctaggtggaggttcccaaacctcagttcttgactcctgtgcacccacagtctcaacaccacgtggaagctgccaagccttggggcttgcaccctctgaagccaccaagccttggggcttgcaccctctgaagccaccacctgatctctacgttggcccctttcacccacagctgcagcagctgggatgcagggcaccaagtctctaggctgtacacagcacagggaccctgggcctgggccacaaaaccacattttcctcccaggcctccaggcctgtgatgggaggggcttccatgaagatctctgacttgacctggagacattttccccattgtcttggggattaacattcaactcctcattacttattcaaatttctgcagccaacttgaatttctcctcagaaaatgggattttcttttctatcacattgtcaagctgcaaattttccaaacttttatgctctgtttcccttttaaaactgaatgcctttaacagcaccaagtcacctcttgaatgctttgctgcttagaaatttcttctgccagataccctaaatcatctctcttaagttcaaagttccaaaatccctaagggaggcacaaaatgctgccagtgtctttgctaaaacgtaacaagaatcacctttgctccagttcccgacaagttcttcatccccatctgagaccacctcagcctagatttcattgtccatatcattatcagcattttggtcaaagccattcaacaagtctctagggaattccaaactttcccacattttactgtcttctgagccctccaaactgttccagcctctgcctgttacccagttccaaattgcttccacagttctgggtatcttctcagcagcactccactctcggtaccaatttactgtattcattcgtttccatgctgctgacaaagacatacccaagactgggcaatttacaaaagaaggaggtttaattgggcttacagttccacgtggctggggaagccccacaatcatggcgggaggcaaagaggagcaagccatgtcttacatggatggcaccaagcaagagagcttgtgcaggaaaactcccccttacaatagccatcagatttcatgagatttactcactatcatcagaacagcacgggaaagacctgcccccatgattcagttatctcccactgggcccctcccacaacacgtgggaattcaagatgagatttgggtggggacacagccaaaccatatcacataggtatggctattttcaagtttttttcattgtttttgcttttaggttttgggattctcttttgttttgagagggagagaaagagataattgtgtgaagctagctgtcaactctaattgaatgtatttgttaatcaacattttttcctaagcacagaatagagcaatcaagtgcttactgcttctcctggatcctggggaggaacacaaagagatttccctttggcattccatagttagttgacactgcctaattttaatgatgacttttcatggcatctacagatcaattaaatacctctaatgtcaggcttttagaggatgttttttaagaaaacaggtaaaaattgctctttctgaaattgagataattttgaaaagtgtgggttacccatgggctattcacaaagtacacaattaccctctacccagttgaagactctgaaggactcctgttcgtggtttacactgaaaaaacactgagttgtgagaggttacttgtcttagaaatagggagaaatgtatgtacagtcacttataaataaggactgtttcgcatgtgtaatattaggaaattgcaaaatcaaacaaatattggaaatctttggctctatatctttaaatcacttttaaaaatttatatttttgtattttactttatgtctcatttcattctagaaagaatattttattatagtaaatttaggaaacacaaaaagacaatataaaggaaaattaaaattacttattaattttttatgaaagtaagtctactccaaaaatagtactttctcccacagtcttttgtctccttgcttgcttttctcattcagagaatagctaatctgctgccagcatggtactacaacttccgggttaccatggtgacgtggggagatccagaattgagctgctgtgacagctctaccatcagcttcataacaggtgaggcatgtgtggggaacagttccacaaggagagagcattattgtgaggagttaccaaggttccaaatctctagaaagtgccagtcattcacccagcactgggtgagcatcaatttcatgggagataatattgattctgatcattcattattttgtttagttgataatctttagaaatcaaaataccatttttattttgtgttaccaccgttgacttatttttattctgaggcactgaccttgattaatgtactctccggctgggattgattagaatagaaatatggcaggcacagccatcagcttcacactgcacagtcgattgattttacccatatgatgattatatttgttagagtgcctccattttcttattaattaagccatttttaaagtcataggctgactgtagtagggtcccttgtggaaattaaaaaatagggtttagagacaggtagatctggatttgaatagaccctccgcataccacatataaccttgagcacgttaacttttctaaatatgttttttttaatgtggaaaatggggatgataatagtatcagttatctgttattatttattacaacttcattattatataagctactttgcaaaatacacgacacaaagtttaagcacttaaaaaacaattagtcttagatcctcggaaaccttaaattatgtagttgcatcatcagtagtcagagatagcaatgaaaaggggaaattcatcaaagaaacactaacccttgtggtttgaactaagacgtttcaagaaccttttatcgaacgacaaggttgtaattagagttgtcctgagaaaacagaggagaaaaataccgcttagaggaataattttggcaaatagtttcctcagtagacatctagtttactctgttgaaatgtatgagaaaaaaaaaaagtggaaagaaatcaatcatctgtgaattcttacacaattaacttacataagcatgtctcttttctttactagccaatatccagagcactttttgttccagatgttaatagtaatattagagcagaaaactgaaagaatacccaaaaaggagaaaatagcagttacttggcaagcgctgttagtcttttgcctataatgataatcacatatttaattataagtaaacttcactgtatcaataattcttataatttaactatattgatgtaaactttctgagaatgctctttccttctcaccaggacagttgtctggaaaaagctcagatgtaacatctcaacctgggactgctcaattccagctgtcaaactttgaattatcttaacgattctgggcttctattttctcaccggtagaaccccctaaaatgtcagctaaataggcactaaagcctacttagagacaactgattagtagagcaaaacttaatatattgaacaccaccctgacagtctttgcactgtcttttaagggggaacaaaagaaatgaaatattaataggatttggcttcctggctcaagtggtttaaggtatgcctttcaagatggaaaactgactaggattgggcatagtttataacagtttaaatggacatagcaagtgtggatcaataaactatggttaatagacaagctacttacctggtaagcagtctgttgtcaccaatgtattgatgttgatgattttctatcttttcctgggtcaaataaataagtgatgctgaaccagcagtctacaggtattgtctcagcatattgacagagatggtctcaattttcacatctataaaatgggtataataataataaatacataataataaatacctcacagtatgtgtgagaattaaatcatgtaatgtaagtcactattataatagattattgtcttttttatacttattttctaaacatattgaaaattctagtaggttttattttaaccttcttttttttttttttacttttactttaagttctgggatacatgtacagaacatgcagtttgttacataggtatacatgtgccatggtggtttgctgcacctatcaacctgtcatctaggttttaagccccgcatacattaggtatttgtcctaatgctctccctccccttgcccccaccccccgacagttctcatgtgatgctaatacttataacaaacattcataactaggtatgctttcaaaaataatcattcactgaagaatttgtaatatataaagtaaaaacgcgtgtgtgtgtgattttttttaccttcttatttaaagcaaataagaatctcatgcttaactttcctatgctttgaattttccaaattgtgtggtgtaaaagaaaataggaacaaaatatttgaattaggtgtgatttattaggaactcaagtctaccatctttgttaggcaattcagttggctagccctcaatcatagtaattatgcggaggggccaaagtattaataaacaaatagtgacatcttgtggccttccagcaatatgctaggttttaaagcaacaacatggaaataaaaatctgacatgtgagaggaaagatatatacttctgggtttgcaattttaaagatgtttcttttcctcactaaaattaggacatgagaaaataccctttgaagaaatatatgcataggttcttgtatatgacgaaatatgttggaatatattaggaggctataaggaagccaaggttattttcctttagtagaatattctgaaatatgatgtagatttgtgttacttgttagatgcattgatgatctttcaagattttattgctaagcatactatataagtgctactcgtatttcacatgaaacaaatgcatttttacttcatatattacaaattcttcagtgaataattttgaaagcatagctagttatgaatgtttgttgtaagtattagcatcacattaggggaaatgattctttatagaaaatttccatagattttagttgacattgtgctgtatctcagaatggaacaccgactgtcttcaaaccaacatacacctggaatttaaattcaattgtgtatttgttttttaaaataatcagagttagcagttactttaaaaaggtaattaaaatgttttcagagcctatatagtataaagcttgtgatgaattctcttccctcgttggcaaattttttattttatttatttacgttttttggctgggcgtggaagctcacgcctgaaatcccagcactttgggaagccacgatgggtggattgcttgagcccaggagttcaagacaagtctaggcaatatagaaagaccctgtctctacaaaaaatataaaaattagctggatatgaaggcctgtacctgtagtcctagctacttggtagactgaggcaggagggatgattgagcctgggaggtcgaggctgcagtaagctgagattgcgccactgcactccagcttgcgtgacagattgagatcctgcctcaaaagtaaaaataaaataaaataaaagtaatttttttttttgaggcagggtctcactctgtcacccaggctggaatgcagtggcaggctcatgcctcactgcagcctggatctcctgggctcaaatagtcctcccacctcagcctccctagtaggtgggacaacagggtgtgccaccatgcccagctgaatcttctaatttttttgtagagatggggttttgctatgttgcacaggctggtcttgaactggactcaagcgatccacccacctcagcttcccgaaatgcagggattacaggcattccctgcttaaatttttaaaaatttaaatgcataagatgataaagtagcaagctcagtgttagaatttagcttcgtggctaaaaaaaaaaaaaaaaaaaacttgttcttcccttctttctctctctcactactcactcagcaacatttattaagagcctgttttctgcaaagcactgggctagacactgtcaaaaataatgtcttgttattttatgcaaataacatttgtcttctatcctgcttgtagtactatgatcttctatcttcctacccttgtatcctactgttctttattcccataaacacctttgctgcaagtaaatgaaagagacttagtttgcaggactctaagttttttaatcctacttggctaataactccactgatacctattaatattaattggttgatgtaacaaaaatatacccaaacaagtgaactttttaggaattttgtaatggtgacatttatccaaaagactttgatatcctcaggtacagatgggtctgggggtcttgtatcttagatatacaagatgtgggatcccattaaacaagtgcccatcctgtatcaccatccttcactgttattgagaggtcctgaagttaccgggactatcgtgtgctgtgaattctaattcgctaagttgactctatatgggatttcatgctctgctggtaagtactttatttatccatctattatactaaattgtgcctcgtttctcccttgtagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtatgtttctttgaatgccagcattgtgtgtctgtaaatttagttttatgaactattgaaaaccactaagcaatcatttattgacacgtcaaatgtttgcataccagttgtctgttttaggctctggagataagacagtgaacaaaaattgaattcttcctttcatagagcttaccgtttaatctttaacagtgagatgtaagagctccaactattgatttcatttatatttagaattatgatttgagctttttcttcaggatgccaaacattttcaagaaaactacaattaacgtgtttcccattttttcccatatatcaccgacacctaaagatttggggaccttgggactactgatttcttttctccaaaatacgcttttggatgtttattgataaggggacagactaaactactgtaataaagaaacaaacaaaaagagagtggctcaaacaaaatagaagtttatacctctcccatgatagcacaggactaaccaggcacttctgctttaaggggtcacccagggaggcaaattctgttttgttgttccatctgccactatgcatagtccttgtctctagagaggaagctttatcaccattacatgcatgttccagcctgcaggaaggggaaaagaaaagggatgatgtggaagcccagcacttacaggatgtgaactgaactgtcatttgtccatgtgacttctacttacaatccactgatcagagctgggtcacatcatcccctctagctgtaggagaggatgggaaataacaatggctgttaggtaggaagccacacgtctacagatatgggtaggtttcttttgaacgtcttagaatgtacatatcagtagcaactcagtaattgtcttttctaaaacctgttatcaatatgtgagaaaatgtcagaatgagacccattccaaataagggaattcattgcaaaatttttctgatgtatataatgcattattaaggctacctcacattgggcccagctgaggaatttataaaattttcagaagatataacgtatctataatataatcaattgcagactgctgcatagaacagagagggaatgtgtctgctatagtcctttagttgtttggggtggtgcactgattcattcactaaaagtttaaacccttgattttgatgatcttgcaggtaacacgcaatgtcatgactgcaattctcagcttgcctccaggcgacatctataacctctcagtaactgcttgtactgaaagaggaagtaatacctccatgctccgccttgtcaagctaggtaagaagagtgcacagagatgggtgtgaaataatcactaatgtttgcatcattcgattcagcaagagctcctcaattcaatgaaataataacagaaaaatggctaattttttatgagtagaaaatagacatttgtactagcaaaagggtatgttcaacttggtacaagtttctgtgagtgggttgtatactgttctgggaaacagtggtgttcgctgttctttgtaaggttaaagaaaccaggtagtcataggattttggagatggaagcacattagagattatctaatgcagtgttcacaaccctataagacaacattctattttcatattaatattatgtaatgctctctttaatatcttaaatagtaatggatttaaaaatctacatattgattttttaaattttatatagtttcccaactccagaataaaatcaagacaaaaagaaactaatttataataaaataatatggatttcctaaatatatggtcagacacaactactctaaaagacataatgaaattacctgatgcctagatataattaaaatgaataagttggggtttataagaaataaaaagatcattagtccttcatataagaagtataaaaataagcaaagaaatgaacaagttaatataaattgataacaaataactaaacaagcatagatacaggtagatactagaataaaaactagagttaaaataagtactaaaagatgagatatattttcatataatgagagaaagatggaaataattttaattaaagtagggacaacacaccaaaagtttataaatggcagcatagaagcaagctggcttcactcccctctacccaacagaaaaccaaaagcaaatatacactctgagattttcaccagcaacaacccagaactcaaatacgaggatgcgaccgattccagagccatagagaagtgaaaatactctgggcagatggtaggagaatcaggcttccacattcgtgacgcctcccccgcgattctgcctggcaacaagtgtgcagaaaatcttctgccaactcatgtttctacactggaaaaagtgaggttgaggtagtcaactagtttccccactatcttgggctccctggcaggaaatctgtccttgccttaacccacaggaagcatcgtgactgcctgaagggagaaatagcttgaggataggcagaaacaaagagatgagatggaactaccattcccagtcccagcaactctgctctgtaacttggccaaaggagacaccaaatcagagtggctgttcagcagcaccatactgtaggaggtacatttcacaggtcccttgggcatgagccccccagctaactttgacacactgccaggataattcctttaagacctttctttttcaggacaggcagagccaaggcaaatctggacttaaggtgccacctagagctgaaatgtaggcagtgatctagtggtaaatatttgctaggcaaacatagccaataaaagacaaaacaaggcaaggcagacaaaggaaagtggactaaatagttaattatttaatgcaaagacatagttctatgcccataagaaacaacatcaaacagggaactgtgacccgcccacgctacccaggaaaaggacaaagcaaaaatccaatgactgaccctaacaagatggtgatctgtgagctctctgaacaagaattcaaaatacagtttaaggaaaatcagtgatgtccaggaaaacacagaaaagcaattcagaaatttatcagagaaatttttaaatcaaacaaattcttggtactggaaaatacgtttgctgaactgaaaaacacatcacagcagaatggacaaaggagtggaatgattcagggagctaaaagcctatctgaaaatacaccattggaggagaaaaaagaaaaataagactgaaagtaagtgaagtctgactataagatattaaaaaaaaaaggctgggcacggtggctcacacctgtaatcccagcactttgggaggccaaggcgggcagatcacgaggtcaggagatcaagaccatcctggctaacatggtgaaaccctgtctctaataaaaatacaaaaaaaaaaaaaaaattagccagcatggtggcgggtgcctgtagtcccagctactcgggaggctgaggcaggagaatgatgtgaactcaggaggtggagcttgcagtgagccgagatcgcaccactgcacaccagcctgggtgacagagcaagaatctgtcaaaaaaaaaaaaggtattaaaaaaaccttaaaagatcaaacataagaattattagtattcaagggggagctgaataaggaagtttactgaaagaaataataatagaaaacattccaaaacttgagacaggtacaaatagccaggttcatgagggtctgagaataccaaacagataccactcaaataaaatcaccccaaagcgtataatactcagactctcaaaggtcaaggacaaagagaagatcctgaaagcatcaagagaaaaggagcaaataacaggtaaacaagctgcaattcacctggcaacaaactgtacaggccatgaggaagaacatttttacagtgctcaaagaaaaaaaactgccatccaagaataatgtatccagcaaaattgtccttcaaatatgaaggaaagataaagtatttctcagaaaaacaaaagatgaaagaattcaccactaccagacctgtcatacaagaaatgcaagagagttcttcaatctgagagaaaaagacacatgcgaaaagaaaacttttcaaggtattagacctttgggaaaattaaatgcatggaccaacccaggatattctgttactgtgattgtggtgtacaatccatccataactctggtataaagcccaaaagacaaatcttttaaaaataataatagctacagcaacctgttaagagataggtaatgtaaagcatgtaaattgaggcaacaaagtcaaaattgggtggtggagagagatgaagttaaatttttaggtgtggtagttttgcttttgtttctattcttttgctcatgatctaagataagttgtcatctctctaaagtaacttgttatggccaggcatggtggctcatgcctgtaatccagcactttgggaggtcaaggttggtgaatcgcttgagcccaggaattcaagacctcatctctactaaaaaaaaaaaaaaaggaaaaaaagaaaagctgggtatggtgacacatgcctgtggtcccagctacttgggaggctgaggcaggaggatcactttagcccaggagattgaggctgcagtgagctgtgagctgtgattgtaacactgcactccagcctgcatgacagagcaagacccccatcttaaaaataagcaaataaataaataaacttgttaaatctataagattttttataagccttgtggtaaccacagcacaaaatcatataatcagttcattaaaaataaaaagcaacaaattaatacataacacttaataatcacttaaccacaaaatatgaagagaggattctcaaaacaatctgaaaacaggcaacaaaacggcagtagtaaatccgtacttagcaataataacactggatgtatatggtctcaattctcaattaaaagtcacagtgtggctgaatggataaagaaataagacccaactatatgctgcctttgagaaacccacttcacctgtaaagacacacagggactgaaagtgaaggggtggaaaaagatattccatgcaactggaaaacaaacaagcaaaaaagcagatgtagctatgcttatattagataaaatggaccacaaatctagaattgtaaaaacagacaaagagggttactatataatgataaagggatcagtttagcaagaggatataacaattataaatatctatgcacccaacactggagctcctaagtaaataaagtaaacattaatagatctaaaggaacagatagacttaattacagtgataggaggggacttcaacaccccactctcagtaacgtatagatcttccaacagaataacaacaaagaaacaacagagttaaactacacatgagacccgataggcctaatagacatttaaagaacatttcacccaactgctatggaatacacattgttttcactgcacatggaacattctccagaatatatcatatcttaggacacaaaacaggtctcaacaaattcaaaaagtacatatcatatcaagtatcttttctgaccacaatggaataagactagaaagtggtaacaagagaaatctcaaaaaataaacaaacacatggaaattgaacaacatgttcctgaacaaccaatgagtcaatgaagaaattaagaaaggaattttaaaaattcttgagacaaatgaaaatgaaaatacaacataccaaaatctgtgggatatagcaaaagccatagtatgagggaattttatagcaataaatgcccttaatataaaaaagtagaaagttcaaatacacaacctaatgatgtacctcaaggaactagaaaagcaaaagcaaaccaaacactaaattagtagaaggaaagaaatgtaaaggtcagagcagaaataaatgaaattgagactaaaaataaatacagaagatcaacacaacaaaaagttggttatttaaaaagataaaatcaacaaacctttaactagactgagaaaaaaagagagaagacccaaagaaataaaatcagaaacaataaagtaggcataataagagacctcataaatacaaagaatcatgagagactactatgaacagctataaaccaacaaattggaaaactagaagaaatggatagattcctgaacacacctaatgagactgaacaattaagaacaagaaaaccttaatgaaccaataatgagcagtgagatgaaagtcataataaagtctcctaccaaagaaagcccaggtcctgatggcttgacccctgaatttcaccagacatttaaagaaggactaatgccaatcctgctcaaacttttcaaaaaagctgaataggaaggaatacttccaaattcattctgtaagataatatgccaagaaaaataataggctgtggataaggaaaaacagatactttaacattcttgcaaatgaactggatctttttgtgtagtgtaatgtcaaaataattctttatattatgacatacagctggaaagtgactgtgtagcatacaactggaaagtgactgtgtaacacaaaacacatcttctacattcaaaaattgaccatttattgcggtatacatttagtttctgatacttatagggaaactcgaagacagtatcctaaaatctgccacagacaatggaggatggattgacacaaagttgtgtgatagacctttagagacagtatgaccgaaagagtggcaacccaaaactaaatgcataatttcaatatgtaattttcacagcagagattttataattttcatatttcaaaaattaagtttatctaatggcaataaaagtgttttccacatagttaatgcaatttagtgacatcattttttaagatgtctgctaatttttgtgtctgaatttgttcataacagtctcaagccatctctgttattacatgtgttcatattagcagctgtaagtaaagactaattcgtggttgttttattagtagcttaaataccatgggtagtattgttggcagtgatgtacttttagaaaaattttagaaaatctaaaaaacaaaaaatacgatctttcctcaatttacccagtaattgcatttctccagaactcaatgcataggtcactgagtcttaaatttctttgtctcctatttgccaagacaaaagctaagtttttgtgctgaaatactttaaaattgtataggtaatttggaaatatgtgatgtgttgattagacactatggaagtaaaaattataatattgaataatttataattttaaatactatcttaattggatttaaatatgccttttcatgacaactttcttctaaattattttacttaatttctttttaaaaactttcaatattatgtagcaaagtacttgcaatttacacttatggtggattttctctggtatgacatttgaaagtcatgtgggatgtgggacatgggacaatttgtcttttggtgtcctcttaataattccaggacggctagcatttctaagtcctgaccacaaaagaacagctaattccctctgctgtgactaataaaaacattcctccaaactttcaaacaccctcaagggggcactagtgccccaattgaggatcaagggttgtctcttacctttcctgcactgaaggcaatctgctcttcctcccttgtggtctatacttaaattctacgaatgtggagagcaccaacttccaactttgcataatctttctattaagaaaaaagttgcctgtctaccaattccagccattatctctgactctgacctctgtgggtgtaaagggccgttcaaaaactcatttccaggtaactgtaattacttgaagattgagctcatattcccaatgtcttcctttttccaagctttactaatacaggaagctattaagtgtttctcaggtcctagcagctttctccaactcatttggtttttcagtctcccttaaaatttaagttcagaggtggtcttatcaaagtagcatttagtgggcctattggatacttcactgaaatttctatgtgacatcatggtcgaaggtgcctcaggaatatgagtcaaagtcatgaactagtacaactgtatctacataggactgtgagttaaaaccatgatagtttcccaaacttatcaaaatgtttggagtctccatgtctccctgataatagaatggactatgtaaaccagcttggaaaatttatttaaactttacaagaaggaaagttgagttttcatggaaattatttctagttaatgtaacccttaggatcaataacctttttcttattggtatcttaaatatcaaatggaatattgtttctatcttattcctctctgtagacaagacaatctttttatgatgtgcctttcttattttcttgaaaacatataatgttggtttttatcctttagtcaaaagatctgttctactaatcatgttattgtgtatataagccctttccattttatataacacaatgcctgaacacctataactgcttaacagatactgttgaatgaattgaaattgcggacctcaaagttgaacatagtattgcagttaatatttaatcggaacaagtttaacctttcagagaagtgaaataatatcttgctttagtagtacctgaattgcaggttttgtgtgtgtttgtgtgtgttttttacagaactttcattctagttgttttatgtttcttcccagcattcattttgatatatatagaagtcatagtcattctcctttaaagaaaaatacaactttggcacagatttttcagagcatgtttgaatcagaatgccattgttaaagctggggccgtaactggttgggctaacctgcagttcaatttatctataatagaggcctctttagaatgcctctgaatgactcctgtgtcatggagggtaggttctacctctatagaaagaaaccaaactaccaatgagtccagtatcatataaattaatctaatgtgtcatgtgcaagggtagagagccctcaaacagttgccaataattctcaacattgtatcatcaataaacatccataaaaagaaatgcaccaataatggtgcttttcccaggatgttgaaccaaccatcccattaggaattttaggttgccagcagtttcacgaaactttggtggtatgtggtgacaggtccctttgacagtcagtcattactatcttctagtcttggtgaatcaacctggatccctgggccaactttaagaggacatgttaagtctacataagataatcagtttcccaaccttaaaaaaaagaaaaagaaaggaaagaaaaaacaggaatgagacgtgttggacacatcacaaatagctctctggtaatagaatatccattcatcaatccatttaactaatatatattaagaaccttctaagtactactcagatgccagagtacttgtggtagtcgtgatggtaatgaacccagagcgctactttcactttctgttcacaaggagcttatgatctagtgaaggggaagatggtaatagtgctgtacagtgctctacaacagggaaatgtggtgcagaatgactgtgtggtcaaagctttctttgaggaagccatggaggctatggtctgaataacaagaagaaccagccacaaaaaggccaagaaggaggatgccagacagagggaacaggcaggcctgagtatagatcttttaaggcatgcagttggaatattatcttcagagtaatgaagggccatttagagaacttaaaataaacagtccgatttacatttaaaacaatccctctggttgcttaatgagaaagggattattgtatcaacaatgaaagtaggggaactaattaaggggctatttgtgccagctttaaaaattatattctaattcaaagaagttgcaagagagtgatggtaactttgactacggtggttgtaatggagatgaagagaagtggacagaattcaggagctcttttggaggttgtgtccacagaactttctgatacggcagaaacacgaagtgagggaaagggaaattaatgactcccaggcttcacccttgagcaactaggacaaatggtggcgcaattcactgagattgagatgactagtaaaactacaggaggaggacatttagggtgaagtaagaatcaaggattcttctttggatgtaaacaaatttaaaatgattattggatatcccggtgcagatgtgaaggccaggggagaattctgggctggaaatataaatttggaagtgtctggatgaaatcaccaagtagtaagtaaagacagggaagaaaagagaagccctggatcaactctagaggagccaccccagcagttagaaattcagcttagcaggaagcatcagaaagagagagtggaaaggaacagctaaggaggtcagagaaaacaaaacaaaacaaaacaaaaacagaattgcacaccaccatcatcaaacttatgctttatcctgaccacagacatgttcgggcacgttcgagataaggaatcatataactttagtgctaggagagcttttggagataattcagtgctatgtcctcatttgaacaagctggcgcttagagaaatgtgacacgctttatacattgctaggtcttggtccagaaacagtcatttcgtactttttatccatctgctgcttctattcctggactggggtgtggcctttttccttcaaacttcattttttctattaaaaaatttaacagaacagggaggagcctcatacccacttttgtgactttccgttcctctttggaatttggtcttagggacattggcttgattttcttaatcttactcatacaaacctttatagagattagaaatctttaaaacataatttggctatggacaagaaaaaaatcaaaatactttgaaatgttaagtatttgggggatagtaggctttttctctctgtctctctcaaatatggttatagatacatagaaatctgtaggctgccagtcagctagaaagaagctaataaaatgcttaaggtcttatacttttttaaaaaattattcatcctgtgaatcagagaatatttacttagcatttactatatgccacacactattcttggttctgagcatacagaaatgaacaaaactgacaaaaatgtcaaccctcattctaatggagaaaaggagatgataaacataaatataagaatgttaaatggtgataagtgtcatggagaaaagtgaaagaggaaaagaggataggaagtgctgtgggggatgggtgcaatttttgtgaggagtagagtaagtgtcactgtgaaggtgatgtttgagtcagagcctaaaggagatgagggagtaaaccaaagagatcactgggatgagattctgtaggcagaaggaaccacaggtgcccagctatggaagcatagtgttcctggcaagttcaaggaaaagtcaggcaggcagtgtggctgcaatggaacaaacaaggtagagagccatagatacagggcagagaggtagcaagggaacagaccgtgtagggtcattgaaaagacactttcctgtgagtgagatgattctccattgcatgctttaagcagaggcgcataacctaacgggtttcactgggtcactctggtgataatagattgttcagggcaaggataagagcaggaaggagccaattaggtaatatgaccatacatccctgttgccttagacaataccactttgcaactcttatggattatttaaaaggcagtaatcctctttaggatttggggcaaggcttttctgccccaaaagtgttcccgtgtggacatttttgataaattacatggtcaccttaaagtttagagaacactgagtctgtccagataagagattatacttgtttaggtcagactgggagccacagaggcgatgaaaagtggtcagattcaaaatttattttgaaggtgttgctgagaaaatctgctgatggacttagatgttgtctatgaatgagtaaaagcagcctagagacacagcaagatttgcggcctgagcaattggaaagacagaggtttgatttattaacttggaaaagattatgggacaggctggtttggggcaatgtcagaagttcaggtctgggtgggtcaacattttgaaggttcctatgaaaccattaaataaatactgagcaggcagttagataaaggagcttggattcagtgaagacttcaggactaaaaatataaatttgagtgtaggcaggcgacagatgtgatgagttaacaaagactcaataaagaaaaaataatgctatccaggaactaagccctgggccactccaactttaagacatggagatggtgagtaaaaaccagcaaaagagactgaggagcattggccagggaagcaagaaagagcacagaaaagtgtcctgtcccaggagccaagggaagagaaagcctcagcgagtggagattgtccaggtcaaacctgtgaacaaatctggtaagatgaggaatgagaattgaccactgatcttagcagcccagaagtcactggtgattttgagaagaggcatttgggtgccatggtgacgggaaaaaaaaatctaaaatgcacaggagctaaagaatagaagaatccaagaatttttggtagttttttgtttttattttgttttctttaagtgagtgaaaacagcttgtctgtagactaagcaaaatgatccaacaaaacagagaaaactgttgatgcagcatagttagaggtgagacttggtgtgatgtccttgactggagcagaggagatggaacccggggatccagtggaaggattgggtctggatatatcttcaggaagacaatgacagacaaacagacagtatgggcattaatgggatagtgagcagagtgaagatcatgatagccgcttgtggatggtttcttctgattgacttcttgtaagataaacacatgcatgttctttaggtttgcagggggcaatacctgccatgctactcttctgatatatacctccatggccagcagccccatgcaagcattgttttctgatttaggttctcagtgacagccatgccacagtcccatggctctgtacctgggcctgacactaaccaatccctcgcctcaatatacccctcctcactgcagtcttctgagtgtcaccatggtttgtcaactgcccagaggcataccaaaccactttagtgcttctttttttttttgagacagagtcttactctgtcatccaggctggagtgcagtctctgctcactgcaacctctgcctcccaggttcaagcgattctcctgcctcagcctcccaagtagctgggattacaggtgcgcaccaccacgcctggctaatttttgtatttttagtagagatggggtttcaccattttggtcaggctggtcccgaactcctgacctcttgatctgcccgcaagtgcctcccatagtgctgggattacaggcgtgagccaccgcgcccggcccactttagcacttctctaaaggcatttctcctgcccatcataaggtactgcatattctgcaggtacatgattctctccaatgtattggaagaatctgaaggagggacacatagggcaatgactgtgaagtctggcattgacctaaatacacaagcaagtgcccactctggaaaagttggtcttctaagcaaaggaatttttctggaggcctggtcatccccacttatatgcaactgactgggtaactcgctgattgggaggaaaacaggtgtaataaggacccttgattaggagtccagaggtgtggatcccagttcttgccctcacaaacaaattgtgttaccatagcaaagtaactcagaccctctgaattccagcttcctatctataaaatgagtctgggctagatgatcttttatgctccttcaacttttagaatttcattccatacctgagttcagaataaaagcagcaagattaatgatgcaatgaaagtgctgatcttattctaagaattttgcaatatatgactcctaacaaaataaaaatgctaagtaaaagcacatgctcctggaaccactgaaaaggaggtattcagatatttgttttgaaactaagtgaagagaatcagaagggtgagggggtgggaagtgggtggatgatgagaaattatttagtaggtacaatgtatgttatgtgggtaatgaataccctgaaagacctgatttcaccactatgcaatctatgcatgtaacgaaattacactagtatcccataaacatatgcaaatttttaaaaatttaaaaaaaagaaagtaatgttaaatgggagctttctctgaaaaactctattgatctttagaagttacttaaggtactaaaactatcaacccatctagtgattcacagaagaagatattatacttgctatctctaagccttaaagaatataggtaaggctgggcacagtggctcactgcctgtaatcccagcactttgggaggccgaggcgggcagatcacttgaggccgggagttcgagaccagcctgcgcaacatggtgaaaccctgtttctactaaaactacaaaaattagctgggtgtagtcgtaggtacctgtaattccagctgctcaggaggctgaggcaggagaattttttgaacccgggaggcggaggtcgctgtgagctgagattgcgccgctgcactccagtctgggtgacagactgagactctgtctcaaaaaaaaaaaaaaaaaaaaaaaaaaaaaaaaaagaatatagttaaaaagtaatgcaaatgacagacatttctaactcctgagaaaattttatttttatatataggaaaaaggcctcataatttaatgtgttttcaggtgctaaatatttgcctgaatttttttttttatttcctggttttttttttaaatgttcaaattacttgttaaatgtatctaggaaaagaatttccctaagtcaacaagacaaggtctaataaacttcaggtctaacaaagacttctgctgtttaatgtaaatatttctctccttaatttcattgcatatcaatcttaactcaccctgaataatttctatacctcttgtttattttcctttcagacagtgctttcttttgcagatgttatttcaccaacttgagcatagtttctgcagtccacactgcttacattgcagatgcttcctttggccaagtcgaatatactatatgacttacgctgcttaacatagagttgcttgagttgaggaaaataaaaataaatttaaaagacttatgacaatatagatgttaacatttatgctttgcatatgaagagcattctaaaaaactgttatcagtgaggctaaagattgaaaataaatgttgttatgtggatcatggattaagataattttaacaatacttttctacttaattttccttattaccaatgttgcacatttgtaaaatgactcaccacgctggtccttatggatataatcttggcctcataaacatcattctctaggcagctaaattaatgagtcacattaaaagaagaaacaatgtaatagctatcagagaaagatgggttttagacaataaacacattacattctgctcctaggctaaatattacatctgactattccctttggaattcctgagaaaaggaagagatttgctgccagagcacagaataagaatcagacactagctcacacttcaggaaggtcactttcactccccagagatcctaggcaacagcttgagcctctcataatccaatctaaattaaatggtagagatggccttgcagccttccagtctgcccatattctatgcattgtacttgattttcttataaaattagattggattctcagtccaaacccggagaggcatggaatgagagagaagaaaagaaaatagggaaggccagctagttgagtggaacgccagcaatattagaaagcttttagagggtatttaaaagcaaacaaccctatatctatacctcattttatgaaaatggtatgtctatcccccttacccatatacataggtactcacaccaaatatcatggactgtgaagttattttaaacaaaaggaaatttgaccttttggagcatgagaatatggaaaatgttatgattgaaaatgtcatttagagagataaaaagcaatagccaggagatgttccataactaatatctacatgactttacattatataaagtgtttgtgtatgcattgtcttaaatttcatttactcttctcaacattattggttttttcctatccttctgctttagaagactgactgtatttgatattttatagggttttttcatccctcatgtgcagaaagggacatatttggtattttgaatagtaagagactgtattagtttgctagggctgtcatagcaaaataccacagactgggtggcttaaacaacagaaatttgttttctcacagatctggagtctggaagttcaaggtccaagtgtgagcagagtaggcttctcctgaggcttgcagatgatcactttgtaactgtgtcctcacacggtcttttctttgtgcttgtacatctctttactgtttatatttcctcttcctataaggacaccagtctgattagattagagcacgtgctaacagcttcatttaatttaatcacctctttaaaggccctattcatcctgggtgtggtggcttacgcctgtaatcccaaaactttgggtggctgaggtgggtggatcacttgaggtgaggagttcgataccagcctggccaacatggtgaaaccccgtctctactaaaaatacaaaaattagccgggtgtggtggcaggcacctgtagtcccagatactcaggaggctgagtgggaggatcgcttgaatctgggaggtggagtttgcagtgagccaagatcatgccactgcactccagcctgggtgacagagcaagactccacctcaaaaaaaaaaatagtcacattctgaggtactaagggttagggtttcagcatatgaatttaggcggaggggatataattcatcccataacaaagatagaaagcaatcaaaatgcctttgatgtcattgtattccctatcatatgcaattgcctaattaatatttagccactatctactttaatcttgtgcttctgagaatggaaaacatgagtcatgtaaaccaggggtgtccagtcttttggcttttggcttccatgtgccacactggaagaagaattatcttgggccacacataaaatatgctaacactgatgaatcaaaaaaatttcactaaaagtatctcacaatgttttaagaaagtttatgaatttgtgttgggctgcattcaaagccattctgggcagcatgcggcctacgggccatgggttggacaagtttgatctaaaccatcttaggctgtggcactgagctggccttgacttctcatgagaagtgggaaccccctagccagtttttgccagaaatttccagacttctactctaggcaataagaagaaatgctctaactcagtactattcatttgaaacataataagggccacatgtataactttcaattttctagtagccacattaaaaattagtaaaaagaaacaggtaaaattgaattcgatatactttatgtaaccaaatatatccaaggtcatattgttccaacatataatcaatataaataattattaataagatattttattcttttctcacactaggtctttgacattctgtctgtattttacatttgcaacacctctcaatttggactagccacatttcaagtacgcaacagctacatgtggctagtggctgtgttggacaattcacattccgattcttacattttaaaacatttcctgggacagttgttgtcttgagtaggaaaatctaattataagcactcccaattcaattatactttcacttgtgaaatcttgtaatagtaataagttcataattataataacaataaattgtaataactttctttgtttcctttgggataccagagttaaatttctgcctgattaatttagggaagcacaccaatcacgaagatcctgaacagtcctcaagcaggtgatttatgtatgtattcattgacctatagagctgacatgtaaacgtcttccagaaaagtacacagtgatcacaggtgcagggaccttgaaataatctattgccctcatattccacccaaaaagaaaaatttgttacgtggttgttagatgtcccagacctttaggagattttcctgaggatcttatcacctagagccacattctcagccagaacaaaggaaaccctcactgcagtattcatgtcgtattccttggaccactgggagctcttgcagtaattcatgatagttcttgactttgcccctgaaattggataattttacctacataaaaacagaagagaacattaagatacaacctcagcgtgtctggtcttgcctggtgcttgaatcctcctcttttggttgatgaatcttgactcatgttttaaatcagccgataaataagattttttgagtacctataggtggctacttcaaatgaagacaaagtcatttataacacatgacccttgttcttaaagaatctaataggatctactagaatcaggccttcactcacatagattatataggaaataattaaaggcagtagaatgtcagagaagggataaatcattaagagaaagagtcaccaaatgagacttcaaggaggaggtaagactttttcttgaccttcgaatgagcagaataaagagcatactgattgaaggcaaacatgggctgacatagagcactgccctgaagttcagtgagaagactgtctttcccaggaggcaacacatctgtgtgtcaggaatggtggtgaagctggttggatagcatgcagccagtttaagcaggatcttaaagacatggtatgtttggatgtgataccacagacaatgcacagataggatttaacatgagtgaaatggcattttaaggtgattttaatccgttgttgacaaaatgaagaaagaattgattagagccagggaaaaagaggcacagcaagtttgtgatgatcaatgaatgtgatcacaaaagtctagacatgcaatataatttaaaaatagattaaaggaggccgggggtggtggctcatgcctataatcccagctcccagcactttgggaggcagaggcaggcagatcacaaggtcaggagatcgagaccatcctggccaacatggtgaaaccctgtctctactaaaaatacaaaaaaattagctgggcatggtggcatgcgcctgtagtctcagctactcaggaggctgaggcaggagaattttttgaacccgggaggcagaggttgcagtgagccgagattgcaccaccactgcactccagcctggtgacagagcgagactccatctcaaaaaaaaaaaaaaaaaaaaagattaaaggaaaaggtaacgagtttttaaaagatatgctctctgggactgagaaataagggaagagcctcagaattgtgactgaggaacaattctgtagtgtgcatttttaaaaaagaaaagcctaggctcagcctaactaatcattcatctatgcccccaaacaacttcacacttggttctatagattcaagttccacatgagtcagaatccctaaaggacataatcctattagcaaaggcagttataaaggaagtgagaagtggaaattgacctctgtgtttcattagcagtcttcctcagagcagaagtgggacaatacaatgcctggaggactggacaattcattgcaagtgaaaaagggctcctgacacctattgtgaattttgcttgcctaagaagaactcatctctttcctccttcaactcttctgcctaaccttgtcaagttgctgcaggaaagaaacatgcttctttttagttggacacaagtttaggagatctgtgataaatcatggcaagaatgattttgacatacttcttggtcctgggcagagtcacaatgatgatattctagaaacaaggttcaaatctttccacacaaagatgtgtacctgtcaaagcagtgaaatggctgacaggactttttcaagcacctctaaaggacaggagctggagaacagacttaggagagtggggcagaaaatgaaaaatccaagtaacaagcaggaagaaacctacaacagtgggtagtcgtctgacaggcgcatataggtggatggaggatgctgttatgtgaacctagcagcaaggtacaatatgtccaaataagcaatgtcagggggtctgagagcaggtaacagggaccccagcttaaaaccttgagttcaggcacagcactctgcatactgggggacctagagggaaagacaacatccaaaagacagggtcacaagcagaagaccaggagacattcaggaatggagaatgagacagcagatgactattagaattgaggaacaggcagggttttttggtctcaagagagcaatgccagtgactcaattactagaaataagtatgaaaaggacagacaacacagcttcctttacgaatggatttatttattattaagataaaatgtctaagataaaaaatttatctaatgttttattaatcttccaatcccctcctatcaattcttttcttaaaaaattatattatcagccaggcacggtggctcacacctgtaatcccaatactttgggaggccaaagtgggtggattgctggagcccaggagtttgagaccaacttgagcaacatggcaaaactccatctctgcaaaaaatgcaaaaataagccaggtagtcccagttacttgggagtcgaggcaggaggatcacttgagccagggaagatgaggcttcagtgagctgtgttcgcactactgcactccagcctgggtgacagagtgagacccccgcctcaaaaaaaaaaaaaaatgatactatctgtttagctttatctttttaaattttgactaaattttcaagcagccatttttctgtctgaattgttccagatagtttccagagaaaggaagacaggttgttggctaaataccaaactgcatctcatcattagaaggaagcacaccaaatttcatttttctccacctttattaagtgcagatttttgtttctcatccaggaagttctgtattatcagggcaatgctaacttcagtataaatgacacagaaactattaatagattatgactatgatgaaactgaagtagaaaacagaagtgttctgaaaagagaagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggtactgtaccttttgatctaccttttctcagttaacttaagtaaggctaattatctgggcaaaataagaatcttctatttctttgagctatataaaatgaaaactgtttatttgctcttttgtgtttcactgatagaaattaacagcaggcttagaccaagcccaaaagttgttatgagaacttttatctttgtctgtatcacttgttcctaattcataagtcactccaggtcagacaaaggaataaaggtagtaggccattgaattgatcaagggaagaaagaccctacaatataaaatataatttaacaaatatgaaccatttgccaagtatataaaggcactgaatagaacacacatgatagaatcaatatttgccttcaaaacatttttatatggtgtagacattgcataagtatagaaaaaagtaaagtaaaatataagtaccacaagacaggtccattcgaccaagagaatttaaaagaaacgtgcatatctagtttgtaagggggacagtcttattgcaaaatgaagactgagagaaggttattgctaaagctctagaattacaaatggcagatacgataaacagagttattcaccaggtcagaatgaatgaaaggaaagagatgaacctgcagttctatgagtggcaacgccacaaggaaaaaatatttcacagccagaagtgaaaggaaaaggacagatttgttagggattttacataatatagtgtgtagactaatactgcgaacataagtaattgatcttttttaaataatgaagttcatgagattgagaagaaaaaaggaatgctgggagtgcaaatcttttcatattgaatgctaagataatttgctttgattcctttctccttttgagattcccttctatgaatgtatctcttgttgatttgtactgaacagctgaattttctctattctaagaatccttttggaaaataactgctctgccaataatggattttcttctctataactacagtgatgccttcctttaagaaaacaatggttagttagctacttactacaactgagtcctgttagcaaaagtctttccttagaataattcttttatagaatagtgaaagagaaggaagtggaagaaaatgctgatggctctcatttctttatgcaagggtgtttcaaaatcttgttttgaaaaaaatgctggctcatcttttgctgttgtacagtagtacttgtcactagtctggccatgggtccaccaagttagcaacttctttgactcaagaataagttaatactaaatgtttcttagtgcggatagttgccatgttttagtggatgttatataaaagctaagaatgcagacaaaggtgtagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaaatgcaaaataaaactacaatatacaattttcactagtaataatgggaaagctcagagtttgcaaatgtatggtactggaaagaatgtagggaggcaggcattgtcacgcattgatgccaaaggtgagtaacttgcaaaatgtctgtagagaactatttttctatagctttcaaaattttaaatgtacactttttgactcagcagttcaaagaatgtgacactagcaaagaatatatgagtatatgtgtatgtgtgtacgttcacacatatatacatattacatgcatatattgtgtgtatatatgtgtgtatatatatgtgtgtgtgtgtgtgtgtgtgtgtctatatgcatatgtgtgtgtcttcccaaatttgtgaaatgaagttcattgtagcattgtttgcaatagcaaaaaatcagagaccatttacacattcatcaaccggggctcattaaataaattatggtatgtcctttcaacggatttctgtccagctcttaaaaagaataaaacagcttaatctgtactgatatggaaaaagcaccaaaatatattgatagctaaggtaaaaaaattagcagaataatgtgtaggctaagccatcacttatgttttttaactgtgtcatatatgttcatacatccataaaatgcatatgggaagaaaaataatgcctgacaacatggaataatgctgcttccatggaagggaattggtcagatggggaatggggaaaaaaggaaacatttttcaatgctattctttgtcatcttatacattttttactctgtcaatctattaccaactcaactatgaaatatatttttaaaaaatatagatgaagttaacctaaaatttaccttattttctgaaaccccaggaaccagttgctgtttcttcccatgtcgtgaccatctccagccttcttcctgccactgcctacaattgtagtgtcaccagctttagccatgacagccccagtgtccctacgttcatagccgtctcaacaatgggtaattatacacattagtgtataattttctcactttttttgaatatatatatatatatgtatttgtatcaatattccaccaagaaatcccaagcttcggagtcagagagtccttaatttcaatcccaaagtgcacttactagctatggagttagagaaagacatttggtgcctctgagcttttctttcatctgtaaaattggaataataatatgtaactttctgagttgttttgaagcttagaaataaaatacttaaatccttagtatatgctgtctaaatgctagttgctaactcatctcatcttcttcagtaataggcacagtactcttatcaatccaatttcatctatttagccttggtcttcatctgtcaccgatcagagaatgacataattgataactgggtcaaagcaagaaagtttccaatccagccaaaagtataagtgggaaaattagaggttaatgaaaggtctggaatgatgctgtttatttccttattcttttcttagttgtattacatgtgttactcctggtttgttagagtctgattctgcaacctgagaccctctatgaagcctcttgtaataaagtcactcataacttcactggtttagttccatttctgtaatattagtcatatatttagctgctaaattcagggatgactggagcggactgttttcttttttctttttctttttggttttctgtttttaatttttgttttttcagaagagaggacaaaaaatatacctgcaaagtattttaatggtctctcattcctacatccttgtacactttctaaaatatacagttgacgatgaataatgagagacttagaagtgccaacctctgcatagttgaaaatccatgtataatttttgactccctcaaaacttaactactcataggctactgttgacctgaagtcttaccaatgatatagacagttgatcaacacatttttgtatgttatacttattatatattgtattcttacaataaagtaagctagagaaaagaaaatgttattgagaaaatcgtaaggaagagaaaatatatgtactattcattaagtggaagcagatcttcataaagatcttcctcatggtcttcacattgagtaggctgaggaggaggaggaagaggagggtttggtcttgctgtctcaagggtggcagagagtaaagataatccatatatatgtgaacctgcacagttcaaactcattttgttcaagggtcaactgtaccttaatgtccatcattccttgtcagctccatgacaatgtagcataacaggtgatattattaaacttatttataaatgaggaaaatgaggcccatagggcagatgaaatggcttctctccaaatagcagtactcaagcgaaaaagctcttctgatcatgcgtccattgttctttctgtttaagcactctactcataaactggagccaagctggcccaaatgggaagtggtaaatacccagaaccttagggatcagatgcacctgctcattctgtgactttatgatcaatgcaaaagatggtatgagtcctcaggcccattttaaagagttttataagaatattaaacctatgttcctgcctttgatatcctgttcttccgtgtagtatgaagaagtagacaatgtgtaagtgccacaggagacaagtctttatatagagtacatgaaaaggacgtgacccctgttcttcagggccctacaacctattaataggttttatctcttgagctgtgcagatggaaaacccctaaacatatggccacggatcatcagaatgtctgcttctagtaatgtgttaagtgcttcagcagatggtagtttgctaatgtctttttgatatacattattagttgtaagcaaagtatacagttgtgctttctgacttcaaaatcatgggcgtaaaataagaggttgccaccctctaagcttgtgaaaatgttaaaaaacgataatgcatggtaatgacttccacatttttagctttcaaatgaatttaaactgtggcacaggtattcttcattctttagtttccctatgtaagaatatcctgaatgttgtaggcctttgaaagggactcaattcttccagacacctcaataccacttatcagtctagtttgctaagttacagttgaccaggaagaggtcattgctggcttggggaacatgattgttactattattggtatcatcgtaagctcactgcccttaagactagatgaaaagcaatgaatggttctgtttggttccctgtaagagaacctatgatgaaaatgcacaacttatctctttagttacagagatgaatcccaatgtggtagtgatctccgtgctggccatccttagcacacttttaattggactgttgcttgttaccctcattattcttaggaaaaagcatctgcagatggctaggtaagttaagttttactaatattttatccggaatctttaaaatatctttatctgccatatatatattgtttttgcacacctaagttgtatagcggtatattggattttagttttcagtgtctgtttctattgtgtgtgttttctaaatagacttcgaaacattatattggaaaatattaccattgaaatgagaaagcaaaggattgcttgtttacacaaagtcagacctcttgctatcaatcttggcatttgaagtagcccatatatggagatccattacatttgggtactttcatacacatttggaataaaagaaatatctatgacagttcagtatagttaatgaaaaaagttaataaaaatggagatgacaagaaagaacggggtggggggcgggaaatcctctccataattttaagctgttctattggaaaatatttgtacagtttatgattaggtccattagcagtctctattagttttattcctattactcagagttgcagccagcttagtttttcttgcaattagaaaagcctttgatttatgatttcagctcttccctgttcctttgaccactgatgcattgctcatcagagcacattctcaagtagtttctgtggccccctgtattatcagaataatctatcaattcccttaaaaactgttgcttatttgaatactacttggtttgggaaattttgttaacatttatatttgcccaatattaacctgctgaattataaattaacattcttctcctgtctcagagttctatcactcacatatttataaataaattcatctatccaatagtgatctaatcagtgcctgacatggcatatccaaagaaaaatcagacatcaaagctgtccactaggagcttacttacctaactggatatatgaatagatagatatatttaaaggcataagctgacatgtagcataaaggggattaaaaacaggatgccatgaaactagagaataaagactaattctgaatgtgaaaataagcttcttgaaggttggcatttgaataatcttaaaaggataagaagagatgtgggattgcactgtaactacagtggagagctctgaaattacactccttgaggtcaaatcttttttttttttttttttttttgagacagagtctcactctgtcgcccaggctggagtgcaatggtgccatcttggttcactgcaagctctgcttctcaggttcaagcgattcttctgcctcagtctcctgaatagctgggattacaggcacgcaccactaggcctagttaatttttgtatttttagtagacacagggtttcaccatgttggccaggcttgtctcgaactcctgaccttaagtaatctgcccacctcagcctcccaaagtgctgggactataggcgtgagtcaccatgctcggcctccttgagatcgaatcttgacttccaacttgcgtgaatttgtgtaggtcactgaaacttcatgcgttcatattacaaatattgctacatatatgacagtatatgaaacagacaaaaatatgtgccttcatggagctcatattctagtgggagaaatagacaataaacaataaagatataagtaaaaggactgccccttaagttagcaggtgataaggaaaggaaacaaggtcaggtaagggagataagcagtaccagtgtggtgttaggggtcctaggaggtgggtaggcttcactgaaataatggcattggagcagagacttgaagcacatgagggaggtagcctgtgttatctgtgggaagagtgtgcccagtggcaagaacagctggtgtaaaggccctggggtaggagcacgactgggatgttcaaagtgtagcagaggggccgttgtgactaaagcggaggaagacaagagtagaaggagatgtcaagttatgcagggcttcgtatgcctttggaaggactttggcttttactcagtaaaatgagcaggcattgcaggctctggagcagaagattaacagcatctgacttagatttaacactttcattttgacttttatgtagaaaacaggctgtattgaggcaaggacagagacaggcatatcaactgtggtagccaggaatccaggcaagagatgctaatagttcagtccagagcagcaacactgaaggcagagagaagccatcagattctggacatattttgaaaataggagcaacaggatttgctaataagttgatatggaatggaaatgaaaaaaggagttgaggctataatcccagcactttgggaggctgagccaggtggatcacctgaagtcgggagttcgagaccagcctgacaaacatgaagaaaccctgtctctactgaaaatacaaaattagctgggcgtggtggcacatgcctgtaatcccagctactcaggaggctgagacaggaggcagaggttgcgatgagccgagattgcgccattgcactccagcctgggcaacaagagtgaaactccatctcaaaaaacaaataaacaaaaaaagagagttgaggctaactcctgggtttttggcccaagcacttgaaaggatggagctgccatcaactgagagaggattccaggtcagagttgggggaacatcaagacttcagttttggaaattgtattagtcagagttctctagagggtcaaaactaatagtacatagtagtatatatatatcctattagatattatatatagatatagtgtgtgtgtgtatatatatatatatctcctattatatattatacatagatataggtatatgggagtttattaagtattaacttccacgatcacaaggccccacagtaggctgtctgcaagcttgaggagaaaggagagccagtctgaatctcaaaactgaagaacttggagtccaatgttgaagggcaggaagcgtccagcacaggagaaagatgtaggctgggaggcgaggccagtctctccttttcacatttttctgcctgctttatattcactggcagctggttagattgtgcccacccaattaagggtgggtctgcctttcccagcccactgactcatatgttaatctcctttggcaacaccttcacagacacacccaggatcaatactttgtgtccttcaatccaatcaagttgaccctcagtattaaccatcacagaaatgttaagtttgagataacttgcaagtgcaggtgcagagtagccacctggacataaaagtctaatgtttgaaagagaatttttggttgaagatataaatttgagagttgttggttctgcacagtggctcatgcttgtaatcccggcactttgggaggcaggcagctcacttgaggtcaggagtttgagaccagcctggccaacatggtgaaaccccgtctctactaaaaatacaaaaaaattagccaggcgtggtggcgggtgcctgtaatcccagctactcaggagactgaggcagaagaatcgcttggacttggggggcggaggttgcagtgagctgagatcgtgccactgcactccagcctgggcgacgactgagtgaaactccgtctcaggaaaaaaaaaattgagagttgttaacatataaattgcgttagagctttagactggatgaaattcagggagtaaatgtaaaagaaggccctgcattaatcactggaacaatcaatattaaggttttcagggagaaaagaagataacagtaagcgactgacaaagaggcagccagtgaagtataaggacaactaagggagtgtggtggcctggaagctaggggaacaatgtgtatgcagaagagatgataattgcccctatattagtggatacttaggagcattaacgcagtaataacatagcgtaatactcaactcataggaagtgtgcagtaaatgttagctcataatagtaatggtggaggaggtggtaatagatgtaatgcaagtagtggtatttctgagcattttttgtggtacataccaaagatatttaggagaggtggttctgattctttcagctagttattaaagcatagattctcatcatttttcatgctatgatcctttttggcagtctggtgaactcttctaagaataatgcttccattttctgtgcctaaaataaaatacataggattatacaactatattgaaatatgataatcataatatttaaaaagcaaatgtgttgtacactttttaattagtatattcaatgtcaatatgtaatagtctaacaatttcatcatggtgatgcatatgaccaatatttcaagatatctgcagcaagtctattattaaaaaatatgtaatctctattgttagcaaatcatccatgtggatattctgatggtttggtacctactttaatgatagaaaggactgctaagtttagtcacaggttgtgaaaataaatatgtacccttttcccacatatgttcatagagtcctaaattctatctttggaactccagattaaaacccttgagttacaggtaaaataaatcccatatataggaaattgacataggaaaattcattaatgatgtgtaaattataatacactatgatattatattagtgtatttttcaaaagaagaaaattgttcttggaacaccttaataagaacaggtagataattcaagtaattagcacattgtgccagtaatgttaaaatctctgcttcagttctgagtattaaatccattaattccgtataaagaaaaaatgagatacatgagccccaatgagctgttattcatgcatgaaattagccaaaagatagagaaggcatgagaatatgtttactttttctctacttctggaaaaaaaaaaaaaacttcaacagtgtttttactagcagattaataggccacattccggacagtaggcacaccagaagcttgcctatttcaatacattccactcttttattctaatctccagtgatgaataatacgggcatcacaatataagagaaagattttggaggaagtaaacaatccacttgatccactatcattgtagggaggaaatcaaaatgccataaacaaaaccctacaaagaatttttgctaaagatggaaaatgctcagttcatctaggagagtttctatgttactattaaaggctttgtaaaaaaataaataaatattataccccaaatagttcaaatatttcttttagaatcatgaatgccctttggaaaggattgtgaagtgaattcttttggcctcaaataatttgatttgcaaacttgcaaaagattatttcttttcgttttagctttctgttttgcattgtatgccaaaagggaacatatggaacttctattagcttcttttattttgttttttttttttttctttttctttttgagacagagtcttgctctgtcacccaggctggagtgcggtggcgcgatctctgctcaccacaacctctgtctcccaggttcaagcaattatcttgcctcagcctcccgagtagctgggattacaggcaagtgccaccacgcctagctaatttttgtagttttagtagagacagggtttcgccatgttggcgaaactcctgacctcaggtgatccgcccacctcggcctcccaaagtactgggattacaggcgtgagccaccgcacctggcctagcttcttcttttttttaatttaatgctgtgatgataagctggtaaagactctctttacttttaggtcaacgtaagaatgctttgtcaagcagtaaccttgattttgtggttcctttaaaacagggagtgtggagctggtacatttgtcaattttgcatccttagagagggatggaaagcttccatacaactggtgagtattgttttggaacaagcttctacatagtttaactatgctgtgtgtgctccaaagtcgattttactatcctttggggatagttttgtctgattatccttttgtaatttcggtgatggtagactttcaatggctagatcttcacagaatataatggtttatataagctcagtgcagttctgaagtagggaaagcatcatggtctgctctgtatttacaatactaaacaagggactgaaacagtggtgcacacgcaggagcccatacctgtgctgaaaaagggcttaaatgcaggagcgccgctgaacaagtggtggctaaaggcacgagaagagattccaatgaagcagcttgcgacagatcggcttctccattttattttatattttattttattttattttttattgttttgtattttttgaggagacagaatctccctctttcgtcacccgggctggagtgcaggatgatctcaactcactgcaatctctgcctcctgggctcaagtaatctttccacctcagcctcccgagtagctgggactacaggcgcgcaccaccaaatctggctaatttttagatatttgtagagatgaggtctcactatattgcccaggctggtctcgaactcctgggctgaagtgatcctcccacctcggcctcccaaagtgctgggattacaggcctgagcccccatgccaacccagcatctccattttaaactcacatttcagtgcctgaggcaataagagccaccacttctgttaaaaagttgtacagcccagtattcagttctcatgcttacagataaataaatatcaaagccagtgaagtttcataagaaaacatggcttcatttttctttatgcttgagtattaaggacccggaaggaggaagtgttcgaattttaaagagcattgtcaagagattaaattggttgacattatacctgacaatgatagatgaagattaacaatcctatccagttcaatcaatgcccaacaaaagtactaattaagtaaacatttaacatgaagctaacatgtactacttacatggtctagtttgtttcttttgcaagaaactatgcaaagtatatgtaaatgaatatatgtcatattaatcattgttcagttatttctttctgtttactaactccctaaaatggttaatcttaaagaaatacacatgggagactggaaattttacagaatcaatgagggagggagaactttatttaggatataaattttacttccctcagtgtagctgatactcactctagttgaaaatctagttgaaaccagatttcttttaataaggcaatatgttgtgccatttaaaaattttaacatgagtagaattttgctattaaaaaacaacccaactgtgaagaaaaagaaatccatcaacccttgatggtgaaaagttaggaaacgttactaggtttgttcaaatatattagcactctttccaaaattaagaggttgactcactgatacttgtttcatgcctggttcacccttgggaggcccaatgggagatcagtgatgagtggcccatctaggaaccaatccaattatatgtatttaatacttgtgactcatgagagatagatattaactaacttcacagccagtcacaattcatggaatttatgggagaccagtcatgggagagctgaagcaaaaaagaattcacttcaggatctttctataaaatcaagcacattttgcagctcttcacaaagacagttttgccgactctagcattttctagctgactgagaatagatatctcagtgaagatttgtaataactgaagtgacaaggtgacagtatttttccccctaattctcagaataactatagatgcagtcacaggatattttaaaatctatattaatgggtgttctatttgacaagtggtttgaatatctgaaaccaggcatttaaatcaacagtctgaattagaattgaagtgaagctaaactattttgctcctacttagctgaatatcagtgaggtcacagactaagtagttgatgagctacttatcttgaatgaatgatatccttgtatcatccatacctctgttttaagggttatatttataaattttatagtaatttaaaaacaatacagaaagtcacacctagtagtgcagctttattaagaatgtctcttaaaagcttagtcttcaccggaatcagtatatgtaaactgaccatttttattttctcacacaagctgctgtttagctgtcaaatgatgttacagaggtttcttaaaataggcttaagcataggaagaataatatccaagaataagcttcaagataactaatgaggcatataagtgcttcatttaactgaatgcaaaatgtaatcacctggtagcagactaattaacacaaagtaagttgaaagaaatatatctgattacaataaggtcatgtgtgaataaaaactgattttgtcaatattgtagcatttaagcccgcacatttatatttcacagaatggattaatatttaattgtaattaaggtgcttgtcatattaattaatcccaataggtaatttactgatatctattcacagtttatattactaactcttgcaactttttcatctttccatctgttgtctattaatgcacacaggcgtaggagtatatttgctttcttaaccctgctaccctcatgtctttggactgattatcttttggcattttatattaatccttggtaagtgatttttttttactgtttaacacaaactctttaaaagttagctttcaagaagtaaacaaaaaggaaagtttctttttaactattttgtatgttcagtaacatctaaagttattaatcatgtattgaagtgaattaaagcagttaccggtacaaagatattaactataaggttttccgttaaatttttttccgtgatgttgttggcaagcgttttttcccatttagtactagttatttgtttcttcattgagtcaatccattggcctctcatctttgcaaataatgctttccattttccattatcatcttcatccattagagagctccaaatttccaagaaggtagaaatgcattaagatggagaaatcagagtctatacaatcctctgtatctgaggcctccttgtttttataataatgctaactcagtgactattaaacagctgactatacgcaagcctctttgtatgattatctgatttaattttcccccgcaatcctgcagagagtattactagtcccattttagaaatgtggaaataggggcttacggagatttactgtcttagtagcacattccactatgtacagaatccaggttccaaactcaggtctctctgaaatctattctttcctctgtaaagagcagactcctttaatttcttattttcttaacttctggatcattttaataatcaaatcttgaagtgttccttttgactttttaatatgtaatgataacagtaaccttgaattctgagactaaagaattaagaactctttcttttcctgtgctataagataaaaggtagcagtttccaggggaactgacaagaaaatcattgtccttaaatattaatacctagtgtttaggtactaaattatgtacagacagatccataaatgtggacaacttgaaaaggtctcagaagaaaacaataaaaatatctcatagactggaaaaaaaatagcttatggggtggtggtgcgggtatgaaaagcaatctggagcatttatttattcaaaaagacaattgaccaaatgttctccagctcctccaaggacagaataaatacagctggcagaatttaggatttcaagttgcactggaaggaacataaaaaaggatttcctcaaaatagagattgttaattccagaattcatatcttcttttaaaaaaagagactagaggaaagcttttgaaacaaagtagacatgatgtgtaggtaataaagtcagaggaatgtgctagatgctgaggacccattcactgttattctaagttcattgttacagtttttagtatagggcttcagcacagtcaactccgtattttcagtatttgacatcaaatagttttcaggtatgaatagcacacataaattccatttcaaccttcaaaatatacatttacttttaactgaacatctactaatcatcctcaaatagtgtgcctaccattaaaatactaacagcaaatacccataaagtatcccagattgcaaataaaatgaaagaaagatgcatatatcatttccttgcttaattctctgagactttctcattttccacagtgcgtttttaagcttctgtaaggtaggcctgtgcaagtaagcatgtattccttaataggcctcattgatgaacatatgctcaaatttcagcaaccctcacaaggtctgctatttctaataccaatcaaatagcacgaggcccaacttatggggagaaaatacccttcagtaatttttagaagaatcaccttgaaactgtaaatggttgtctccagttgagaagagaaggtaaaacatagagctgcatgctttctgtaacttcagtaaatttcacacatatcaactagtaaaaacatactggatataaactatgttctcagcccttttgtacaatgccagatacaaaagaagtgaaattcatgctccccgctcgtggaaatacagcttctactcacacaaccactccaattccctgtttgcttcatctaataacttgtggttattttcccctgctttcattggctaaagagtcatttttaatcctcctaatgatgtgtttgtcttcatatttcacctaccctgtgaacaacagctgcaaataacaagagccatctccccagacgcacactgcctaacacactgtccaacttcctttctaaactgtcggtttcttggaaatatatgttcctgttgattttctaaaacccatctgatgccactagtggtttgtgtggaaatcaaaaaactctttctctctctcatagtgttgctcgaatctcttcctggggtggtagcagaatcagtgtggagcaccagtacccagttaggttggtctcaggattgtgttctgcaaggatttctgactttcagaacttaagagtatgtttcctattgaaagaaatcatctaagttgaactagctatatctagattcagtgttaaatctttttttttttttttactgccataatgaccctcatgctgtactcaggtatttatctgcttgttctcaatcctaggcagttggcattttaagcaagaagtggcatttagttgaaaatgctcagctttactcctgatgattgcacattctatttgaagaatgatataatatactaaagtcctttttaaggtttggggatggtttctgcttagctcatcaaagagtaagcagcacttacaaaattggagacttttagagttttgttttgtcttgttttaactattataaatctcatgtccttgctattgctttttcggaatgaattgcagtatggatggctttccaagactgtcataaccatggctaatttatgcagaatgtatcttaactttttgaagtcattaggattttgaaccttacctaatataagtgaaagagaaaaaactaaaagtgcacaatcctctatgcatatatgctgtaggtatgtctgatgggggttatttattgatttggaaaatcttttgcaatgaaaaggcgaaccctacatgtcacacaaaatcgtcactgtaacatgtgcacatattggctctttccagaatgtgcttaagttaaaattgctagcaaagccttaatttgcgtgaattttcccctggttttagtctcggaattagcacagcaattgaaaatgtaggaacattttatcagtgttgctgtggagtttcataattcaatcctgtcatgttccacagccttaggatacagaaactccttggaatcagcaagatctaaatagaacaatgaaaattgtatacaaatcatgattacttatgccaataagtatatgataatatgtcatacaaaacatgtagtggaattatacgttatattgaaagttcattcaataatgaatgagattgaaagaaaaaaaatgtgtctctcctccatgaatcaagtttctacgcagctgccgagtagtagcagcttaatatttcagcactgaatttattcagtgttaccctcttacatacatttgttacttcctagtttcttttaaagcctgtttggataggaaagtatttttttgttcactcctgatcacaaaatgtgttggcagcctcctgactttaccagagctgttagtcatctccgctgacattctgctttccgaaagcactgaagtaattggctcttactacaggaagtaaatgtggaactcctaaaactaactaaattaccatcacggggctgaataaaaaacatgatcaataaatattcctttaggttcccaaatgcctataagatacagctatgtccaacatgatagtgttttttgaggggatcagggagaggcaaagtaaaaactggactgatttttccctctaaatctcaagtgtggaagacaaagaggatgagggagaaaaaatagaacaagaaccattgaatggattgttttcacttagaagtgggaagaaattaaaactacctgaaaaccacaaacaccacttgccttcgtggacgtgttcctacatttcttgacctgcattattttctcttcatccacaagtcccatcttttcaatcagaacatcacaagcccaagtctagtattcaattgttaaaggaatcattaggtgaaattcagagggtaacatggcagagattattttgtttcagttcaactgaataagcatttattgaccacccactaggtgtttcattaactatgctcagccctggggggaagctatagtgagtgtagcaaggtgtgtacctgcaactaacaatcacacaatgtgagaaactctccgtttgcaaagtgctgtgaaagcacaaagtactgcttcgtcctgctaaaagctttcaggaagtggagatatccaaacattcataattttaaatataaataaatatttggacacattaaagtactaagattacaactggttatttactatagactgtttattttctgaaaagttgggtgcttctatcaaaattatgtaaagacctctgaaaattacttgcaaaaaagtttgctgtaacatcacttgtacagtcaatcatgtttctgtatttactatttatagacaacaataagaatacaatcacaaagtgcttcaatagatactgttagccttagctaacttaggtaagttatcttacttggttgggtgaaaatcattaccttaattatctcctaaacaaatgtaactaactaaagcatgcattagcatttcctgtgtttgagcttatagactagtaatgatgaagagcaagcaggtaataggtccagttcttcagatagcttaaaaattagttcaagatggaataaaaacaacgccatagtagaattatacaaggtacatgtccacactgacagcacacattcacatccccagagaaaaatgtcagaaaatgttattttagtctttaattaagaaaacaacattccaccgtctctttattagttctccatttattcccccattcttccttcctgcctgtagaaattggagtgttcaggtggtagatagatacttctatatatttacaaactgctttagcaacttaatcaacagcagttagaaatttcatttctagaactcagtttttggcaaatgggaagtataaagtgcagatatgttcatgcaatctagtagagttttaaaaaatgaatctgaaattattattatcttctcatgtaaggaaaagtaaacaaacctgatatgtgtttaatgaaaattaaataaaactgaggtacctgatgtaattatttaaagctgttcaagtttaattattatgttaatcaattcttctgcccagataaatttgtcttttcttttttaattatcaggagtaaaaatggtttaaagaagaggaaactgacaaagtaagtttttcttactatgtcatttaaaaggatgtttgttataataatcttaacgttccaattaaagattgcttgtcttcaaagagaagggacgcttaagaaagaggcaaatgcatattacaatagctaagcacaataatgtactggttgtttatgcctgagtggcagtggccactagaaaagtgtatcacagaaatcacatcagaaataaggacaatgtttatcatatcaaatctgagagagtggatcgttagcaatttttaaagtcttggaggaggaagtatggtattctaaatacagtatatgaaaatctaatatttaactacatcaaagggtttcaaaaatccttttagtattttgaaattctgtgtttattgcaggaaaaggcttttactctatttgatgttataatagatactttgataatgctttctcaagaaacctgtataataaatagaaaagataattaatctagcctgtggttttccttatctattaaaccattaaatgagaagaattactattgtggtaagtgaaaattaacccccagttgatttcaaaagcctattagattatcacctccatgccttttcttagttataattctacatatgaaaagtggaactttcctttatatagagtttgttcttgatacctgcctggatagaacattggtgaattagtacaagaaggaaattagggggtccagccaggtctgtggcatctatgcttatggaaagaaatcatgagtaatccatgacataatccaaaagaaaagttgatgtaaaaatgtttctagttagtcttgagtggcatataattttatggcatatatgaaaacagaataattttttctaagtcaatttcattttttatttttattttttaatttattttattttattttttggagatgaagtctcgctctgtcacccaggctggagtgcagtggcacaatcttggctcactgcaacctctgtctcccaggttcaagtgattctcctgcctcagcctccccagtagctaatactacaggcacacgccaccatgcctggctgatttttgtatttttagtagagacgaaatttcactatattggtcagactggtctcgaactcctgacctcatgtgatccaccctcctcagcctcccaaagtgctgggattacaggcatgaggcaccgtgtccagcctctaagtcaatttcaaaccagcatacattccactggcttataccaactgatgtaggagagataagaccagactgaatagaggagagggtaccatcacctgggagggatgatttcacagaaacagaaagactttgttaccaaaaactgttggttgggttggcaggtgagctaaagaggcagagactagagcatttagaagatagcgtccttggacgaaaaggagagactgtcaaggcttgctcctcccatgactcaggcaaagaaaagaaggagaagcaagacccagacaaaagatagggtagagattaggagtggtagaacatacccacaagcaaaaaaaaactcacatcaattcggcttccaccttcccccctctcattttcctttgactcctctctccttctctagaagacatttcttgaaaggctttcctctcacctttttatttgccttctctaccatttctctttccctccaaatgccccaccactaccatatccccctggttcccattttctatctccacttgtcttcattccatccttcctttccatcacctcctctttttctttttcctctgtagatatttgtccttttggtctctactcccttccagctttctttttcttctccttgtcattctccttctcccttatgtccattcttctgtttgctattccttcctctctctctcttttccctctgcttcttgcttttacttcttttaacccattaatactttgtctggtttgccttctgtatacatgtgcccattttcctagtaacaagatgaaagctagagttgttaaatccaactttaaggtcgatacactgcccaaagacaccagccagagagtgcagttctaagggggttcattccaggagaggagtcccaactttagcccattcttttggaaggataacaagtttgaagtgggaaaagctttgaaccaggacttactctccctggattccagtgagaattctactgcttagtagacatgtgatgttgggctactcacttaactctcttagccgtggctctctcagctggagcatggagctaatgttgtctattcctacctcagggatcaattaagcaagataatgcatgtgactatttatgaagtgtagcgtgttttataaatgagttattgttattaagtaaaaacatttcagtttaaaggtattctctggaagatataacgccctctaaaatttactaaaatgttaacataaatgaattaatcagattagctaatcaacaactttaaatgagcattattaaatactatgtattttctaattggacataagaccacagttaggccaggtgcagtggctcacacctgtaatcccagcactttgggaggctgaggcaggtggatcacttgaggtcaggatttcaagaccaccttggacaacatggtgaaaccaaatctctactaaaaatacaaaaattagccaggtgtggtggcacctgcctgtagtcccagctacttgggaggctgaggcaggagaatcgcttgaacctaggaggcagaagttgcagtgagccgaaatagtgccactacactccagtctgggtgacagagtgagactctgtctcaaaacaaaacaaaacaaaacaaaacaaaacaaaaaagaccacagttagatgatataagctgagtaacacaccacaagaccaagggaagggtcaactataaagaccctgccaaagtggaaaggcttgagttagatgacagaatgtggaattctgcagaagcagagagctactttagagagcaaattggtttaggtaggctctagaggagataagcagctacagaaaactacaggagataaaacttgattcttattctcaaaaaaaagtgagaacttctgctgcggatgcagaaacatagctcagatgtgttacttgattgaacctctgagccatttccatacttttatagatatgcaagcctctaaagataactcactccagtgagaccctgggagctttctggacaaaagtttcatcccactgatcctgcctctgctttggggagactgtagctagcagcacaattccttatacttgtaaagctgttgaaacttacaaagttctttatgtactgtatgtcaaccctgtagctgtaactactgtattttatggatgagaacattgactctgaagagttaggcgattctctaggataacacagtcaataaagcaaaaccataactcaaacaggtctttggaatccattcctttgttattttccatatgccagagttttttagaagcaacacagatgggggtgtgtgtatacgagtatgcatatatatactactgtactgctacagtaagagccaagtggaaatctagagatttctcctatcaaggaagctggatatatatgcccttcttttcaattgcaatatattaaggattggtaacttgaaccaaaaaaaaaaggtgagtgctaaccttagagaagtaaaacttctattttctccaagaagattaagaagtatgatattaaacaatatataatacctatcaacaagaattttaaaatgtatgtatatttctttgtgtttggcaaagcccggttcaactggatgactttgatgcctatattaaggatatggccaaagactctgactataaattttctcttcagtttgaggtgagttggttaaggcattttctaccttctgtaatggaaagggcctgggaattggggggtttgtgttgcggtcatgtccctgctcactggcagtgcgtaacaaaaagggtattggcctggggattgctgatctgctggtttagagcaagggttgtcaatccttgcttagtaggcaaggcctcaggtggcacaaatgagatgaggggaagaagagaataggtgcaggtactgaggtgagcaaacatgggtatagtagaagccatcattgaaaaccagggaaatcgagagtacaagaagaaaaatgcaagctgaggcatgaagcctgagacagaatttccctttcaggggatttgtagtgtttctcatgcttcttaggccacagtagtggcggatagtggataaaactgaccccctttgtgtcctgggcacataacatcctggagtagggcttttcaagctataggactcctggcattctacttaataacttttgtgcagttttattttctttccttggacaaattggggagataaagttacacatgatttgtgttaagaaaaaaattgacaacatctctttttttccgaaggacacatatttctttggatctaaaaccatatgtcagaagagatggaagtgagtgagtctaatatctcagcagtgtgggggaagataattagttctcactttttctttctacatattttatagctcataacacagtctaaatggccccccatccttcaggtttctatagcatggcttgagtggtcagtgattcagggaaaaggggaagataaagtgatttttctaaattctgtagttttttttttttataaagccttttaagtgctcttttctattaaggtagctgctttttcttcagtttttaaaatcatttctcctttccacttctcagccaaggacagctttagtctgcaaaaagcatcagtggtcctggtgtggagacactaatggggaatttgaggatgagaagaatcttatacattaccaaatacaaagaccgctaactaccacctgtgtcctgaaaaattccacacagagcctgctcacttatccattgtatccaggtgcataggatattatagatgctacaccaaatgctatactcaaagaaattcaatttgaattggaaatgaatgaggaggatggcatttcagaaagtatatcaaggaaaggaggactttttttctaagcaaacatgaggcaaaactctgaaaaaataaatagctagatgattctaacgatgatagaaattatggtatagctacacttttaccttattaaagccacattttcttaattccttcaagatggcatgcccttggtggcacagctggatcataacctctgctggcaactcacagtttatgtcttgaaacccaagcataactattactgtttctgaattgcatgaaaaaaaattcaacaagtcattttccagtaaacatattcttttagttgtgagtgacaaaaacatagctcaaacttgtttaaactaaaggaaagggggtttattcaaaggatactaaggtatctcatacaatcaaagaaaaggttgagtagctagactacgtgcagggaagcagcacagtttcagggatgactggagccaggggcccctctatttctcatttctgcttctctctctgttttggtttcactttgtttcactgaacaaagagaaacaaagagaaacgcagccagagagggcagatgtttgtgttcagtgaaacaacaaacaacctctttttctgtcacttttgttttgttttgttttgttttttgagacagtctcactctgttgcccaggctagagagcagtggcgcgatcttggctcactgcaacctccgcctcccaggttcaagtgattctcctgcctcagcctcctgagtagctgggactacagttgcccaccaccatgcccggctaacttttgtatttttagtagagacagggtttcaccatattgactagtctggtctcgaactccttaccttgtgatctagctgcctcagcctcccaaagtgctgggattacagccgtgagccacgatgcccagcccaacctctttttcatagtgaaaagcagccaacaacaacccttgagcaccacagccttttgtttccatggtttccaaagggaattactgtctgtctttcttgtttgtagtttgaaaattaacaggggaggattttgatggacgagcctgtgtcatggtgcccattcaaaccaatcacagccagagagggcagatgcacagaatctctaaatggaaccatgtgggctcaagtagcaaaacctaagaagggcattatctcccaataaagagagggtattgggagaaccaaaccataagcgattagcatgctatctttagatatcacaaaaatatgaaaagcagaattataaattttatgtgctaaatgttcaatttataatatgctgagggcttttattcattcaatggataaatgaatacatttagcctgacttcataggatttataagaaatgtgctaaactaggaatctaaaatcctgaatcctcactacagtgttgctactaattaacattctaaaaaatatgtttttttcttaaccaattgatatataatgagtttggggtgggcttgggggcggatgatgtattagctacagattttttatgtagtgaacatgctcatgtataagtttcaatttatccaactactttgttggaataattcttatggattgaaactgcccaggcaaagtatatacaaaatctgcattttgagtaaatttcccataagtggagtaagttttcccagtgttcctaaaactatacaaacagtatagtatagtatatacttcctaaaactatacaaagagtagatatcaacatttgtaatcattgataatgtaatattacaaagaaattgctttctcatctgttaacgttaagctacatcatcttcatatagcactattagtcatttgtgttatttcattttcctctgtttcttttattttcatgtaccttataatcttcatcattttgttactgatttctaacagctgatttatgattaaagaggttaacattttgtgaagggctgaaaatgaaataccatttttttctcatttttttacattggggttttatttggagtttgtacagaagttgtgtatttaaaaaataatcatgttctgcttttttttaagtacattttctcatcaccttagtttctttatgtataaaatgggtgagttgaactagatcaatggttctcaactggacaagtaccagtcagcccccagatgaaatttgaaaatgtgtgggagtgtttttggttgttataatagcttaggaggaggatgctaacagtattttatggaagagggacgaggcgttaaatgctcttcaatgagtgggacattcccgcacaatagagaattgtcctaggccgaaagtgtttgattgagaaatatgggttaaatatgggatgaggctacaatcaagctttataacccatgtgtattagtcatgggttctccagagaaaccaatgggatgtttatatagaacaaatatgatgtatatatagagagatctattttaaggtattggcttttgaggttatggaggctgacaagtctgaaacctgaagggcaggctggcaggctggagatccaaggaaaagttgagtttgcagttttgagtttgaaggcaatggggaggcagaattcctccctccttgtaggacctgtctcttctcatcaggccttcaaactgactggatgaggcccagccacattacgtagcataatcagccttcctcaaactctacttacgtaaatgttaatcacatatgagaaaaacaccttcacagcagcagactggtgtttggccaagcaactggacactatagcctagtcaagttgacgtctaaaattaaccattacaccacgattttaaagtctttaatattgttatttattctgatgctctcttcatacatttctattcttagaacattattggtcatatatgtaattaattgggtggtaagtcctgacattatttacatattctggtaggaaaatacaacttactctctagggctctgttttaagtcacaggcttagactgtatgttttggactaacatttgctcaagcagtggcccgctggtccaatttacttccttcttcatttgacagacttcagatattaccagtcctcagtcccattctgccccctacatcctcagggtcagcgtcagggtttcctcatcaattttcatagaagtagtgtgctcccatgcctgatttcaggatgtatgctggacctttcacatggcagccctcacatttttttgaaatacattgatagttaattgagacttaaggaaaaaaatgttcctaactctaatgagaattcaagagggtatgagatggccaaatcaccttggtctagataattccagcagctgaacttgtacttgttctgtttatattaatgcctagtatttgtattcattttgatactgacattgaaatatcacattcacattgagaaatcacatcatttataagcattttgcagattgaaactaatgtctggatttatagatactaccaatacagccataagtcatacatgaagctatatgagttactaatttgtgtttactgaataaatttcttttttactctgaatctgattttaaatctgctagaaagattgattatccttctgataaaaatatacaccgttcctttaaaagtcttgggacccagggattaaaataggttcctcattttttacatttcacatgggaaagattttgaagaaccagactttatagctgaaatgtgagagcccagaagacatatcacatattgctcattctgctattaatgtctgtgcttagtgtttgatcaggatactagtaaaggccctcaccatctctgttcagacatgtggctgcaaagatcaaaacaaaactacagaactggccatgcagttcacaagaggtgacctttgatttctggtagtagcttttacttgctatagatggaacctcttctgtcaacaccactggcactttctttctcctcactttttccaccccttatggacacgtaatctagtaatcttagtattgtttgaataaaccccctttcctttagtctaaactagtttgagctatgtttttgtcactcacaactaaaataatgtgtttactggaaaatgacttgttggattttttgtaatcatgcgattcagaaacagtaatagttatgcttgggtttcaagacataatgtccaccctatcccaaagcaaacaccgaaagcaaactctcacctgctgacattgttacaaaccctaagaccagaatgcagattgtgctctcctcagaagatgatattgcaggttatgggctgaatatctgtggccccccaaaattcctatgtttaatccctaacccccaatgcaatggtatttggagatggagcccttgctaagtaattaggattagataagctcatgagggtgaggacttcgtggtaggattgttgcaggacttttccttagttcagctaaagatgaggtccttgtccatcccacagccatgaaaatttaggttcacaggcaatttggagggtgagtaaaacagggttttattcggtgaaaaggaagaaaagggagaaacagggactctcactaggctggagtccctgctagagcacttcccactggcagcttgaatctcaggttccacacaggaagaggagaggccaggttccttccccactgcaaacatggtgaacttcccgaggctccacctctgtgagcaggctagttggaatttctccaaggaccccctcccacctgactgtctcaggatcagccaagataagatgcctaagaatgaaatctaccttgttgccatcttgatcttggacttcccagcctccagaactgtgagacataaatctctactgtttaaactatcactctatggtgttttgttatggcagcccaagccaactaatgtaatgtatatgcttgtgctttgctttccaagacctgtatgcttcaaacacagccaacaaaacgtagcctgctactgggtttgggtgaccgtattagttcctatggctgccataacaaattaccacaattgtcgtggtttaaaacaacagaaacttattctcacaattgcagagccagaattccaaaatcaaggtgtcagcagggccacactccccctgaagactctagggaagaatttttctttgcctctttcagcttctgttggccacagcaattccttggcttgcagctgcataactctgatctgtctccatctttacatgccttttcctcttctccaggatgatctcatctcatgttctctaacttaattacaactgcaaagacactttctccaaattagatcacactcacaggttctgggggttaggaggtagacgtatctttttggggatcaccattcaacccactacagatgactgtatagcctagaagaaaagggtgataaattatatttagaaacaaaactgacaaaagaaaattcagaaatgatttatgtgggtttcaggtccatcactccatagtttgtcttcataaagatttaagccagtggaatttccatatggttggaaagaaaataacttcaaagctgctgaactggaaacttaatattttattttccacttagtgacaggctaaattacaaaggcttcaaagcatactgtgtttacatgcagttcccactttgctgcaattcaactttggcaacttccacttacagtgttcagccaattaaacctctcttatcaacttagagtatttacagcaggaaggcaacacacaattaaagttctgtcagttagtcagcttccacaattaaagttctgtcagttagtcagcttccacatgtgctcaaacgctcagcctcaatctgtttccaccattccttttgtatctgaggccttttcccatggcttatcagtctgtccccaaagcaagagaattgggggaagagttgttggtctgctggcataaatggcagaggaggaagaaattatggagccaggcaaagcaaaacaaagaatcatcacaaaagtattttacaatgatcatcaatagtgctgtattagtatttgttgagttaaattattccatttgataatcactataaaaaaggaaggtgtggagaaattactagccttatcttacaggtaattaaagcaaagtttaaaagagtttaactacccttccaagaacatacagtttataagtggcatgtcagaatatgtgagatattttgaaaaaatatctatgcaggcattttctaaaggaggtagatttctgaaataatttaagcaatggaagcatcatttaaataaacttataactaccaaaaggaactaacctaaacatcacactgatttagttgaaatttactaaaaataagttgcttcttacaagaaaaatagagtcaacctttgaataccctttaaaatggaacactcagttataaaataacaatgggaagcatctgcctaaatatatttggcaagtaagtgcctgagatggaaaaaaccaattttgtgagttgaaaatcaaatgtaacatagtttgtatataaaactgacatcaacttagtccaaagaacttcagatattgtcatcttgaaaagccaaaagagatgaggaatcaaaggaagagagaaatctgggcaatttttgttggttcatccatgttggctacagtcaggcaacccaatgccattaagcgcaaggtaatttgccaccaaggatcttctagttaaaagcatcagaagacccaataacttgattaataaagcatgtgctttgcaaagagcacttgaataaagacacaaagggcatgaaacagatatccctattcaatcctagaacgtggtcaagtggctccaattctcttcaacagtgttaaaagaccctccgaaattcttctcctagggaagtattcctccagctttgattccttgaagtaataattgggaggaattatgaagagtaaaacttgtgctcaatattaacattctataaatgtaaataaaatttataacaagtgatttttgcctcgcttagtagtcttatagaaagatgcacactatgtgggtaatcccacttatacacagttatgtacactgtttactaacattcctctaacatttgtataggaatataactagatccactgcattggttgcacattgtacaactccagtgaacaccgttcatatagaccacaatgtgaatgatgcctccaagaaatacaggtggcctgaccgtaatccccgtttcctgtaagacacatggcatagcaacttagaaatccccctttccccataacataccctttttgaagtgtgacagttatttatataaaaatttcccatcagttcaccttctgaaatgaggtttataagagtaccaatatacgcaggcagacatttggatgttcttattctcactgaaggattttccccaacaactacagatccatctttatgtttgaggtttcattaccagatatttagtgactgttaatcccatactttgtaacatggagattgttccctactcattcctcactattttttactactttctctaaggctcattgcctacaagaaaaaaaaagcctagatttcttcagagaataggaaatatttatacaaattgcataaacttaagttactctattcctccaaaaatctgaaatgcatttttattttcaaatatttcataccctgagtgttatacatatagttcttacttctccaaatgaccactaagttatccaaggtatttatgtgttgtattagatagctattaccacaataatgctgtataagaaacaacctcaaaatctctacaataacatttacttttctcactcatgggtctgtggaacagctggggcagttctgcttcaggctgtgggtcagagtcaggtctgccctatgtgcctcctcattctcggactagcagcttccctgggcatgtctttttcagggtagatggcaggcacacaagagggcaaaccaaacaagcaagtgcattgaaagcttctgagtggacttgatttctatctaagatcattggccaaagcaagttgatgatagtggggtggagtaccttccacctctaaagggagctactgcaatgtcatatagcaaagggcttgtgagcaataaaccagttgaacaataatccaattcacaccacgtatggaactctcaaatccattctctgtcctttacaggagttgaaattgattggactggatatcccacactttgctgcagatcttccactgaatcgatgtaaaaaccgttacacaaacatcctaccatgtaagatcgtcaattgtgccaataacactcatgtcttaagggttgaaggactgtcattgcagattaatcaatttcaccaatctctggccatacccacttgtggtccggatctcaaggccacgtctgagattgcattgatctcactctcctttgatgtctttagatcttagcatatggaggaagatttaattattgtgcttttaaatgaattgcatctgaacaaaaagactgatcatttggccctttagagattaaagagccacagtcaaattggggattggatcatttgtactctcataaaatattttcagccaattcattggtaatggaaagaggcaaatgggaaggcgatgcagtatattaaaatgccttctctaacttctgacaagttatatagttgcttagcattttgtaataaaaagcagcattcaaggaaaaaaaggtaatataaagcacttacaaaacaattaaaatacattccagtttagatttcacttttctctctgctacacgctgtggagctaggcatgaatggaaaagtgagaagagaaaggctgaaaaagctctagaaagagaagtctcttcttgatatggtttcttgatgaaattagatatattatcataataacacttcacatctgtacacagttcagaaattacttctttaatttaatgtccacctacaaaagaaacccatgcatcttctgttctctaggtctccttaaagtagtgaactctctggatatctctaggtgaaatgaaaatcgtgtgcttaggctatatactatagctgtccaatcaatctcacagatattgtagttcctgaaatactctgaacaacacctaaacaatcctggaaacaattctttcaaggacaggagagctggtagtgaaaaaaaaatagtggttggaagatattcacttatttatttaaacaacaaaccaaagttgaagaatagctaaaatatcaggctaaaaattattatctgcctactctgtcactgactgatttaacttaatattggatagaaagggccaaaataatttttccttccatcttgaattttaatatttttttctccttattctctacagatgacttcagccgtgtgagattagtctccatgaatgaagaggaaggtgcagactacatcaatgccaactatattcctgtaagtagaaaaaaaaaatcaggcatcccaaagctaaccagccagagaaagactagcagggctatatggatgtgtcaaacagttcaaaagagagcctttcccaacccagcaattgaattctaaaaagtttgcattactccgtttcataataaagaatagaaagaaaaagtccatagattactaatgtttctatttctttataaaggtccagtgaaagggaaagtagaaaggttaaagatcacctctcttatgtttaaatttcacattcagcaaccaaattcaaagggttccaccctagcacctgcacttttaaaatataaagacagttattattgtcataaaaaggtgtggatgtgatttttacagccttctggataacaatgcttacaatcacacagactaattatggtcagttattctgatagcctctttgattaaaacaggagaaaacattacataggtgtgtgatcctttgccaattttatcaccagtaagttttcagtttttttcccataggcgtgaagcagcatttggtgttgacagtgtctggttaggtgataattttgtcacttatctttcagggatacaactcaccccaggagtatattgccacccaggggccactgcctgaaaccagaaatgacttctggaagatggtcctgcaacaaaagtctcagattattgtcatgctcactcagtgtaatgagaaaaggagggtacgtacttactgaaactgctcccacttagcagcaaaacctgccctagccactgccgttgatgaaatgcttgctgttttcaaagtcaaataaaacatagagacaaatcgctaaatttaaaacattgtattcgggaagcaagaattagaatttgggggtaaacacacagacccggtggtctttgcaatgtctaaaggaaaaaagagaaggttggaagtcttctaaaaaggagaaatattgcatattgttttgcaggaaagttcattagcactagtaaagttttggggagctggcaagctctgattggtgaatgcatggtggtgggtaaaactagtctcagagtcccaacaggctgtttcagttgctgttagataccactggtttcaagttactaaaggcagtttcagcaaccggggcttacagagaattacattcctggaacaatgttatgcgttctgagtgctttcttttttttttttttttttttgagacggagtctcgttctgttgcccaggctggggtgcagtggcacgatctcagctcactgcaaacctctgcctcccaggttcaagcgattctcctgcctcagcctcccgagtagctggggcattctgagtgctttgtcccctgacccctcaactctgttttagttagatatgataagaatgacccaagtcatgtgataagaattcacactacgtagcagaaatggtttgctttatgtttcatcttcaccacggtcctatctaattctttagaggcgaatacctttgttttccctaagtgagcacacttaattcctttcctagcctgtttgttttaaaaaattgttttgtccttgctccaggtgaaatgtgaccattactggccattcacggaagaacctatagcctatggagacatcactgtggagatgatttcagaggaagagcaggacgactgggcctgtagacacttccggatcaactatgtaagtcaccaggcagagagcaggtgctgtccctatgctgacacctgctgagaccagtttggtcggggagaccctaacccagcggcgctagaggaattacagacacacacacaaaaatatcgagtgtggagtgggaaatcaggggtctcacagctttaagagctgagagcctcgaacagagatttacccacatatttattgacagcaagccagtgataagcattgtttctatagattatagattaactaaaagtattccttatgggaaataaagggatgggtctggctagttatctgcagcatgaacgtgtccttaaggcataggttgctcatgctattgtttgtggtttaagaatgccttaagcggttttccgccctgggagggccaggtgttccttgccctcattgcggtaaaccgacaaccttcagcatgggcatcaaggccatcacgagcatgtcacagggctgcagagattttgtttatggccagttttggggccagtttatggccagatttgggggcctgttcccaacagacacctacaccaccaccaccagggaagtgctgggagaccaacccaatgagcactttgagctttgcattgctgcttccttcaagaggaaaaatccattctcagtgtcattgtttcccatttcatcagtgatggtgtggatgatatggttggtctggagaggctgagaagacgcagtaaaaagtctgcactagttcatctcgaattagctcaagatcatagaagacactattaatcattgtttatgaggcatcattgaggacagaagtgttctcattacttatattaatcatatatgagtataattggggtatataaggcacacttatgttttaaattaaataattaaaccctgatttagtagtttgggttttgttttgttttttttcttgttttgttctggtttggttttcattatttgtaaggtacttctaggtcttattatcataattccctatctctcttgaagggctattgatttctgatggataacacatccaaaaaaaatgtctgtttttctcacaaggcctgacacctttctgctgacaagtctctgagcaaacgctgaatatttctgtgacaggcttaggtgttaacatcaattgaagtcatgccattgacctcagcctatagaatatacagtttttactattaatagtcttctccacttgaacatgctgtctatgaagacaaaattgaataggaaagttctcactgagatgttcttccctgcttagaaacaatcctttctaatagttaaggaaatagcaaactgtagcctgtggaccaaatttacccactgccttttggataaagcccatgagctaagaatggtttttacattttttaatggttgaaaaaagacaactgagtatggtggttcatgcctgtaatcccagcactttgagaggctgaggcgagcagatcacttaagcccaggatttcaagattgcctgagcaacacagggagatcccatctgactaaaaattcaaaaattagctggtgtagtggtacacacctgtagtcccagctactcaagaggctgaggtgggggaatcacttgagccccgtaggtggaggttgcagtgagccaagattgtgccactacacttcagcctgggcaacaagagcaagactctatctccacacacacacacacacacaaaaaaaatcaacaagaaaaatagtattttatgtgaaatgctatatgtaaattatgtgaaattcaaatttcaatgtccatatataacattttattagaacacagcctgcattgttgacgaattgtctatgactgcttttgtgctacatcaagcttgagtagctgcaaccaaaactatatgatctgcaaaaactaaaatatttactaactgtctctttgcagaaaatgtttgctgacccttaaaataggcaatggaaacaaagattgcccgtatcaatacaacgttagaacttgatactacctactgattgatctctacaggagataaatcacttcttagccattgttaattgccacttgttaactggcagttaacaatgtcttttatgaccaggagaattcaggcaaatccccgtatgactctaacaggctgtgtttcgtgttgtttcggtcatttaaaattcacattgcttccttgttaagcacgtttttactcaaatgcagagtttcagcttaagtgtcaccccctttgtggcgtcttctctgggcttggacaccgttagcccattccttctctggggcagagtcttaagtaagctgctttatcacagcacaccatagatagttacaattctcgcttcttgtgtctgcctccccagtatactgtgagtttcagaagcaagtgctgtatccctgtggaatgaataaatcagtgaatgaatgagttatttcaaaaataataaggcacttgtaaagcatcaatagactttccgtcagagaaaatatttgtcaatccaaatgccatttgaactctgttttttgttcttagatatttcaattgaaaagccagtgcaaactgataaccaaatacagtacaaatctgtccctaggtttgcacgtagtagaaaaaatttcagagcacaaaatagggtctgttccattgcctattctgttgacaaagaagagtcacatagattattgcttggtcagtactatgcttcttgtccttggtcttaagtgatgacctatctttcaatgacaatcatgtgaaggacttgaaaaataggaataaaacattgaacagtagtgtttgtttgtaaggaatttacttgttacaagcgtctggtaccagagtgcccccttttggccataagcataatgaatctaaatgttaagctacaatgaaggctaagttgcccaaagaacattgtgctatgctaattaatatatttttcaatttgtttcattttttgtttatacccttctttatccattccatattgatatgtggaaactttccaattataaaaagataaaattacataaataaggaactcaaggtaagagaaatttaggaatagctaagtaagataaaaccagaagagttttctcctttaacaagaaaggagagaaatgaccataacacacaacttgtcactttctactacttgaaatttggcatcaactgagtgagagctggagactaaagatcatcaaaaacgtgtttgttgccagggactttgtgccctgctattcagctcacagggctgaccccagttccaggacccctgccgtgtagctgcggagaaactaactacaatttaatgatttcctgattttaaatcaccttgcactttttaactgaatacattttcacttcaaccgtactggaatatatatattggctacaatgtacacatgttatacaaattatgatcagcatttaaacagggcaagcattttcctgaactttcctggcaaccaaagttatctggtggctgagtattcttaaatcctcatgatgttgaataagtaaattattctgcacaattctttatgcccaagatagtttctcaacatacttcctgaagagagcagtgagggtagccagcgtctttgtagacttcatgttctgtgtgtctaagccagagcccttgaacatagtaggggaggcactgcatgctgctggggatatattaggtgccaagggtacaatgggtgtaggggaggtgataacttatgtatatttaaacaaatcttacatatttatttatacattttatttatgaattgtctttatacgtttattttctgtccaagaccactgactctttgaaattcatttctctttcaatacctgaacttaaattttagctcaaaactgacagcgaggccaagcttccctccttcccagttatgatatagtattccagcctctgagtgaattctaggctcttcacaagtttgagaactgagggatgaatcagacctttatgaagcctgggtttgggatatttctgatggctgataacaagtggagaatatgtaactcttacaagttagttgggactaaaaagagttgatctggaaagatatacattctagttaatatgtactcagttcagagagaacaacaatatatttgatgtatgggttaataggaataggaaaatatacaagttatactcacttactggggactcccagaatcaaccatacaattgcacggagctggatgacggtgagtgatggtaatgaggtactagtaagtagtaatatcacacacatgattacacttaattcacacaacaactcttgttataagtatcattaggccatttttagatatgagaaaactgaagctcagtgagtcaagtcctctagtatcaaagcccaagacaaggattctcatataagtgattttgtgaaagtgcattcttagggaaagcccataagggagcaagggaagcagattgacagagaagaagccctacagagcattcagctgaaaatctcacctgtgctggatcccacagagagtgctgggggcatgaacagcaccatggtactgtctcactctgaaaaaggctggatttttgtaccccacaattagtcagtcattagctgtgggcttccctcagcaggagaacgcaacctcttaggcattttctatcgaggcagctctgtgcagtggaaggcaactatcaagagataggtactgctgtgctgttagcagcaactgggaaaagtgtgtcccaggctggcaaagtgtatctaaagggcaccaacagcactttctacagtgtttaattcattagccaaaactgatgcagcttctaaatgacagagccaggatgcaaaccctaatctgcttaagtgttgtccacaggtacagattagcctacttatcctactatttgaagctttatacaattagcgtggttttttttttcaatacctattttatgccagatatggtgctcaaagctggaaaggaaagtgtactgaccaggagtggaacgtggctctacctttttgcatgcttaactagcagagtcctgggtcatcctaacagtgaactgaaaaattaatgcttgtttttggcttttttctctaaaggctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcaggtaacctcatcaactgcattttctattaaatattaggagttggttttgtaaggggaacagctcaccattccataagcccttatcaggtttagttgaaaattaaataaactctgatgttttttaaactatgattaattgatgtctcactatatacaatgtttattctggctttcctgtatctataccctataaaatagatgttattattccaatttttaaatgaaaaaaatagagaagggtagagatgttaagggattcacacaagttcatgcaactagaacatggaggagttagtattcaaatccaggcatgccaatctgcaaagatcatgcccttaatatgtgatattatcctactccatcaaggattctgggtagttacaacatggacaaatacaaggtcaaattatagaaagctgatcacagcttgacataatataaataggcataaaaactagaaaaggaaaagaaaaatgaaaatattcagcttaggaagataaacatatttgctatgattcctcttcgggattgtctcttaaattgtcagacagtagaatgaaaaaggatataggatataaaaaaatcaaggtccacactaattcccaacaggaaaagttatcattaaatttaatttgttcttcctactgtatgaacagagctccatcaaaatctatctctgtgatacaatattgctgtaaaatccttatgcaacctcaaaagaacaggggacataaacgtgctccaatggcaagtgagaggtggcagtgggatgaagatgtgaagggaagcattggcagccatgccaacctaagcaaataaatctacaatcccagacctactgccttggcccttgtgaattagaatgactagaatgaggaagtatatgtgtgcattcatgtgtgtttgtgtggagtgtgtgtctccctggaaaggaaaatgcttcataagctactaagtttctgtttagggcagatattgttgctgtcaatccactgtaggcattcacaggttaaaagatgtgctttagcaggtaagattatctgttctcaaaatggttcttttcaagaacagaaaatgaagctcttcaactctggggtcaaactcacagattcctttcatggaagatagtaagtgcagttctggatatgactttacaggtgctcacccaatggcagatcattttatctgagaaatcctgggagggaagagttgtctagtagaaaaagcaacccttaaactcaaggtttatagagtgggatttttctagcaaactttccatataaatttgcttgaactttctcttttcccatcatttcacagtgattcaaagctaagagccatttgactctttattgaggattagagggaaaaaagggctgacttcaacacatagaactagggactgtgatgggcagttggtcagcgcatgtcagtccacttccatctgtgccccgagcattgggattgggggactggctgagactgggtccaaatttttcatttgattttaaggcaactatctcaaaggtccctgtgagatggaagcaggcccaggacccactaaaatggcaggcatgctgtaaggcaggtctggggtggtgaactgaacttagggttgaagatacacaaatctctgtggtcccagacctagagttagggtatggacatctcaactggagttttgagctgatctgagggcttaactctgatgctgttcaaaagacagggtattgtttatgtgtatcagctctctgaattcagaaatcagttcccgagagtactcaacatggaatccctacttttctgcagaagcagagaccccgataaagggtgtggccaatgcagtgcaaatgtctctcaggaacgtagccatgatagtcagaaatgtgacattagaaggaacaccaaccacaactccatacttaaaaatcagttaagtggaaaatattgtcaggagcttagtctgcgtttttccacaagggtactatttgtagttttttagaaatcatcagttttatttcaacagtaaagtagcaccatctgggctggccgaggtggctcacgcctctaatcccagcacttcaggaggccgaggtgggaagatcacctgaggtcagaagttcaagaccagcctggccaacatggcaaaactccatctctactaaaaatacaaaaattagccaggaatggtggcacatacctgtaatcccagctactcaggagggtgaggcaggagaatcacttgaagccgagaggcagaggttgcagtgagccgagatcatgccattgcactccagcctgggcaacagagcaagactccatctcaaagaaaaaaaaaaaaagaggggggagaaaaaaaagaagcaccatctgaataatatgccatcggaacattcttttgcagtgctggcgtgggacggacaggaacattcattgccctggacaggctcttgcagcacattcgggatcatgagtttgttgacatcttagggctggtgtcagaaatgaggtcataccggatgtctatggtacagacagaggtaggaacataatctatatgtatttttaaattttccctggactgaaaaacttaccattattcaatgatatgcttcaaaacaattctctcaaacttctttgtatctttctttcccattttcttattgtatatgttcaaactgctttgaggcataaaagaaatagacactagcctccagaaatccattcgacatatagtgattatacttttattggcatcataattcagagtgcatgggtagattcgtaagagtaaaacctctttgaacagactcagagtcaattgcagataacagccatcctgggtaaatgccaccaaatagagactgttgaactggtgaaatttgatttatatttgaaatgttggatttgattcaatacatttgtcattagtttatcctccgtgtgactctatcccaattcacttttgatgatgattagaagttggatttgagctttctgtcccttttatgattttaaagattcccagtccccaacctaccagcattgccagttcccttcatctcaatgatgaagatttattattttaacaacatggaagcatcccctgaaatatccaacagtgttacgtgctccgtcttcctcctcttctcccgagtcctccctccctgaaagcctgaggatgcacttagtctggagcgacaacccaaggcaacgccggcagacagcaccgcctgcctcagagcagccgtgggtgtgtacccttgtgggcgcaaaaacccaagtacaacagcttgttcataagcctcatcacccagccatactcgcgacttcttagcttcggtcttacaataatcctttttctcaaagagtatgtgtgggtggagcgcttgggtagaacacaacctggcccgacctgtaatcagggtatttttaaaatgctttggtcttcctcatgcttttcctacccagcaccactagatgtcagtatcacttcaaaagcctagagtaatggcggccgtctcagctgtttctgctttcccactccttttacttttctttcctcctacctccccattcttgtctgaccaatttttggcaaggctgtttcaatacattcatttctgaactacagcaggatcataccacttgggaaagagttatcctcgttaatattcagacctctcattgataattaggaagcaagtccaattggtttcctcacttggtttcaatcatgctgcctagtaatttagtgtggtggggacatcagtatcactttttaatcataagtttaaaatgtctggtttcccagaggagtccactgtctggtgagtaaacagtgctttattaatcggtccatatttttggcttttacttccataaatttgcaccttgatatgtgattaaaaatccacgttatgtatatgaatcaccaagcttcaaagagccacaccttattttaagtattttgcatttaatgaattgtctcctcaatttacttaattcataccttttacaacttcatagattttggggcctggcgtagtggctcacagctgtaatcccagcactttaggaggctgaggcgtgcggatcacctgaggtcagaagttggagaccagcctggccaacatggtgaaaccccgtttctactaaaaatattaaaaaattagcctggcctggtgatgggcacctgtaatcccagctactcgggaggctgaggcaagagagttgcttgaacccaggagacggaggttgcaatgagctgacatggtgccactgcactccagcctgggcgacagagtgagactccatctcaaaaaaaacaaaaaaaacttagtagattttaattatggcctgtttgcttttgacttttctccaactacagattcttaatctctttcacatgacacatcctccatcccatttttagggtcattatctttctttgggtggttatcaagcagccaccatgtcgctttctgcaaagccaagaaaacgttttgttttctccctaaatgttttaccctaaattttggttgttttatttgtttatgccagcattttatgttgatatctccgcggacacagcctttttaaagtacagtatccccatcctggccaacatagtgaaaccccttctctactaaaaatacaaaaattagctgggcgtggtggcacacgcctgtagtcccagctactcgggaggctgaggcaggagaatcgctggaacctgggaggcagagcttgcagtgagccaagatcgtgccactgcaccccagtctggtgacagagcaagactccgtctcaaaaaaaaaaccccataaaataattaattaaaattaattatgaaataattaaataaaaaataaagtgcagtatcccttccctgaactctcatggggagttcaaagtcagcaaagggggcagaggttccccgggttacttactttttccaacttttctagcttgacccttgattcccgcaggacttcctggtggatgttttccagttccagttatttatctgtgtctttttttttaacttatgtctagaacatcttcttcatttacctttattttttccttgttcctctgcttaccatggttcatcccgtattttgaatacagattgatctgcctaagattctccttaagcccattcacattcaaattctgctgccaggtcacaaaagttaacaaggaaagaacaaagtaaaaaaaggttattcttttcacatgtatcatcctagagtactcctttgacgctaatgattttcaagagaatgaaatggttctccacttgagctctgtttttatgtatataatcaacccacatagaccatatttcctcccatcactggtatctaattttccagccttctctacattgccttgaccccaccattccacctcacccaaaaaattgcagaagtagctgataggatgagccatgtctccaggtgcaacatgctgcctggactgcactgtgacctgccctcttcctcttcctcacctgaccagacacacttcatagacttcttcacgcaagtagaggcgtatttagaaagaatgccagaccctgaggggagcctgaatctccactttactgctgcacaagtcatgtcacctctcaaggctcccatttctcttctgtaaaatatgaatgataactttcactaatttttgtaaagcagacatgatgggaaataatataacctagataagtgatttgaaactgtgaagtgctacttatgaatgatgttctcctctcttctatttttatcgaatattttgtttggttttcctctaatatccttccctggaggtcagttggggctttgctttgagcagcccatcctcttgatctgcagtttgaatttcgggactttcaaggacaagtccctccataaatagtctttatttacttttcttgtggtcttgttgtttggttgttttttgttttgatacaaaatgtagccactaagcagatgcagattgaatgtccaggcaatctctggtcttatctattccctgtgttgacataacaccagaagcaatggattaggtgtccatgtgtgatgaccacaaggggtagctcagccactgataggataccatcaccacaaaagggaatatattttctccaaaccgtgttgaaaaatacaggttaggctgaggcatcaatccagtgatgttcgaaatattaattttgttttttgtatgaagttgttacacaggaagcttcttaaaatcctatgaatattttgaccggatctcatttaaatgttatttctagtgctattacttatagagaaactctgggaaacaaagaaaaaggaggaacactgtgaaattacccttacttcttggcagaaagatatattttggtgatttcattttggctttcattcaagtataacttttacatgattgtgctcatattatatgtatgtatatatgtgtgttactttacattctatttacattgtagtttctcatttaggattttactatgtagcctgtatagtatcaaaaattacctacaactctataaatctcattttaaggacagactaatgtttcattaaagatacactattgcatacttaaaccaatctcctttttatagaacattaaattggattattttccactttttactattatctgtgtccacaccatttattagcactttattaattctacctccacaaacaataggtaaaatggactgcctcaacaaacttgtcatcattaaatattattcttttccttctagctttgtccactacatagatagaaaataattatttcaatgtactttgtattacttgactattgttggcatattttaatatttcctcagtttacttcaaaaatcatttaataaacacagctaagtgctaagcattaggaataaaaagacatagtttctaacttccagggaatatttggcctagtggttgatgtcctttacttatttgtctatttgtatatgttactgatttgaatgactttatcacaaaaataaaggcatcaatattctgtcataattctagaaaatatttttcttttccagtttgtggtttaccctgtgttttattctttttaactttttaaaatatacagtagattgagatttttatttgtaatgtattctactgctcttaattttagaaattcctttcctaaaggaatcagagagaaattaaccaatattttcctctgtatttttaaagacaatttattaaattacctggaatttgctttggtgtatgataatgggatatcctttttttttcaaaatagccccatgatttgattgaatattcatttcctttagcattaataatgatttaatgtacagcatggtgaacatagttcataataccgtattgtatacttgaaatttgctaggaaagtagatcttaagtgttctcaccacacacacacacacacaaatatatatacatacatatatatgtatatatacacacacatatatataaacatatatataatctggggtgatgaatgtgttaactagcttgattgtggtaatcatttcataacatatatgtatatcaagtcatcacattgtacaccttaaatatatacaatttttattatactgcaataaagttaggggaaaaaaattccactgtttttttaaaaaagccatgatgttctaagctctgttattaatcaaaatacttgtacagttgattctcttggattttctagttataaaactgtgtctctgtaaataatgaaaatggtttcctttaacaccagatcttgatcattaaaattgtcatagtataaaatattatatctttgcacatgtctgctctgaaacctgtttttgtcttttgttccaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgctcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgtaagtaaacttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagagaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtggctattgtgagcctccgtgtgtgtgcttccaggaggctttgctcctcttcatgcacccgacactgccccttccctggcttccctccatccctgatcatcttcatgaagccacagatataagatcagcttaatattttatcagtgaccttagtgttggtgaaggatgccaaatgaacagctctgcaccccaccgtctcttgtcactgaaaaggcttggccatggcagaccttggcagagtttcttgcaagatctggccagtgagtctcagtttcaccttgcagggtgaatggcagaggatgcccataccctgcaggttaacagcttgggctcctcaggggttgtcagttcctactcacctccctgctaccacctcctcctcttcttctcacccccgactcctttatttccctttttggacattttaataatgtgtcgcaccattctcaggaacaaacatggttaatgaaaggtggcaaagggatgtgtgacattcttagattttcacacatgggcagtcaggagtgaaatgtgcaaccttggaagagctgatacaatgtatggtaagctgaagtacgtttccaacactgctgctcagagcatacagaagttttgcatcctggaacattgcttcccatgaaacaaagcacttcataaatattttatgtttttcttgagcaccctttcaaggtagggatcaaatagtgccagatcaattttcccaaaaggaaagaggaagtatccagagtttagactgaaggcttagagtcaaaactacaggaaggtcacactgttctctggaacactgttgctcttcagtttgtagagtttatgatggaaaaggcatcagtctgtcaaaagacttgtttaatcctgataatgactttggaattatctctcctgggtctcagttaataaactgaagaatgacctaa

SEQ ID NO: 2142 - DNA, 276076 bp, Homo sapiens; identical to SEQ ID NO: 2141

SEQ ID NO: 2143 - DNA, 65638 bp, Homo sapiens
gtaggatacaatttttgctttatttataatttttttttttcaattaggaaactgagacttaagaattttctctaaaaaaaataaaaactggaaaacaagtaattttagaaacaaatatatatttttgatagaaactgtaagtaaatattcagtactaccagaaatatactatcttcaactctcggcttttttccaaaagatacagaatcattttttggaaaagatacaagatgtacagacaaatcacattcataccttacaatttaaattcataatgaacaatgaatattttcatattttccagaagtttgaaatttcaaagttgttagcaaaattattcatttccataatttttacgagtaaaaatagaaagagctgatcatgtaccttaatattgtcactttatatattactcaaaagtacaaataaccctaaaagtagaatcccaggcttatcatattataaaaatactgagacatttatcaaacataactaatataaatgaaactacatttttaaaaatgtttcacaaacaccagtccatctttctctttggttcagaaaataaaagaggtaggttcaaataaagaaaatgcctattacatcattagattttcattaaaatgctggaaatttataacagaaattattagaagtgaaatgagtttaagaactaaattaaaaactgataataacttcaactagtaaatatttttctaagttctaatcacacaaataagaaaagatagttgactataaaaatggctttagtaaaataaaaaaatgctctcattattataaattaagtctcctatatcctaacatgttcctaaaacttggggcaagagagaatatgaatgtatatgtttacaaattgggcctttcatttaaatataggtatctaatgtataagagtaatacatactactattaatatgtatctctcacctttgtgctgcccatattgaaaacagcaagttcaaagatattcaacagtgagggagaaataagcacatcatttgctcatgatcaatccacttcatgcaattaaaaaagaaatttcaggttactaagaatggtcccaagaagtcttcctgactaaaacggaatctgattcaaaaggtaggaaacaaaggacaaaggaaaacaaagatgctctgcagaagctgatacaagtcaaaggatttcgtttcctgctgcttttcaaagcaatggcaggataaacggaatctttcaaataaattgccttgtgttggtaatttaacagtaatatactgaaaattagtgtataactccaggaaccaaataatggtacagtggtaaaatggaaaagtgcccactgaaataaatataatttcatcacttcccttcagaaattccaccactgtgttcattcgtattcagctgaaagaaaaataaggacataaaccctatacttatttggatgcttttgctgtaaggtatattttaaatgtaatgattttctattaatggttctataaggaaatttaaagaaatctataaagacattcaaaatatataaaacaagaaatttaaatataaaggaactggcataaacgtaaaccacccgaaataaagattaatgatttataactctaacacacaaaacaaattttgttcaagccagtacattttcagatttcggattcagggcagagatttgcaggattattaagaaaagataaagtataattgtgtggccttttcaaaacacattaaaactatgattttgaacatttctgtgtacatataatttagcccaaaagtttgaagtgaccattgttaccatcttcccttttgtgaaaaaaatgcagcttcttttgccatagacttgtttcaattcgaggagaaaaagtcactccagagattgttgaaagtttcaattatcaggctaaagcaaaaaatgcaacatcatttctgggttactcctaaagtttgcttcatattttcataaaccacataactgatgcctacagcagggagcaccttcatgaagtttggggtgatgcctctgtaaagtcctggtattccttctttggaaataattcgtcgaaagaggccaaccatattcagctgtggggaaccttctaacatggctaaaaaataaaaaaagagggtaatttaatattcaagtatgtttcattattatgacaacaaacaattatgacccagaatgatattctaaaatacagtaaaaggacaacatttattccaagaagcccaagacaacatcccttttatgatcctctttgtatagcacctaacagtgagtgtcctaactatagtaatgatggtaataatagttatttattaattactatgttctaaatactgggttaattaccttccataccaatcttgcaaggtaaatgttatatcaattttgtaagtgagcaattggaggcttagaaagatggagaaatttgtcctaaaaaaatctaagtagaaaatggtagggctgagatccaatggtctgactctaaagctggtacactttccaccaccccacagtgctgctgctgcctccttcttactagacaagcgctgaagagagaacagttaaatctcaggaagtaaggggagtatggaagaagctctgggaagcttgggaaaaagcacaaagacctgggccttggaaatgacctcaacaagcaggaagagaaagcgaaaaccagtgttgctggcacaaccaagacaacgggaggagtaccatgtgctatggagatgcagccaattgttgtatgtggttattacacagagagtgaacaaagtggggctagattattaaaggctttgaaattcccactaacaactttggaactgacaccgaaaggctgcaaagatgtctgaacagatgtaaaatgatcagacttttaggtcagaaatgacagtctatcagccatagacaatctatcagccgtatcagtcatgcaaagttctggatcagagctggcagacaggagggttagaatcagactgcatgtgtctgaatttcagtcccactatttaccacaggtataatcttgtgggagttacttaaattctctctgccccagttgctcatctgaaaaatggggataatgttagtattcccatccccaagatggttatgatggtgaaatgagagaatacacaagaaacgtgtagttcactactttgtgtttttctctacagccatgactgtctctcagctccttaaatacaccatgttggtgcctgcctcagtgtcttcacacatgctttccctcaactggaatgttttctgttcccactccactggcctgtgcccagctaactcccactcatctttccagtctcagcttcactgacagcattctgcagcgcccaagttaggttatagctccttgctctgtgctcccctaacaaaagaggagttggtttaaccaggttgtttacttgctggacataacgtcttctctactctacactggcggggccacacctgacttgttgactgctctacccctagcatctggcagtgtctagaatgggacaatggctcagggagtatttgccaattagttactgactgcttggctggggttgctgtggctggcacttggaagggaggttgggaatagagctgtagatgcccaaggtgtactacttaagaaaacaatggataagactgaccagggaaagcatcaaagagaaaagaaaggcatttgaatgcatactttaatagagtggggatagcaataaaagccagcaaatggtaaaagttatcaatgggctggcagaacaaccaggatggtacagtgtaatcaaagccaacaatggagactgtcacagtgaggaggaatcacagctcaaaacttgtagggtctacgcaacactaaaaaatgattccaaccaccatttaccaaaaatttaacaaacccaagatgctttatttatattgttggtaattcttacaacactgtacaattttcattcccattaaaaaccccaagaagtctgaggcaaggatctgaacccaaatccatcagatactaaagcttataatcttaaaacgtgcatgtaacacagtcaaaaaaaatagtactctgtttatctataaggcatatgtatgcatacagtacatatgcaatgcttctgtcgcattaaaatttcatgacgagggagcatttagaaaaagaatttctgaaaagattccttaaggaggcaataatgaaaaaaaggttgagaaatactgtcttaaaactacagtctgcatcttagtagaacttggagttctaaaagcacattactggtgcagcacttttatcggtgtggttctgtaatcaaaaattcaccttgagcctgcatgcgagttctcaccaaagccaatgggtagctggccagctgaccacaggtgctggataaggcaccgcatcccagcaacaccatgactccagggtttacagaatcttttgcaaaattatccagccaataggacttcaagagctgccagagaaataaagaagaaaataattaacgaactctacaacttcaacgtaaacattttcacagctattctcaacctcatgagaagccccgtttctgcaggatgaggccacgcatttgcagaagcagcaggcactgcaggaggcggtgactctgtggagaggtgggaggccactgggggtgcggaacacatgaggtttgcaccggttactgacattcttctaaacaaacgtgaactgcgcagcaaacgctgcaggatctaaagaacacctcttatggtgagtattaataaaataatataattctactaattgtatctcattttacacgttacatatatttcatttgagccttacagaaactcttacataaatctattattctgattttagaaatgagaaaaattcatctcagcggagtttttgtttgtttttttgagatggagtctcgctcttgtcacccaggctgtagtgcagtggcccaatctctgcctcccaggttcaaacgattcttctgcctcagcctcctgagtagcttggattacaggcacccaccaccacgcccagctaatctttgtactgttagtagagacagggtttcaccatgctggcaaggctgatctcaaactcctgacctcaggtgatccgcccgcctcggcctcccaaagtgctgagattataggcatgagccaccacaccaggcccagagtttttttaagaaggactcagaaccaggcgtgctgatcaaaaggccatactttatccctgttactctaggtccctgtatttcattagaaggcaataattaggagaaactgtataaaatatatatgataatcaactttttaaacataagatactttaagtataaaatacatgttaatatgttatataacaagtttaactttttaattttttaatcctgtaagactaaaaattttaaatcctacaggattaaaaaattatctcaatggattaaaaaatccattgagtgcatttctcaatggaaatcttgcaggttagaaggaaatggaatgttatattctatgttttgaaacttaaaaaaactgccaaacaaaaatactgtatgggcaaaactgcccttcaaaaaaggagaaattaagactgtccctgacaaacaaaagctgatacagcttatcaccactagaccggccctacaagaaaggctaaaaggagaaacaaaaggatgataaatagcaacacaaaaccacaaaatatgaaactctatggtaaaggtcaatatttagaatattataaaatcctatagtattgtaatgaaggtatataaataacttgaaaatctaaatttcaaaaacaaaatttaaacagaatttaaagaagaaaagcataaaaagtaactataaatctatgttaaggatatacaatatcaaaagacataaagtttgtggggaggaggtgaaatatgtaaagaaatagagttttatataccactgaagttaagttgtaaacagcttaaaataagttgctataactttagtatgctttatgtagttgcaatggtaaccacaaaaatagcatctatagaatgcacacaaagggaaatgagaagggaatcagaacatatcactacaaaaaaaaaaaaaaatcaacaaaacacagaagaagccaggaagagaggaagggaaaaacagaaaagccacaggacaaagataaaaaggtagctagccaaatgacaacagtaagtccttccctatcagtaactgctttaaatgtaaatggattaaatcccctaattaaaagatataaattgctgagtgaataacacatacagaatcaactataccttatctatgagactcactttagatctaaggacacacataagctgaaagtgaaaggatggaaaaagatattccataaaaacgggaacccaaagagaaaaggggtggccataattacatcagacaaaatagactttaagacacaaactgtcacaagagacaaagatggacattacataatgataaatgggtcactttaccaggaagaaattataacttcatatggacctaatattaagctcctaaatatatgaagcaaacacttacagaactgaagggaggaataaacagcaacacagcaatagtagtagaccaccaccccacttaatggtgttggggaggacatggagaaattggaatcttggtgtacattgatagaaatgttaaaaaacaaaaaggtctagttactatggaaaatgacatggaggttcctcaaaaacttaaaaatagaattaccatttgacccagaaattccacttctgagtatatgtcaaaaagaactgaaaacagtatcttgaagagatatttgcacaaccatgttcactgcagcactattcacaatagtcaagatgtagaaacaatccaaatgtccatcaacagatgaataaagaaaatgtgatatatatacccaacaaattattattcagccttaaaaacaaaaaagtcctgttgtatgctatcatatggatgaatcatgaggaaactatgttacatgaaataagccagtcacggaaagagaaataccacatgatttcacttatacaaggtatttaatgtagtcaaactcataaaacgagaaagtaggttacacagcgctggggtgaaggggaaattgggagctgttgtttaatgactatagagtttaagttttgagaagtgaaaaagttctagagatctgttgcacaacaaaccacaaacagttaacacttactgtactatatatttaaaaatggttaaaatcataaactttatgttatgtgtttttaatcacaattttttaaaaaactcagcacaagaagtaaagtcctgaaccataccacctcacacctaagaggacggccataataaaaataagcttttttaaaatggaaattaagtgttaataaggacgtggaaaaactggaacctttgtatgttgctggtgagaatgtaagtgcagccactatggaaaacagtctgatagttcctaaaagctaaacacagaatgaccatatggctcagcaattccattctgagatatatacccaaaggaattgaaggcatagactcgaacagatacgcagatgccaatgttcactgcagcattattcacaatgttggaaaagtagaaataatccaaatgctcttcaacagatgaaggactaaacaaaatgtggtatatacacataacggaatattactcagccatgaaaagaaatgaagttctgatacatgctacaacatgaacaaaccttagagacattatgctaagagtaataaatcagacacaaaaagaaaaatactgtatgattctacttataagatatcttgaatgggtaaattcctagacatagaaagcagattagaggttaccaaaggtttgagttacggagggtaggaagttattgcttaaaggttaaggtgtttctgtttggagtgaggaaaaggatttggaaatagtgttgatggttgcacaatattgtgaatgtaattaatgccactgaattgtacacttaaaattagtaaaatggcaaattttatattttataataatttttaaaaattatgtaagaagccaaaaaccatttgcttgtacacttcaaatgagtgaaatgtaaggaatatgaactaaatctcaataaagctctttaaaaaaaaaattcgactcttcttttcattacacattccactcttcctctacgctgtagcttaggtctcatcctaacatgcaccctggctcatgtctgtcgcagcacagataaccacgctgagttttagtcgtttgtctcccccaccagaccttcagtttcttcaaggcacacattgagtcctttgaatccccagatccagtgtctaacctagtggtttgtatagtgtgtgctcaataattgtttgtgagattcataaattattaaatgatttagattgcagggttgatccaagatttgtattcttccgtacaaggaatgaaactgtattactcatgttagtcacattagtcacttggcttaatgtcagatttttgcaaatccaaaacaaaggaaaaaatctctagaaacaccttttaaggtgaacaactatacctaactttgagtctactcttcattaacaaaagcaattcccaagaaaatctaatacaaaagtgaccccatgcatattcacactcaagttacttgaaagttcaaataacacatgcttgaatttacttctggtcacacactgttttctggtatatatctacttcttcatataaagtccaattctaacaagatctaactgcattttccaattcaaaagatttctacaaactcacctcatacacagcaagatctatgcctgcataaggtatgatacctaataaattgggaacatagcctttgtaaaaagctcccaagccttcatgtttcaaaatcttcttggcacaatcatatattccagagtactgcccagttttgcctacagccagcctggttttcataacctggatataaaaaaaaacaaaatatgattgttcatattaactctatcatcatgggattcaaatgaagtaattttacatggaacaaatacctagcacatattgtcactcaaaagactgtacaatttgttgatacattctctttcatgtattacctctattggggggctaagaccaaagccagagagacccgtttactgcaaggaggatctgatgaaggaagtgaccaaggaaatggaagcaagataatctattgatgtcttaacaaaactgactggtgaccacctgcatctggaaggtgagggaaatggtagtataaaggataaccccaatacttctagcttggaacacaggatggggcagtggggagttgggaaggtgatactattaactgatatggaggatatgagaggaaaaataggtattaagtttttttgagaggtgtgtggagtaatataaacaatcatattaagatgcttaaaaaaagctgtattagcatgcataccacatatcggtgaaaattgtatttatcttgcttaagtcatcagttactaaaaacccctctgctatatcaataaattccacatctacaatattatttttgctataaagcagtagttggaaaacttttcctgtaaagactaaatagtaaaatatctgtcgttgcaagcctaaaatattaggtctcggttgtatattacttttcttttcttttgtttttgcctactttttaaaaattgtactttaagttctgggatacatgtgcagaacgtgcaggtttgttacataggtatacacgtgccatggtggtttgctgcacccatcaacctgtcacctacattaggtatttcttctaatgctattcctcccctagcccctcatccccaaaaaggccccagtgtgtgatgttcccctccctgtgtccatgtattctcattgttcaactccaacttatgagtgagaacatgtggtgtttggttttctgttcctgtgttaggttgctgagaatgatggcttccagcttcatccatgtccctacaaaggacatgaactcatccttgtttatggctgcatagtattccatggtgtatatgtgccatattttgtttatctagtctatcactgatgggcatttgggttggttccaagtctttgctattgtgaacagtgctgcaataaatatacgtgtgcatgtgtctttatagtagaaaaatctataatcctttgagtatataaccagtaatgggattgctgggtcaaacggtatttctggttctagatccttgaggaattgccacactgtcttccacaatgcttgaactaatttacactcccaccaacagtgtaaaagcattcctatttctccacatatttgccagcatctgttgtttcctgactttttaactaactggcgtgagatggtatgccattgtggttttgatttgcatttctctaacaaccagggatgatgagccttttctcacgtttgttggctgcataaatgtcttcttatgagaagtgtctgttcatatccgtcacccactttttggtgggtttttttttcttgtaaatttgcttaagttccttatagattctggatattagccctttgtcagatggatagattgcaaaatttttctcccattctgtaggttgccggttcactctgatgatagtttcttttgctgtgcagaagatctttagtttaattagatcccatttgtcaattttggcttttgttgccattgcttttgtgattcagtcatgaagtctttgtccatgcctgtgtcctgaatggtattgcctcggtttttttctagggattttatagtttaagtctatgtttaagactttaatctatcttgagttaattttttttttataaggtgtaaggaaggggtccagtttcagttttctgcatatggctagccagttttcccaacaccatacattaaataaggaatcctttccccattgcttgtttttgtcaaagatcagatggttgtagacgtgtggtgttatttctgaggcctctgttctgttccattggtctatatatctgtttggtaccagtaccatgctgttttggttactgtagccttgtagtatgtttgaagtcaggtagcgtgatgcctccagcttcgttcattttgcttaggattgtcttggctatacaggctcttttttagtttcatatgaaatttaaggtagttttttctatttctgtgaagaaattcaatgttagcttgatggggatatcattgaatctataaattactttgggcagtatggccactgattcttcctatgatatgatattgattcttcctatccatgagcatgaaatgtttttccatttgtttgtgtcctctcttatttccttgaggagtggtttgtagttctccttgaacaggtccttcacatcccttgtaagttgtattccgaggtattttattctctttgtagcaattgtggatgggagttcactcgtgatttggctctctgtttgtgtattattggttaataggaatgctagtgatttttgcacattgattttgtaccctgagactttgctttaagttgcttatcagcttaaggagatttggggctgagacaaggaggttttctaaatatacaatcatgtcaactgcaaacagagacaatttgacttcctcttttcctatctgaatacgctttatttctttctcctgcctgattgccttggccagaacttccaatactacgttgaataggagtgctgacagaggacatccttgtcttgtgccggttttcaaagggaatgcttccagcttttgcccattcagtatgatattggctgtgggtttgtcataaacagctcttattattttgttatacattccatcaataactagtttagtgagagtttttaacatgaagtggtgttgaattttatcgaaggccttttctgcatctattgagataatcatgcggtttttgtcactggttctgtttattgatgaattccgttatattgatttgcatatgttgaacagccttgcatcccagggatgaagccaacttgatcatggtggataaacttttggatgtcctgctgcattcagtttgccagtattttattgaggattttcacattgatgttcatcagggatattggcctgaaattttctattttggttgtgtctctgccaggttttagtatcagaatgatgctgccctcataaaatgagttagggaggaatctctctttttctattgtttgaataatttcagaaggaatggcatcagctcctctttgtacctctggtagaattcggctatgaatctgtctggtcctgggttttttttggttggtaggctattaattactgcctcaatttcagaacatgttattggtctatacagggattcagcttcttcctgatttagtcttgggagcgtgtatgtgtccaggaatttatccatttcttctagattttctagtttatttgcatagaggtgtttatagtattccctgatggtagtttgcatttctgtgggattggtggtgatatcccctttatcattttttattgtgtctatttgattctcctctgttttcttctttattattctggctagttgtctattttgttaaacttttcataaaaacagctcctggattcaatgatttttggaagggtttttcgtgtctctatctccttcagttctgctctgaccttagctacttcttgtcttccgctatcttttgaatttgtttgctcttgcttctctagttcttttaattgtgatcttagggtgtcgattttagatctttctcactttttcctgtgttgcccactttttaaaaatgtaaaaggcattcttaggtcaagggctgtatgaaacagtccgtaggtctgtgttttgccaacctatgcactaatgaaaggatgtctaattaggataatcaccatataatcaaatcctgagattccattattaaatttatggtacagaaactctttggacaggaatggcagccagcctctaaagtggcagccagcctctaaagtgacccccagtgatatttgtctccggttattaacaccattataccagcccctcctacactctaccagggttggtctgtgtgatcaatggaatacagcagaagaggcaaaagataccagctttcatcttaggcactctctctctctctctctgttggaccactgactctagggaagccagctactgtgttttgaggatactcaggcagcctacagaaaggctcacgtgataaggaactgatgtttccagccaatagccagtgaggcctggcagcaacatgagtgagcttggaatccgcctccagctgattccaagctctgactaccatcttgactgtgggctgtgaaaaaccctgagccagaggcacccagctaagctgcttccagattcctgacccagagaaactgtgcgatgataaatgcttgttttaaactgttaattttgggataacttgttagagagcaatagacaaccaacacgaacaccatcacacagtcagacttgacaatggtactcacctccattggatatataaaagtctgtgcagttgctccagccatggaaccagaaataaatctctcaaatgttcctattttttgtccttcttcagtaagtaacttcttgtactgtataaacaagttttaaaatgcacattactacctgctgtggactgagctgcacccccaccaaattcatatgttgaagctgtaacctcccatgtgatggtattaggagatgaggcttctggaggtaattagggttatgaggtcatgaggatggagccctcatgacaggatcagtgttcttgtaagagcagacaccagagagcccactctctctctcccccttcacatgtgcaccaagaaaagaccatgtgagcacataccagctgtctacaagctgagaagagaacgctcactagaaatcaaactggcttggcccttgatcttaggctttcccgcctctgaaactgttagaaataaatttccgttgttgattccacacacactgtggtattttatggcagcccaagccaactagacaatcctagaatacaaatcagctcctagaaatcaataaattgacaaatgtgatgatgtgtctcgaaatgtatacactacattaataatacatagcagaagagcaaggcctaaatgctaatacacgcagtgactggacagtggttttcaagtcagatttccacaaaacacagatgtctcccagattggaccaagttgctcctttgctgaaacagcataacagcatccctccccaggtgtacagaaaatacaaggttaatcaagttttcacaatgtttggatattttccccacagtttttaaaagatgagtttattttcaccagtgcaaataaaatgaataaataggtgacaaacaaatattaacaaaacaatttataaaaacagtttctgtaggtaatacatagaattatactaacctatcaagcccagcatctccctggctatcagtactaaagtgacccaacatagctaactggaccaagggtataaatatgaccccaatacagccaaaatagtgactggccagtatattaatatcatgggattgagagtcaggcagacctgagctggaactccagagccacgtggcctcgagcaagttcatgaacaggtccacattgtggtttccttgtctgtgataacagtacttacctcacagggttatggaaaggattacaaaaaaataatacttgtaacacggttagtgcaggtctgaacacctagcaaatgttcagtagatgttattattattattaatatatgaatacactatctttacacaacttgctaagacattctgcccaaacatagaccatgggaattagccaggcaagccagattccttctctcagaaatgtgagggggtctccagaggtaagcagctgctgtcaccagagggacaaggggaaagtcaacagagagaagtggactcatgcatggagaagggaagggggaagtctcacctcctggacttctccagggatccttcccctacatgatccatccccacagtgatgcccattcctgtgccagccagtttctgttccctgggatctaaagtgcccaatgcaacaacatacgatgactttctcctagcaaatctgtgttttgctgctcatgataaaaattaagtatattatcatttcatgagattcccaaataccagacattcctccccagagagatcactgcttccaagggctctgtttcctgaactacagagtgttacataaaactcctcttctgcataggccctattaattttcctgcatgtcagattgtcaaaatcattaaacataatttgcttaaaaaccttcctgcactttaacagtaactttgaaggtaccttttataccttggacccccacagcacctatcaaaagtacagagtaaacgtttagtgactgatggaggataaatatttaaaggataagtgcttgaggctcctattccccgaaacataccatatacaaagggaagacttcaggacagagccaaaaagtcaggcactgtgcctggtatgtaaaactatgtcaccaagcttagtccccatcttagagatgaggtaatagtcacagagactttaagtaacttgccaaggctacagaactgaaccttcctaaaggagacttaactgagccctcaaaaccaccctgaaatccttttgtctatctcagttctctcccatttgttagactaaccattttgatcttctccattctcctccagcttccaataccacttcctccctcattctcagatcacatcctttctcaggagctcaaggaagagtagagaggccaccaggcagaatatcttggtattctgcccacctcctgcaaaattatccatagctactcacatattttttcttcccaaacacgtataagaagagttcttcttgtaatcaaagactaatccttttaacagtctctggatagaacctgtctcccccagcccctttccatctcccactccctttccctacacacaaactcccttgaaacacctaccgggttaatcaacctctcttacctatgttttcaacttctttatttgtattgacatgcttccttcagcaacaggcacattaaagtcaaatcaaaatcctccctccaggccaggcacggtggctcactcctgcaatcccagcatttcgggaggctgaggcaggaggaccacttgaggtcaggagtttgaaaccagcctggccaatacggtgaaacctcacctctactaaaaatacaaaaattagctgggtgttgtggtgcactcctgtaatcctaactactcaggaggttgaggcagaagaatcacttgaacctaggaggcagaggttgcagtgagatgagattgcaccactttactccagcctgggtgataaagtgagactccatctcaaaaacaaacaaacatacaaacagaaaaaaaacaaaaaaacaaaaaaacaaatcccctccacccaacatctttcttatctatcaccctctccctcttctagtttccttctcttcactgtcaaactccctaaaaatgtgtctctactgtccaagtttcttcacctcccattcactttaagctcatttcagcatggtttctcatttcattacttcacagaagcatttatactaagcttacctatctctgggttgagaaatcctaaaagatattcttattatattcactacccagtagtactgacccccatgaaaccgtttccttccactgactcctatgccatccctctctctggattttctcccatccctcgagctatttcttctcagtgtcctttgcaagtttcttcttttacttctccctttggacttattcctagaattcttctcatttataagctcttcttgagtgatcctgcccattccaatggctcaactcagcaacaacctctctatcaaagatctctctcttaatggctagctgatatacccaattgcttactggacagctccctgtacatgtcccacacatctcaaactcagcatgcacaaaatggaacctgatattgtattctctttgaatgcagtcactcaagttagaaattagaatatcattcttgactcttctctttctcacctccatatccagtcagtcagtgagttctgttgattctacttccaaaatatttctcagttcattcccttctccattccttaaagacatcaccttatactggtgttcatcatttcttacctcaattatttaaatattctccctgcctctagtctacctcactctcccccaacaatgtctccactcttttttcaggttgatattccttaaatgtgaatgtactcatttcacttccctatataagatgctacaatagcccctaccatattcagaataaaatccagactcctattacatttggcccctgtttatctgtccagctctttcatcattatctttccggaaacacactccaccagtcttgaggcacagtgaaccaccttcagtctcttcagtgagtgatgccttcttgtgcctacatttctgtccacatgctgctccttctgtttccaatccttatcttcccctttatttatttatttattttttttttgagacaaggtctcattctatcacccaggctagattgcaatggtgtgatcccagctcactgcaacctctgcctctcgagctcaagtgatcctcccacctcagcatcctgagtacaggcacacacccccacgcccaactaatttttatattttttgtagaaatggggttttgccacgttgcccaggctggtcttgaactcctgggctcaagcaaactacctcctaaagtgctgggattagaggcgtgagccaccacgcccggctccccttcatcttaatggcttgagattgaggcaagcttgagctctaattccagtctgtcagttctgtcttttcatttacttaataagggtttcctggcactgggcaaggtgctaagaatacaagtagctactgcctaaggaagctcacagtctcacaaagcagataagtacagagaacgtcagaattcaatgtgaaagtgctgtaacaaaaggaaactagaacagaaggcttcccagaggaactaactcctgagtaagtactaaagggcatttcccaccatatgacatatagaaagaggaagggtgtctgtctgtgttgctggagcagggtcaggagacagggagtagcagaaagatgaccatgcatggtggccatattgagtgggaggcactcctgggtcatgcaagcagagatgctgaaacacacagtacacaggtagacctacagtgttgagataaagaggaagatgttggagtggaaagcagtcagtacagagatggcagctgaaaccacaagaacactaccccacactattacactgtcaatgatacaatgacactactatggtaatgacaacccacagagaacacaggtttaccccatactgatgatgtgtttgacagagctacataccaggttgaaaagatctttttcttagtttcctaaagtactagctattcaaggaacaaaatctatctgaatctaaaagtgacctagttacatactctgggaaatttgagaatatatacagcctatttaccccgaagtaatttacaatccactgggaaaacaatgggttttccatcatccaatgaaaaatgggatattctgcaattcagcactcgagggaggctggacaggggaggaactggctttgattgagatgcttagtatatgcttgtcacaggaaggtggcttttagagagccccgagggatgaatggaccttcagcaggaggagagaaaacagcaccataggtccagagcccataagaacactacaccacactgtgtagacagctttctcttcatgtctaagaaagttagtgtgcagaaatcacaatactataaagaggtctcaggaaggagcttgggtggacagaagcagaggatgcctgttggtggtatccaaggtaagaatctgacaaatggcataaagcaaaatgtgcatatttgcttgcaatacccatggactttttcaaaaataccaaacttcttgcatactgaaataactgcattgagtatttatttattttaggctgtggctttcctatcataaaatccaagtatgtggtcagaataacctaagggtatctcaaacattagcccttaataatcatgatttgaatcttcaaaccttcatataaggaaaatagccttcccaaggataggttctaattaaaatcctggagactagattttctttaattttttttttttttttgcttctctatttcctaggcaaagaaaaggataccactggacttcgtaaacttctcaagagtattctcttgctcaagaacaaaacactctccagaataatctaaaatctacatggaataatacaaaaactatggggggggagttgaatttcaaggcccttacagtccttgataaacaatgatggaataaataatggaaaacataatctgtggctgctcaactagacagttctgctaatgaccataaagagaacccaaactctaaaacttacctctgtatttcccctttacattgagttaggctgaagcaatagctcaaataatccaagttaacaaaagccgacagagaagtgattcagaggtaaatgcatttgttcattcattgactcattcaacactcgcttgaaacttatcacatgccaagctctgtctaggtgctggagtacatggggaagaagccacgcccctgccttcatggaggtgtcactccaaactcagctcaattttacagcaacgtcaaattacacaaaggacttcaacttatagttttccttccagaggttagattgtgacactttcataaaacttatgttagtgtgctgcttctgctcaggattcagaatgaataaactaaaattctacccttcctttaagaactacttagaaaaaaaaaactttataaataatatgatgaattaagaatcccataacttggtcatgagaaatctctgattttatttagtctaatctcctataagtgatcctccttatggagtatatgtgaaagattatcatgtattaaaacaagaatcccaaaagcattatacattaacatttattgaatccgtttactaactcctctttgttaataaattccacgggtgataacaattacctgttcatatgcccagaatttaacagctgtctcaggagcaattttgatgacgtttgtaccatttcccctccaaagcgagcggatacctccttcttttaccatctgtcgaaagccaccaaatatgttcattttgtctgattttgaaccgtgaacctaaaaataaaagcagaatgatataaaatgctggtggcatattactattactttttctagaacaaccacacaatctttttcaataccctttctaactgcaagaagatatatttgaaaataaaatatagaaaggttgaaaaatatatataatgatgagagggagtattgccatgattttagaggcctgtctctgactctaaaactaagaataattggtatcttcagtgtgagaaagcagagagagaagacaagaagagtattaaaattatgaacaaccttcataagataatattaactaaattatgtatcaggcaatggaacaccctttgaaacatgaacaggctcagttaaagggaaataaaaaagtatactgcagataataatattatattattacatataatttaatgtatgtatattattacatataatttaaagtaatatgttactccctctcctcaagaagtagtacagacatgaactgtaaatgggtctgaaatggtttggatattgtgtatatcagggctaccaacactggaatgcatacagcctgaaaccaaaaataaaaattgcaccctctttggcatattttgaggccctctctaggcaataaattcattacaacatgtacccatcctgtgagtactgataaattacttggcttatactacagatgtggtagtcacttaaaaatactgtaccttatgaccacctacagataaaaactgattaagtccaatacaccaaaaataattaaacaaatcagctattcttctgattgtttcagctcacataaaaggggtgactaccactaaacacacacacacacacacacacacacacacacactcacagaacgggttgaattctgaaggccagccatgtggccagtatgaaaacgggccccaataagaactctgcacaccaaaggctcaggtgagcttccctggttggtctgcaatattccatgcctagtgccacataacagtgccaggaaagtaagacatggagactccacagggagaggacaacagaagctctgccctatgtgcttctttacttgactgattttcatccgcatcttttccccgtaataaaccataaccaggggtaataagctttcagtgagttatgtgagtctttctagagaagtatcaaacctgaaggttgactttggaaactcctcaaatttgcagaaactaaattccagagaaatccattttattttaaataaataaacttcacaataaaataggacaaaggaaaaaataaatgcttattcaagttctctaaaagtcaagttactactgttcctaaagaaaaacacacaccaatcccctctcctttttctttaaagcattagctttgcccctaaataaattttgagatttgggtacattctgaaggaatgctggcttaaaacagtgtcagaatctttttgtacagaaatctacagacaaatataaaaagtgttgaccataagtataacaaagttttaaaaatattttgtaaacaactactatgttccaataggttattccagtgtaccagacattatcacatacctgatattgcttgattcttaaaccattcttattagatattcttatccccatcccagaatgaaggaaaatgagacctcagaggtttcatgcagcatgagaaccaggagcactggaggcaaagatactgcattccccctctcatttgttgtaaaggaaaagtcaattctctgggcctcagattccccctggaaaaatgataaaatacctacttcactgggctgctgcaaggattaactgggttaccacagtgagcaaatacatattaattcttttccattccctctttccactctggccagcccaatgctacactgctagtaaatagcaaagtcagtctataaagccagatctttttctgctaacctcagctttagaataattttcaaaattacattgctgctctaagattctagatttcaaaaatactttacttttgataaagtatattaaaaagaaggaaactataaatcaggagaatcctacaacaatagctagagatattttttgaattaaatgtttgaatagtcatagaatgccaaagattaaaagttcattacacacatgtactaacaatttaaggtttggtacactgccatacttacatggactgaatttagagttaacagcaacaaaatagatttattttttagggtataaaagattattactgagaaattttaaaacttctttttcaaagcaccacatttctcattgttttagaatatttagggcaaacctggacacacgataataaagctcacctgcatcatgattttcagacggtccaaaggggcagtgcttgttcgagagacagcaccagcaatgcctcctgccaaaagctgcctccaccattgtccggattttttttcgtcttccgtgaattcatctggaatagttaagctatcccctatgtcaattccctgtaaaaatgaaaaaaagatccccatgcgccttagttaaaaataatcccagaagacgttttgttttagagaagaatcatgttattttacagttaatatgaacttcattccctagaatttatactaaaccaatttgagtacatagattataagttgtctactcacaatgaacaaagtacagtatcagttcacaagaaatgaaaataaacagtaattacaaatatacaaaaccaacagttacaactttctttcattcatcatagattcacagtatgttttctcttggtctaggttaaaatgaaagggcagcattttatcatagtcaatcttttttattgcaaccatttttcataaggctagaaaaccaactggtgatgacatcttttaagaaattcgttcatcaattcttaaacaatacttcctttatctcaaatttatatccacatcatatttataccatgatatgttttaaatatgtaaataaaaattaaaactgtatgtgaatacccctaaactcatttcctactgtttataaaaatatttttataaatctgacttatcatttaaaacatgcaatagattctatataaaatttagctaatggagaggtattgtttcaaatcatcaccccttcaacctattctacattactatagtttgagagaaacaattctataataatatttttacaattctattatctaaattgttttggcagaaaaatttttacaggcaagagtgcaacggggaggagctctcctatggtagtaaccctcccttccttcattttactatcaataaaatggagatacaattgtagtctcaactgttatcaactaccttaaaaaataccgtaagaattatgtaaataaaacttcacatagtgtacaatttatctaggcaactgaactactagtataatattatcttatactcatagctgagaaggcactaatcaccaacaattttataatgctttatgtaagcttaggcattgttactagtggcaatgtgaactcctgacttcatttaatgcatatttaatttagtcaaatctgaagtgtagaagacaagcccataaagaaaaaaaaaaaaaaaaaggccgggcacagtggctcacgcctgtaatcccagcactttgggaggcgaggcgggcggattacaaggtcaggagatcgagaccatcctggctaacacggtgaaaccccgtctctactaaaaatacaaaaaaaattagccaggcgcagtggtgggtgcctgtagtcccagctactccggtggctgaggcaggagaatggcgtgaaccccggaggccgagtttgcagagagccgagatcgcaccactgcactctagcctgggcaacagagcaagactccgtctcaaaaaaacaaaacaaaaacaaaaacaaaaacaaaaaataaataaaactccttcagagagttcctaagggtttcaggagcagattgcacaataatagaacttggtttacatcagtatgcagaatattaatgaaacaatcaaaatttgaaagtttggtggaaaacaaactggtatgaaatgctaagcagatgaagcaaaaagattctgtaacctttaatgaatattgttaagtgccttatgccagagataaacataatctgaccaaacaaggacacagatccttagcaaccatgaggtgctgagattatttggacaatatagtacctataaaaagtaaaagcctacaacttttacacttccctatggcagaatacttaaatgccaataaaagctagacagcttattcatcaaggtggtacttcttccaagttttcagaatggacatttatgcagtcttgggttgtttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcctgctgccttcaagcatctgtttagcaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacctctttctacacagacacagcaaccatccgatttctcaatcttttccccacctttcccctttttctattccacaaaaccgccattgtcatcatggcccgttctcaatgagctgttgggtacacctcccagatggggtggtggccgggcagaggggctcctcacttccctgtaggggcggccgggcagaggcacccctcacctcccggatggggtggctggccgggcggggggctgacccctccacctccctcccggacagggtggctgccgggcggagacgctcctcacttcccagacggggcggctgccgggcggagggtctcctcacttctcagacggggcggccgagcagaggcgctcctcacatcccagacggggcggcggggcagaggcgctccccacatctcagacgatgggcggccgggcagagacgctcctcacttcctagatgggatggcggccgggaagaggcgctcctcactttccagactgggcagccaggcagaggggctcctcacatcccagacgatgggcggccgggcagagacgctcacttcctagacaggatggcggccgggcagagacactcctcactttccagactgggcagccaggcagaggggctcctcatatcccagacgatgggcggccaggcagagacgctcctcacttcccagacggggtggcggctgggcagaggctgcaatcttggcactttgggaggccaaggcaggcggctgggaggtggaggttgtagcgagccgagatcatgccactgcaccccagcctgggcaccattgagcactgagtgaacgagactccgtctgcaatcccagcacctcgggaggccgaggctggtggatcactcgcggtcaggagctggagaccagcccggccaacatagcgaaaccccgtctccaccaaaaaaatacgaaaaacagtcaggcgtggcggtgcgcgcctgcaatcgcaggcactcggcaggctgaggcaggagaatcaggcagggaggttgcagtgagccgagatggcagcagtacagtccagctttggctcggcatcagagggagaccgtggaaagagagggagagggagaccgtggggagggggagagagagggagagggagagggagagctgtttttttttgtttaatactctataaatctatgcctaatagaataaatagaactctacaggttaaggagctactgggactcaggtatcctggcccataagtgttacagagtgttcttgggtgataactgtacctatggtttatagctccaaataagtataaatacataaagtagacttactgtagaatgtttccagaaacggataatttcctcaatgtctgtaacaggattaaataagaagtagtctctccattcattccagtccactgtcattgtcccatcaacatcaatgctgaaattttaaaaaaatgatcaaagtacaaaactaaattgataaataaaactaacattattggccactttacagaatgacagtttcttttctaacataatattctcattaaattaaaaaaccccatccacaaatataggttgttggaaatggcagcaagcattttatggtcctgtcagatagttttaattatctagataaaaatgggcccaaaaattacagccagctcactaaagaatactttcagcactctgtcaaactctgccaatgagctacaaaacacaaaaacttgaagataaaatattaaacgatggtaatgaatagattcattatccatttttttcatgcacttagtggatcatgaagataattcttaatgttctattgcaacatttgaatgtagttttgaaatatactcaaaacatgctatcaacttcctcgaagttaggaaaattaacagctattataaaaaatcaaactgtcagtgactgtgcctttgagtcttttttttttattattatactttaagttttagggtacatgtgcacaatgtgcaggttagttacatatgtatacatgtgccttgctggtgcgctgcacccactaactcgtcatctagcattaggtatatctcccaatgccatccctccccctccccccaccccacaacagtccccagagtgtgatgttccccttcctgtgtccatgtgttctcactgttcaattcccacctatgagtgagaatatgcggtgtttggttttttgttcttgtgatagtttactgagaatgatgatttccaatttcatccatgtccctacaaaagacatgaactcatcttttatggctgcatagtattccatggtgtaaatgtgccacattttcttaatccagtctatcattgttggacatttggcttggttccaagtctttgctattgtgaatagtgccacaataaacatacatgtgcatgtgtctttatagcagcatgatttatagtcctttgggtatatacccagtaatgggatggctgggtcaaatgatatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttctttcgagaagtgtctgttcatgtccttcacccactttttgatagggttgtttgtttttttcttgtaaatttgtttgagttcattgtagattctggatattagccctttgtcagatgagtaggttgcaaaaattttctcccattttggaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggggttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctggtttggttactgtagccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattgccttgggcagtatggccattttcacgatactgattcttcctacccatgagcatggaatgttcttccatttgtttgtatcctcttttatttcattaagcagtggtttgcagttctccttgaagaggtccttcacatcccttgtaagttggattcctaggtattttattctctttgtagcaattgtgaacgggagttcactcatgatttggctctctgtctgttgctggtgtataagaatgcttgtgatttttgtacattgattttgtatcctgagactttgctgaagttgcttatcagcttaaggagattttgggctgagacaatggggttttctatatatacaatcatgtcgtctgcaaacagggacaatttgacttcctcttttcctaattgaataccctttatttccttctcctgcctaactgccctggccagaacttccaacactatgtcgaataggagtggtgagagagggcatccctgtcttgtgccagttttcaaagggaatgcttccagtttttacccagtcagtatgatattggctgtgggtttgtcatagatagctgttattattttgagatacatcccatcaatacctaatttattgaaagtttttagcatgaagtgttgttgaattttgtcaaaggctttttctgcatctattgagataatcatgtggtttttgtctttggttctgtttatatgctggattacatttactgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagaaattcaacttcttcctggtttagtcttgggagggtgtatgtgtcgaggaatttatccatttcttctagattttctagtttatttgcatagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaacaaccagctcctggattcattaattttttgaagggttttttgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagagcgtctttatttctgccttcatttcgttatgtacccagtagtcattcaggagcaggttgttcagtttccatgtagttgagtggttttgagtgaaattcttaatcctgagttctagtttgattgcactgtggtctgagagatagtttgctataatttctgttcttttacatttggtgaggagtgctttacttccaagtatgtggtcaattttggaatagccgtggtgtggtgctgaaaaaaatgtatattctgttgatttggggtgcagagttctgtagatgtgtattaggtctgcttggtgcagagctgagttcaattcctgggtatccttgttgactttctgtctcattggtctgtctaatgttgacagtggggtgtgaaagtctcccattattaatgtgtgggagtttaagtctctttgtaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgtctttttttgttttccatttgcttggtagatcttcctccatccttttattttgagtctatgtgtgtctctacatgtgagatgggtttccttaatacagcacactgatgggtcttgactctgtatccaatttgccagtctgtgtcttttaattggagcatttagtccatttacatttaaagttaatattgttatgtgtgaatttgatcctgtcattatgatgttagctggttattttgctcgtttgttaatgcagtttcttcctagtctcgacggtctttacattttggcatgattttgcagcggctggtactgattgttcctttccatgttaagcacttccttcaggaactcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggtttgtagagtttctgccaagagatccgctgttagtctgatgggcttccatttgagggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggaggctttgctcgtttctttttattcttttttctctaaacttcccttctcgcttcatttcattcatttcatcttccatcgctgataccctttcttccagttgatcgcatcagctcctgaggcttctgcattcttcatgtagttctcgagccttggttttcagctccatcagctcctttaagcacttctctgtattggttattctagttatacattcttctacatttttttcaaagttttcaacttctttgcctttggtttgaatgtcctcccatagctcagagtaatttgatcgtctgaagccttctctcagctcgtcagagtcattctccatccagctttgttccgttgctggtgaggaacagcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaaccggctgtgtgaggtgtcagtgtgcccctgctggggggtgcctcccagttaggctgctcgggcgtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaagcaagcctgggcaatggcgggtgcccctcccccagcctcgctgccgccttgcagtttgatctcagactgctgtgctagcaatcagcgagactccgtgggtgtaggaccctccgagccaggtgcaggatataatctcctggtgcgccattttttaagcccgtcagaaaagcgcagtattcaggtgggagtgacccgattttccaggtgccatctgtcacccctttctttgactaggaaagggaactccctgaccccttgcacttcccgagtgaggcaatgcctcgccctgcttcggctcgcgcacggtgcgcacacccactgacctgcgcccactgtctggcactccctagtgagatgaacccggtacctcagatggaaatgcagcaatcatgcgtcttctgcgtcgctcacgctgggagctgtagaccagagctgttcctattcagccatcttcgcctttgagtcttaagaaatcctggcacctcattttcaatcttaaaattaacatactgtactcaaatatttatcattaatatttggcttgttttacaagtttcttggtaattaatgccatttgtatctgttttctcctaagagaaactctgagtgtaccaggattttgactgttttattcccttccttgggccacctcttacagctgctggcacaaagaaggtgctcatttatttattgaattaatggatgtctctaaaaaaagctttggtgcatcctacaaattttattctataattagtatgaaaatgatgcaaaaggatggcagtcaaataaaatgcaattttcaggtattcattattgtgttttctagtgtcactttttattttgacttgcatatgggaaattacacttaaactttcatttgtcccagcacagaggtatatctgcatgagagtcctagtcactacttacatttataatataactctgggttgcaatatttataggtttatttatgtcactattttctattttaatgtaattgttgtttgaccccaccacccaactccccacacataagcatcctccacaaggcaaggattttttttaatttcattcaaagttataaccaaggtttctaaaacagtgcctgccactgagtatttattgaataaataaatgaattacaaactctgtagcttaaaaccacagaacatttagggtattgacaaacttcctagataagatagtcttgctgtgggtataacttgcatttcccttcaaattactaaacgtgttgagcatctcttaccatgttcatttgctactgctgtttctttcacgtgaaatatgctgttcatgtctttgcccgtttttctaaccggttgtatgtctttttcttatttacatagttctttatatcattcattctaatccttcaagttataagctggcaaataccttctctttgtctttccactctatgctgtccaagtacagatgctcttgattttaacgcagctgaatttaatctttttaatgcagctgaattcaatcttttcattcctatgtatggccttttgtgtcttctttttaaaataaattcttccctacactgagataaagatatttcttccccaccacctcaagctgttatagtttaactttcacgtttaggttggtgtttgtgtacggtaagaggcaggtatcccaatttcctttttgtctgcatgagcacgagcatcatctattgcacacactctccttttcccaaagttttgcaaagctacttctttcacgtgacaaatccaaaatatggatgggtctgtttctgggctctctattatgtttcacttgttaacttgtctgtttctgtagaaacagcactgacttggttatggcttaataacaacccttggtatctgatagggcaggcccctggctccttacagttcttcaggaatgtcctggatattcttaggcctttgctctttgatataaatttgagactcagcttgacaaattcctcaaaaaaaccaggtgggtttttttaatggcattgaatctctatcaccaatttggagagaaggtacatcttttctatactgagtcttctttaaagccttctaacaaattttgttaagctgctcttatgaatgcattgattgtggtatattttttaaaatggctgattcagtttgctaatattttctttaaatttttacatataagtcataggtatcttggcctctaatttccctgtttcatatactgtctgcttttggtgttataatgatctcctagaaaggataggacagtgtacttctacactctggaaatgtttgtacatctgttctttaatcatttgcaagaaccatctggggctaacgttttgtttatgagaaaattttaaattactgacccaatctcttcaattgcttaggtactataagctgttgcttcttcattcagtcccagtaagttatatttttctagaaattcacctactttgtctgttttcaaatttattggcattaatgattcatattattttattagttttttaaaagtccttatgtgcctatttataactgaacatgatttatttacatctcatttctcttttttcttcatcaatctttccagaggcttgtcttttccaacagtttctggctttgttgatcctgttactgcatctttgctatatattctttattatctccttcctcctaccttcttcgagattattccattttctctcccctaacttagcacattaattttcagacttaattcttttctaataaaagctttcagactataaaattcatacaagttccatcttagaaatattccataagttttaatgttttcaagtcaacgtgtccttgaatttccacttacgatttcctttgacccataagttgagaagtgtatatcacactttaaaatattggcatttttataatttatgtctgtaattaacttctattttaatgcatagtggtcagagaaagcagttcttgtgataccagttctttgaaatgtgttgaacctggctttatggcctactatgaaatcaatttttatacatgttccataaatacctaagaaaaaatattttttctaattttttgatgctaggtcctattacatgcccattaaatcaagcttatgtatttagaagtttttgtcttcactaaagtttttctctgcttgacctatcaaatacaggaagaattgtgttaaaatctctcaccactatgatggatttgccaattaatccccagaattttatcaaccagcttaaaaattgtatatcctcatactgaattttaaaatgtagtgacactctatttttattaatgtttttactatataatctattattaatagattattaataataattaacagttgatattaacatagctaccccagctttttttcagtaagacttttattttgcttgttctttcatctgacaatctctgccttctgatgaaatttacattaatttttattaattgaagactaaactgagaaagtcctaactgatcagaaggtgattatcttctaacttactcgtcacccacctcaaacccccagggaaacaggataagaactctatttaggctgccccatttgagaatggggatgaagggaaatcatgccccaacattactgcagggcacattttagtggagttttactgtacttgaatttatttctcacatcttacctattgctttctaattatctcattctttctatgtttttccctcttctctctactcttcattggattgtttcaatcttatgtttatgtatttattttcttattccatttctttcccccctgatttggaagttatatactcaactactacagtttcaatggtttaccttgaaattttaccacatatatataacaaagtctaaagttaatgtctgaccccatcatcctaaataaggtaagaattttagaacagtttaatacaaatcatccccttccctcctaacttacatactattattgtctagtattgtagttgtcctttttcttagaacccacaaatgggtcattattatcatattcatggatgtttccaacagactgctgaaataatccataggccactagctaagaggtggcccactatggtctagagagtaccaagaaacactgtgtgacccattccccatatatgctgcctccagggctgtatatgtcctttcccctacctaccttccactcacccttttcagtagcataattctactcattctttaacatattcttcaatattttctgagagtccattattgcaacgtggtggacatagaactgttaaccagatacacatggtctgtgccctcagtgggaacaacaggcatggcactaaacaaaagcaagcaatactcaatattcattgagcatttgccaggcattgttctaagtatttcacatgttaactcatttaatccttaaaacaagcccatgtatttactatactctccattttacagacaaagagaggctaagaattttgttatagtcacaagactagtaagtagagtagaattaagagtttcaacccaggcattctaactccaaactgtactcctaaccactgagctatacaaacaagtcaaggattacaaaccataagtgccatgaagcacagaaacaaattgcatagtcaaagaataactggagtgaagggttccaagcttctgaacaattctggagaaagaaatgtaaagatatgaaaatgagagtaaacaggggaaatgagatggagacaaaagcctaaaagaaaaatgagagcagaagataattatgacatatgtgaaacacatgtttcagagggaatgcctgcttcagctacttcatatctacagcttctactgaacaggtgtaagtaggaggctatatttcaactcagtgactcctctcttacaccctgatgacccagtcacagctgtttcaatcaacactgtgttagtctgttttgtgttgttttaaacgaacacctgagactcggtaatttataaagaaaagaggcttatttggctcacagttctacagactgtacaagcatggcaccaacatctgctcagtttctggtgagacctcaggaagcttttactcatggctgaagaaaaaaggtgagcaagtgtgtcagatggtgagagaaggacaagagaaatgagatgccaggctcttatcaacaaccagctttcatgaactaatagagttcacttattaccaagccattaatgaaggatccactctcgtgacccaagtagtccctacttccaacactggaggtcatatttcaacatgagatttggaggggacaaatatccaaaccatattaagcaccattcagatgtttttcccatgaattcaagtttgggacacaaagagacagtgaaatggaagaaaacaagctgacatttggagtgacatgagtaacactaatggcttagcacttgagggaaggtccatgatggttatataactacaggaaactctggtcacattctgcctttaaaaattgtttctaacacttttactgaagaagtataaacactagtaataataataataataataacaatatcccaaaagtacaaaaaaagtcactagccatgaaagaaatataaatcaaagccatgagatatcacttcataccaattatatattagtcagggttatctagagaagcagaaacaatggatggttaaaatcaaaagaaatcaaaagacagttcagatatggtggctcatgcctgtaatcccagcactttggtagggcaaggtgggtggattgcttgagcccaggatttcgataccagcctagatgatatggtttggctgtgtccccacccaaatctcatcttgagttgtagttcccataatttccatgtgtcacgggagacagctggtgggaggtaattgaattatggggggtggtcaaccccatgctgctgttctcatgatagtgagtgagttctcacgagatatgatggttttatagggcttttccctctttgctcagcacttcttcttcctgccaccatgtgaaggacatgtttgcttccctttctgctatggctgtaagttatctgaggcctccccagccacgcgaaactgtgagtcaattaaacctctttcctttataaaatacccattctcaggtggttctttatagcagcgtgagaatgaactaatacagtaaattggtactaggagttgggtgctactataaggatacccaaaaatatggaactgactttggaactgggtaacaggcagaggttggaacagttaggaaggttcagaagaagactgggaaagtttggaacttcttaaaaatttggagagctcagaagacaaaaagaggtgggaaagtttgtaagttcccagagacttgttgaattgctttgaccaaaatgctgatagtaatatgggcaatgaagtccaggctgagatgatctcagatggagatgaggaacttgttgggaactggagcaaagatgactcttgttatgctatagcaaagagactggtggctttttgcccctgccctagagatctgtggaactttgaacctaagagagatgatttggggtatcaggcagaagaaatttctaagtggcaaagcattccacaggaagcagaggacaaaagtttgtcaaatttgcaccctgatgatgtgacagaaaagaaaaatctattttctgaggaaaaaattcaagccagctgcagaaatctgcataagaaacaaggagtgaaatgttaatcactaagacaatggggaaaatgcctccagggcacttcagaggtcttcaggaagggccctcccatcataggcccagaggcccaggaggaaaaaatggtttcctgggccaggcccagggccttgctgctttgtgcagtctcaggacttggtgccctgcatcccagccatggctaaaaggagccaaggtacagctcaggccatggcttcagaaggtgcaagccccaagccctggcagcttccacaaggtgttgagtctgcgggcacacagaagataagaattaaggtttgagatcctctgcctagatttcagaggatgtatggaaatgcctggatgtccagacagaagtttgctgcaggggtggagcccttgaggagaacctccgctagggcagtgcaaaagggaaatgtggggttggagccttcacacagagtccccactggagcactgcctagtggagctgtgaaaagagggccaccatcctccagtacccagaatagtagatccaccgacagcttgcaccatgcacctggaaaagccacagacactcaacgccagcctgtgaaaagagccagaagggggtctgtaccctgaaaagccacaggagtgcagatgcccaaggccatgggagcccacttcttgcattagcatgaactggatgtgtgatgtggagtcaaaggagatcattttggagctttaagatttgactattccactagatttcggacttacttggggcctgtagccccttcattttggccaatttctcccatttggaacaagtatatttaatcaatgcctgtaccctcattgtatctaggaagtataataactaccttgcttttgattttacaggcttataggcagaagggacttgccttgtctctgatgaaaccttggacttttaggttaacgctggaatgagttaagacgctgagggactgctggaaaggcattattgtgttttgcaatgtgagaacatgggatttgggagggaccagggcaaaaatgatatggtttggctgtgtcctcacccaaatctcattttgaattatagttccaataatccccacatgtcacaggagggacccagtgggaggtaattgaatcatggaggaggctaccctcattctgatgttctcatgatagtgagtaacttctcatgagatctgattattttataagggtttttttccctctttgctaggcactgctcttcctgccatcatgtgaagaaggacgtgtttgcttccccttccaccatgattgtaagtttcctgagggctcctcagccaagcaaaagtaagtcaattaaacctctttcctttataaattacccagtctcaggcagttctttatagcagcatgagaatggactaatacaccaggcaacatggcaaaaccacatctctacaaaaaatataaaaattagccaggcattgtggtacaatgcctgtagtcccaggtactcaggaggtgagaggatcaattgagccagggaagttgaggctgcaatgagccatgattgtgccattgcactccagatgggatgacagagcaagaccctttctcaaaaaaaaaataaaaatcaaaaaatgaaaagacagacagtaatgagtattcatatagctatggagaaactgaaaccttcattcattgctgctgggattataaaatggtgcagccactttagaaacaatttggaagttcttcaaaatattaaagatatttaattaaatattaaagaatctctagacaggctgactgttgaagggcattctcagacaaagccagtctgcaaagactgaaataagtgcctacttcttcaaatgcacagatgtaaacacaaggccacaaacatcaacaacaatcaggaacaaatgacaccactaaagaaacaaaataaagtaccagcgaccatccctaaagaaacagagatgtatgaactgacatagaattcaaagaaagctcagcaaacttcaagaaaatacaaagaaacaattcaatgaaattaggaaaataacgagtgaccacaaagagaaaggtaataaagagatgaaataataaaagaaaaaatcaaacagaaatcatggggctgaaaaatacaatgaacaaaattaaaatgcaatatgggagcatcaactgcagaagtgatcaagaagaagaaagaaactatgaactcaaagacaggttatttgaaaatacacagaggagaaaaaagaatgaaaatgaatgaagaaagcttacaagatttatggaacagcatcaaaagagcaaagttttgagtcacaggagttgaagaaggagaaaaggaagataaaaggggtaaaaagcttaattaaagaaacagtaacagaaaattttccaaacctggagaaagaggtaaatatctacatgcaggaaaagtccaaggtctctaatcagattcaatccaaacaagactaccccaagacatattacaatcaaactatcaaaaatcaaagacaatgagaggatcctgaaaacagcaaaagataagaagcaaataacatataagacagtcccaatatggttggaaacagactggtcagcagagacctaacaggtcaggagagaaagggatgatatatttaaagcgttcaaggagaaaaataccaaccaagggtaatgtacccagcaaagtgtccttcagaaatgaaggagagatactttcccagacaaacaatagctgagggagataatcatgaccgcacctattttataagaaacgtaaaaggagctcctcaagctgaaagaaaaagatgctaatgagtaacacaaaaacatctgaaagtataaaactggctgataaaagaaagtacacaggtaaattcaaaataatactgtaatgatggtatgcaaatcacttacatctgtagtaggaaagagaaaactattaaaagtaataatagctacaataatttaagggatacacaatatgaaaagaggtaaactgtgacatcaaaaattcaaaatttcaggggattaagtaaaagtgtagatttttttgttttggggggtttttgcaataaaaattaagttatcaagttaaaataaactattataactcttaagatgttttttgtaacctcttggtaaccacaaaccaaaaaccaataggagatacacaaaaaataaaaagcaagaaatcaaaacataccactagagaaaatcacttaaccacaaaaaaaagacagcaagagaggaagaaaagaataaaggatctataaaagaaccatgaaacaataagcaaaatggtagtacaaagtccttacttatcaataattaccttgaacatgaatggattaaattatccaatcaaaaaacacagtgtctgagtggattaaaaaaactagatccaactatatgctgcccatgacagactcatttcatctgtaaaaatacacacagactgatggtgaaggaatggaaaaagatattccatggaaacagaaaccaaaggagagcaggagtaactttacttgtatcatataaaacaaactttaagtcagaagttgtaaaggagaaacaaagttcctatataatgataaaagggtcaattcaataagaggatataatagtaagttatatgaaggtacttttactccactcctcccattttaaattttcagtgtcacaatttatatattttatattgcatatcccttaataagttatgtagctattgttttttataaatatatatgaacccaacatcagagcacctaaagataaataccaaacattggccaggggtggtggctcacacctgtaatcccagcactttgggaggccaaggcgggtggatcatgaagtcaagagatcaagaccatcctggccaacatggtgaaaccccgtctttactaaaaatacaaaaattagctgggcgtggtggcatgcgcctgtagtcccagcgactcgggaggctgaggcaggagaatcgcttgaaccgtgagacgggggctgcagtgagccgagaccctgccactgcactccagcctggtgacagagtgagactccgtctcaaaaacaacaacaacaacaacaacaacaaataaaataaaataaaaaccattaatacgtctgaaaggagagagagactgcaatacagcaatagtaggggacttcaacaccctaccttcagcaatagacaaatcatctcaacagaaaatcagtaagaaacatcagacttaaactatactctagaacaaatggacagatcagacataaaacatttcacctaatggcaagagaatacacattcttctcaactgcacatggaacatgcaccaggggatatcatatgttaggccacaaaacaagtcttaacaaatttaagcagaatgaaatcatatcaagtttcttttccgaccacaataataaaaaactagaaatcaggccaggcgcggtggctcacgcctgtaatcctagcactctgggaggccgaggcgggcagatcacgaggccaggagatcaagaccatcctggctaacacagtgaaaccccgtctctactcaacatacaaaaaattagccgggcgtggtggcgggtgcctgtagtcccagctactcgggaggctgaggcaggagaatgacgggaacccgggaggcggagcttgcagtgagccaagatcgggccacagcactcaagctcgaggacagagtgagactccgtctcaaaaaaaaaaacaacaactagaaatcagtaacagaggtgcttcagcaaattcacaaatacatggaaattaaacaacatgctcctgaatgatcagtgggtcaatgaagaaactgaaagcaaaattcaaaaatttcctgagatgaaaaaaaatggaaacacataataccaaaacccatggaacacagtaaaagcaattttaagagcaaagtttatggcagtaaatgcctacataaaaacaaaaaacctcaaataaacaaccaaaaaaccccaatagacatttttcaaagacatacaaatggccaaaaagtacaaaaaaaaaaaaaaagctcgatatcactaattaccacagaaatgcaaataaaagccacaatgagatatcacctcatactacacttagaatgactattaccaaagagacaaaagataacaagtgttggcaagtatgtagagaaaagggaacttttgcaccctgttggtgaggagttaaactaatacagccattatggaaagcagtatggagttcctttaaaaattaaatatagaactaccatatgatcctgcaatcccaccactgtatgtatgtgtgtgtatacatatatatatacacatatataaaatgaaatcaatatgtcaaagagccatgtgcattcccatgttcattatagcactattcacgatagccaagatacggaatcaacctaagtgtccaccaatgcatgaagagagaaaatgtgctatatatatacaatagaaaactattcggccattaaaaaaagaaggaaatcctgttatctgtaacaatatgaatgaaataagccaggtaaagacaaataaatactgcatgatctcactcatgtggaatcagaaaaagttaatctcatagaagcagagagcagaatactttgggagtcgggtatggtttgtgttaaaggacacacaatttcagcttgacatgaggaataagttcaagagctccactatacaacatgaagactacaattaataataatatattatattcttgaaaaatactaagagaatggatgtaaagtgttctcaccacagaaatcattaagtatgagatgtatcatgttaattagctagacttagtcactccacaatgtacatatacttcaaaacatcatgttgtacatgataaatacatgtaattctgtcaatttaaaaataaataaatgttttaagtcactgaattgtatactttagaaaagtgaatttatggcatgtgaattacatctcagtaaagctgctggctaggtgcggtggctcacttctgtaatcccagcactttgggaggccaagatgggtggatcacctgatgtcaggagttcgagacaagcctgaccaatatggtgcaaacccgtctctagtaaaaataaaaaaaaatagccaggcgtggtggcgcgtgcctatagtcccaactactcaggaggctgaggcaggagaattgcttgaacctgggaggcggaggttgcagtgagctgagatcgcaccattgcactccagcctgggcaacagagctagactccatctcaaaaaaaaaaaaaagttaccataaaatatttatattaaaaattgtgtagctacttttaaatatccaaccctctgcattatcctttgctatggactgagctgtgtccctcccaaatccaaatgttgaggccctaacccaccgtgtgattatatctggagatagcatctttagggggtaaagtcaaataaagtcataagaatggaaccctgatccaacaggactatggccttataatagaaagcaagagaaagatctctctctctctctctctctctctctctctctctctctctctctctctctgccatatgacaatacagtgagaaggggtctatctgcaagccagaaagagagccctcactacaacccaaccatgctggcactctcatcttaaacttccagctcccagacctgtgaaaaactaaatttccattgtttaatgcatccagcctatggtattttgtcatggcagctaagctaatacttcttagtctattctgaagcttgggcttagaatttgcattattcctaaagctatcaaagaaaatataggaatatgatttctggcctaacagccagggaaaagccctcactttcctataagaatattactttagaagcagaatattatatgctctatatctcactgtccaaattctgtttatcttcttttcatgttttaggttttcatttcctcaggaaagcccttctcatctagtactaacaaaagtcattacgtgctcagccttgagactttgagccttcctcttgagcagctgtttgtaaaagaaattatgaagagagagaaaggatgaaaatgctattggcacagatataaaatgagataaattcaataacaaagccatttagaaagatttttagacaatgtgaggactgaaaatattcacaacaatattaatacaatataattgtcctttctgttttacgttatcataaaaaatcagttcctgccctgtgtttatagcaacagagtatttgagagcacctgggctgcagagattactgctctatcccatgaaacaaaacattaagagtataaaagtctgacttaaatagtcaaactgattgccccagacaataaggttcaaatttgcatttctgttttctgaaagtttaaacaggtatttctttgttagcttggagagcttagtaatttcccttttttccagtcacatctaggttaaataatgtgatgaatctgctagtcttcttagtttgaatcaatgagttttactgtcacattagaaatcaaatggagaaaaagcaacaccaaaactcttcagctcctcatctatggagttaaaaccttacttcctgccattccactatcctttgaggccttgaaagaaagagtccagtctgagcttacacttcccattcttacactttagataaatgtacacatacaaaatgaatgggaggaaaaaagacaaaaagatcttggatatacataatgaagactagggaggtgttttaaagccacacttacaaacacagagttctaatgcagaatattaaagtgaaagtcaattgttgaccaacatgaagagcttacctttgaagaatcaactctgcttgttgttcagaaatagtcagacccagtgtctggagagactggacaatttctgaagcctcaatttttcctttaaaaaaataaaaagggcaaaaaataaaactcagaactggtaagaaccacagaaattatgaatttcaaatctctcatttaagagaaagctttaaactgattaaggcaaaattgtgcatgtaggtgagttatagacttgcttaaatgcctatcccaacatcaatactaaaaatgtaacaaatacattaaaaaataaatacacattttttaaaattcagtaattgtaacagccttatagataaataatattcctccaaagagactgacttcacaagtggccttaccaagtaatgtaattaagaagtagcagaactaaaatccaaatcaagatattctaactccaagataaattcaattaaagtaggatctattcattttaaaagtacctatttctacatttttaataaattactagacatttactatgcaaaacatcatatatgactgagttaaagagaagtagtaaatgaggaaatagagctaaagcacagactattcttttaaaaatctggcagtaaaaggccaggcacagtgactcacacctgcaatcccagcacttttggaggctgaggcgggtggttcacctgaggtcagcagttagagagcagtgtggccaacatggtgaaaccccgtctctactaaaaatagaaaaatcagccaggcatggtggcaggtgcccataatcccagctacttgggaggctaaaagaggaaaattgcttgaagctgggaggcggaggttgcagtgagctgagatcgcgccactgcaccccagcctgggtgacagagtgagactccatctcaaaaataaataaataaaaataaaaatctggcagtaaaaataagggagcaaggataaaagaacaacaaaagacagaaaatttttaatactagggaaattagagcgtgtttgtggacagaaggagaacaatcagaagacaggaagagaaaatagaaaataaaatagaagcaataaatgtaagcactgctgtatttccttctagcagctcacaggctcatgagaatcctaagactactgtacatgaaaaagaatgaaacaaaacaaagtaagagagggtctggtgctgaagcagcataaacagctgacttctccagaaaaagaggaagaccaaaattactgttagtggtgaaaggatagactttcttggagaaaggaccctggagagatgacaggattctgagagaatcctcctggggagagggaaggagcagcatgagaatctggaccatgtaaggacagtgagaggcagcatctgttagtaaagaaattatgcaaatacccttctgaatattctcctttagaaatgcactcttaaagagatatggttaattctcattattcacagcaatcatcttccataaagttctatattcattgcaaacactgaattagcaaataccaaaccattgttcctacaggaaaaacagggttaggttcctgtgagcctctgattacaacactttcatcaactgattaatacataaccatgtcttatgtctgtttctgtttgaacgcacctcatttaatgtgtgctgttgattcactaacattgaatttggggcaaagcttatcaaacgcatatattttctccataaggcatgctatggctttcttgcacttaggaacactagacagcacttcagcactacctttggggaacattttaaaaaggaaattaccaacaaaaatacaaaaatgcaaaaactggcacaaaacagaccttgaaagggatacttgctagttaatagtatgagagctgaaacaagaaggcagagtattgccttattctactagctaggaatgtacatgctgagcaactcaagtttttcactgctctgtgcatgtccatgaatgcctgggaaagtactgtgagtatatattttggggttactttggggataaattttattgagtaggcaaatttgcaaatacagaatccccaaataatgaggatcaactgtatatgttttgcattaaggaagtctaaaaaataaaaatatgaaccaataatgccacattgttttaaaatacacaaacatgggaaattagggaaacattgtgtagatttcctacaaatataccatcaaaatttcatctttaattattgcctctggttcatttagaattttataaaatgaacaattgatatgtacactacttatgcactgggataattgacctctgattatctggcaattgatcttaaggtagctccatctctcagctactgcctgccatagcagcacacagacaatctgacctgcaagacaatctgaactgcagagggtcgatgttggaatgaaagtttgcagagaagaaagaaaactgagttttgctagaagactggactaaggctagacttaggggcatatattgtaaggcttatgggcaacaaatgttccaatagtactactttccaacccaaactcagctcttcctggctgagagtcacagatgtgaataatcttcaaaatcatctagagtttagtttgtttgtttgaaggaacttgctttgaattaaactttaatattcattgtaaatcaggggatggcaaactataaccctcaagccaaataaggtgtattaactatctttgtaaataaagttttattggaaatcagtcatccccattcatttacatattatccatggctgcttttgaggtacagcagcagagacaagtagctacaactgagaccacatgacccacaaagctaaaatatttattatctggacttctggacaaaaaagtttgctgatctcagacatgaaccacatttcctctcaatctatttgtttaacctgtttctttaataacaagtctgtaaatgaaatgaccttgactattcacaagtagggagggatttggtgctgcattataatttttataaattctctcttcctgttaaaggttacctctagtgatgagggcttcaagaccctatttccaattagaattagataaggtcttcagagtagggcccccatgatgggactagtggctttttaagaagaggaagagagatctgaggtagtgcatttgctctgtgatgcctgctagcatgttatgacatagtaagaggccctcaccagattcggctcaactttgaacttcccagcctccagaactataagaaataaatttcatttcttcataaattacccagtctgtggtactccattacagcaacagaaaacagattaagacaaactccaacctattaatcgaaatatagaagtcataatcttaaccagaaggtacacacttaaacgtttatatgctatttttccctaatttccaggatcagagatatcttctctaaattaattcttccaaaaaaactaacagatgcaagataatctgaaagttttttaaattttagatgacacaactgtcattcttctatacaaataaaaagaaatctcattttacccagaggacaagaaaatataattattatttttaacctacaggtttaactcaaatcagcataatgttccatagttaacatttacaacaggccctgcccacagtttttaattcagaaatgtaattcattacatttcaaagtaatgaaaaagaaaagctatctataagttttcttcactaaataatataaactctacataaaaatcacattactaaaaaaaagtattaacacaaataataattatcatctaaaaccagagagattaaataagcatccttttagactcttgaaagcatgataaatgcttcttcatagctggtgataaatacaaaagaaagacacaccatcattatttttgtctaaactcttaaatgccaatttcattttcttctcatggtctttaaggtacttcataaattcttcaaaatccagcttcccatctttgttgacatctccagtagtaaaaattttctataaaaaaaaattagagagaagttattgccaatatgggctgatgcactaaattatttctacacatatttcaagcagattagctgttttcctaaaagactatagtacctatttttggccagatgtatcatcattcattatcgcaaagatctataataaaagtaattccactactgcaaaaagattctgagtcttgtgttaaattttcaatcagaaaaatgatgcattgatttttataaaacatgacatttttaaagctaatctaaccataccctaaatttcttgacatgtactttataaaccccaagatagaagacaaccacttgacctaccacaggatttaaaatattgcagcactttgggaggctgatgggggaggatcacttgaggtcaggattcaagaccagactggacaacatagtgagacctcatctccataaaaaatttttaaaattagccagatgtgttggtgcatgcctgtaaatactagctacttggaggctgaggtaggaggatcacttgagcccaggaatttgaggttacagtgagcaatattgcaccactgcattctaacctggtgacagagcaagaccctgtctctaaaaaagaaagaaagaagaaagcctaaactagtgttttcccctttgatttcaaaaattaaataatcttttactaaggatgatccatataaaaagctgtcatagcaaactgtaagccctctcctaccaccacccaaaatataacctatctacctattatgacactcatagtcacccactcaaagcttacaaattctactgttctcatggtcatgctcttctgggtaaataatgccaagttgggccgggcacagtggctcattcctataatcccagcactttgggaggctgaggtgggcggatcacctgaggtcgggagttcaagaccaacctgaccaacatggagaacccccatctctactaaaaatacaaaattagttgggcatggtggcgcatgcctgtaatcccagctacttgggaggctgaggcaaaagaatcgcttgaacctgggaggtggaggttgctgtgagccgagatcgcaccattgcacaccagcctaggcaataagagtgaaactctatctcaaaaaaaaaaaaaaattaaaaaaataatgccacattgtgactggatggtttcatggtcatggtcagatctccaacctccagactgagagacagatctgaaacttgtgagctgcaactaaagctacacttagagaaagatttctggtttaaaatgcataattagaaaagaagaaagactggaaatcggtgacccatcattgaggcttatctcaatctcaagaaattattttaaaattaagcaaaaaagaagttgaaggaaataaagagcaaaaagtaatgagaaagaaaacacaccattgggaggattaacaaagccaaaagatggttctttgaaaagactaataaaattgataaactcctaaaactggcaaataaccaatgtcagaaagtaaagatggaaactactagacactatagacattaatgatattatgaaaagctttatatcaaaaatatgaaagtgagataacaaacgcctacaaaaacaacttattaaaaactgacataagacagcagaaagtctgatagccctatactcagattttaaagaaatttaaagtgtaatttgaaaacatttccatgaagaaaaatcgaggaccccatggttttaacaataatgtctaccaaactttaagaaaaaaacaccaattttccagagaacagaaagggtgggaacattttccaacccattttatgaggcgggtatacacttgattctaaaacctaacagggacatcacaaaaaaaggaaaattacaagcaatgtcaactagtgaaaaagatgcaaaactcctgtataaaatattagcaaatcaaatctcataatacacgaaatggataagacattatagatatatatatatatatattcatgcactgtatacatttcagtcaatgatagaccatatatatgacagtgatttagtaaggttatagtactatattttcaccatggaatactacacagccataaagaagaataaaatcacgtcctctgcagcaacatggatgcagctgaaggccattatcctaagcgaatcaacgcagaaatagaaaaccaaacaccacaagttctcacatacacatgggagcaaaacatggggtgcacacggatataaagatgggaaaagcagaaactggggactacaagaacggggagggaatggacaagggttgaaaaattatcgattgggtactatgctcactacctgggtgacagggttcaattgtaccccaaacctcagcatcatgcaatatacccttgtaacaaatgtgcacacaccctccaaatctcaactaaaagttgaaaaaaattaccatatttttactgtatcttttctatgtttagatacacaaatacttagtgtgttataactgcctacggtattcagtaaagtaacctgttataatccaagagaaaaatgtcacagcattctgtggcgccatttacgtactgaagtttcatctaagaggtttatattttggccaatggaaatatcagcgaacaagaatagtcaccgaccaaaaggggcttgctgcccgatgaactagaagtcaatactataataccaggtgttgagaaaagaaaagctttttattgcaaggtgacccacaagaagacaggagtccagctcaaatctgtctccctatgctggctttaaggtagttattagaaaaggtttgggggcggattctgggattagtgggtgattggtggaaggaaatggggaggtctcccaagtccttaggcatgcatagttacctcttcatgctacctcacagatcatgtgtgaaaatccggggggagttagtataaaatatgtggtggaaatttgggctgtaacatcaccaagttagttctgtgcagacttgagttggccatattcattccaaccagttttagccagttttgtgttatcttacaagtggagagattttcagtgtttcagcaagttgcttcttttttaatctgtcatcctgaaaacaagattttctcttagtcatttgttcctttcactctttggggccacagttttcactaacattttggaagtaacaagttaaaggacatccctgaccctatttttgaacagttttttttaacccatatttctgcagcatttctgatggcaaatcaagagttatgattgcctaatgagtctgacttaacaatacaatagtcctcccttatccacagtttcactctctacagtttcagttacctgcggtcaatcatggtctgaactattaaatggaaaactccagaaacaaacaactcataagttttaaattgcacaccattctgagtagcatgataaaatctctcaacattctgtgccatcctgcccaggaggtgaatgtccttttgtccagcatatccacactatagatgctacttgcctgttagtcacttagtagctgaaccagttatcagatcaaaaatatatagtctatggctgggcgcatggtggctcacgcctgtaatcccagcagtttgggaggccaaggtgggcggatcacttgaggtcagaagtacaagaccagtctggccaacttggtgaaatcccgtttctactaaaatttaaaacaattagccaggagtggtggcacacgcctgtagtcccagctactccggaggttgaggcacaagaattgcttgaacccggtagacagaggttgcagtgaaccaagactgcacccctgcactcagcctgggtgacagagtgagactccatctcaaaaaaaaaaaaaagagctaaagctaattaaagataaagtaaaaaaaaattaaaaaatatatatatatatgtatatatagagagagtatatatagggttcaatattacccacagtttcaggtattcagtgggggtcttggaaaatatgccctgcagataaaaggggactactataatatgaaagattaggaatggattcccctttaaattttcttgtatgttccttctagaaataaaagaccaatcaaatgagaaaagtaaaatctacttggcccgagtttgctatagcaagggagtcagacaccctcacttgtgtattgacagagactcaaagccaggcagaggagtgggaaagctttacagtgagaaaaagggaaggcttcaggcgtttcctgattgggggctgctggcctggggaagctgtaggagggttcattagaaacgcggcaccctatttgattagtaggtggtgcatatttagctttctctggttcgtcctaagttggaagtgaagaaaaaaattaggggggctgtcggttattaatcaaattctgaccatttggggctgttacagcagttattgcatagctttgtgtattgtctctagagatagcaacctgacttcctataagtctgacataacaggctggtttcctggtctgtttattttagataaagggctggttttctgggcagactgctgtaaattttgagtcaaagttctatttttatttatggtctgaccattatctcttcgtatatttagtttctcaactttcacaggaaaaaacaaaacaatatattgttcaaaaacagactattttcacaataaaaagttattgcttttgtatcttaacacgacaatgtaagtatcatttcttttttttttttttaatcagttgagttttgtctatataaacaaattttcctactggggaggtggagacgtgtgggaagagacctcacatcaaaacctcctaacgatgtgactgccacttgaggaaaagtcacaatggtgctcctctgaaacagaatgttctgtgtggttggtgcagaattctctggggacacccctcccttgggttttgacatgtgaaccctcctcagtcaccactaggtacacaaagcgtccttgccaaaaatgcaagacagctctacaaaccttttgtttcaataaggaagaaatgtgtttcaaaagattcgacttgatagctaacccagaatttcttatgaaaggctagtttgtatcaaataaacaaatacaacttacacttgcaaatctaaatataagagtgtctttaaacaaatatgaagaacacttaactttttttttttctttttgagatggagtctcactctgtcacccaggttggagtgcagtgatgcaatctcagcttgctgcaacctctgcctcccaggctcaagtgattctcctgcctcagcctcctgggactacacacacccaccaccacacccggttaatttttgcatttttagtagagatggggttttaccatattggccaggctggtcttgaactcctgaccccaagtgatccacctgccttggcctcccaaagtgctggaattacaggcatgagccactgcacctgaacaagaacacttaactttaaaaggagaaacactgcttttttctaggaattaaaaatccagataagctttgcagaaataacattttggactgaattggtccacagaaagtacacagtccaggcctctgatataacagatgaggataccagggtatggggcttggaatatagaatgtgctcaaactagaactgacccatgactgaatggatgcttcaatattcccaaagttcacatggctaatagaaagagttttactaaatttcaacatgacagaactcaactgacagttttttgggcacgaagtaccaattatccaaaataaactcaatagtccacatgctcatgatctcccagtctaccgggtcaaacatccaaagagcaaatatacttataaagtaattattatatacaataataaattccaaatgaaaaatgacttggaaatactgcaataggagtatgtacgaagcacaacatgctgagaaggagcctgtaggttagccttctggggaagagaagggttagcctaagctcggtactgataactagggtctatcaattaaggcatattatgaggaaacctcagcactagtgaaacccgagagtaaaagccacttccactgcccccttccaggaacagaaaccgaaacataacatcagaaaatttccaatcaccaccccactcccaaatacacgtagagtgattattccagttctctgaactggggagggcgcatctttagcctagacgcccctctgggtgactaatgacaggtgagcacattgaacaaggtgactcctaagacaaggctgtatgtagccaacatcttgagagcaatctgaagttggagattttactacagccaaggagaaaacggagaaaaatacttgagaaatgtgttagctgtgttgttattcttaataaacggtaacgctggtcaacgacctgaacactgcagtgggcccaggtcaagcttgacaacatgtaaattttgccctctctgcccaatgcctctccagggctcccagccccaacgtctctctgattacagccccagtgagacccaccttcgcttcctctagagattgaatggcccctacatcctccaggccttcctgaagctcaaaaatgtccaaggtcccatccttgttatagtccaggtaccaaaagagatctccgtagagggagtccatcgaggatgtctccctcgcagctccgcggcctgagtgagccccagcggggtggaagtgcgaccgacgaacgggatctctgcccaccacacacgtccagtgggaagaggcctaagacagcatcctcctcaggggcgccaaacacaatgcaccttcatcggttaaagctctggaaggagagggctcatcctaacggcttcagcgcaaaggcgcgagcgcgcaggacccgggacctgcgtgggaccgcactctgggctgcgctgggagaccgcggagttcctgcctcactcacgtctgatcagaagccccggctcccactccaggaagagtccagtcggggcaactcaagcccctttccccagaaacttccagggagaacccagcacagggccatctgaaagtatagcttctcttttggagagaagtaggttgggaatgttgggacatgggctattgcagcataagtgactggcggtggcggcctgccaacatttaaaaaaaattgtttggctgcacctgtctaggaatccttctttttaaaaatccttataatgattttttaaaataaaataattttattgtagattcaggggttacaccatcagcttgttacaagggtatactgtgtgatactggggtttgagctcctaatcgtgccatcacccaggttgtgaacaaagtacccagtaggaagctttccagcccttgccctcctccctccctccccccttttggagtccctagtgtctattgttcccatctttatgccccatttacccaaggtttagctccccctgtaaatgagaacacagtatttgtttttctgtttctacaataattcgtttaagttattggcttccagctgcattcatattgctgcaaaggacatgattttgctccttttttatggctgcatagtattccatggtgtgtatgtaccacattttctttatccaatctgctgctgatgggtacctacattgtgttgtaggaatccttttctaaggttgcagcactggagaattgctgtaataaagactaggaattgaatgaaaatctgcccacatgggccctttcttctgtgacacctcccctcacagttttttatcttttatcttcatccaaccactacaatggctccagggcaagcctatccttcagctgttagtggctggattggaaagatgatctcaaaataggcaaaagttcagtgatcttgggtcccagagagaagtcagcagatactcataaatactatctaaggcttcctcttaatcctcaccctccagaaccacagagggccctggcttccccagaccaacacctgtgctccctcatcctgcaccactgggaatatggaggtgcagtttcacaataaaaactctccactttttatgtaatttattttcctaaatatggagattgggtaccctaaaaagttgaatattaaaattcaaaaagaaaatttaatttagccattatctgtaagctcttgctctacactacccatcatgtcagatactggggacaaaaacagaccatcacatgtccttgaaatactcataggtttccctctgggaggaggttgcaccatggttagtcaaaaaaactactgtacgcttctcagtaaacattttcccccagagctgctgagcagtggcaaatgtctaatgctgtttcacaagatgtgctgtggcccaatcaagaatgaattctttcaaaaagagaattttatggtccacagggaatggtccttccctgtgcaacacagaaaatgtaggtagtggcaaagagccacagaaggcagatagccaggcagagaatgagccttgggttagagtctacaggaccaagcagaaaagacagaagtcgtggccagggtgataaggaaaacaggctgacagcatttaacagaattgacaggagagaacaaaccatagagttgagagtttcatctaataaaaggcaggtagttttgttgaatagctctttctgctttttgaaattaccctgttcattatttgcttattattttttattccccatgcacctacacacacacacagacctacttactatagggagggttttgagaatacaatgaagaacgctgtcagtgttgttcaccactatatccccagttcattaaacaatgtctggcactgtttgaaaacattaaatgaatgaatttactatttatgctaagttactgggtaggtcttaccattcctagttaacatttgaggcctccaggcattaaataacatgcccaaggccacagtctagcaagcggtgaaaacatttgaaccctgttctgattccacagcctataataataactattacatccactaaaacagttaatgtgtagtaaacactatgatccacgtttcagagttaggcttcaaactttctcaacaaatccttttgttttcataaatcctgtcaaatatagataccttggtggactccattcaatccttaaaaagataagatttttgaactcagcagggtcaaaagaagttaagcagtgtattacagaatgttgtcttgtggaagcttcttttgttttttctggaataccgataaagaaagtgggctaggaagattataaaggtgagttggggccttaaacaatgggcaatcatataccaggcagagaagggggaatgagagaaatctcaggcagagagaagaaaataaagggatcaatgtacatggctgtggcctagtcagggaatatggcatgttgggagtttggaaaggtgacaaaaggcttagaatgctacaaagatagaaagggtattttataccttactaaagaattcttccatttttttcattctttcagacactttatttctgcagagaaggataacatcaaatttagaatataaatcaggagagaacacaaaagatacagattttatatattttagaacatttgacagaaatgtagttggaattccattgtttttcttataccataatctttctgttgtgatgccctaaaattcaccctgtgatttcatatcatgtcttcttaatattgtgccagaaaccataacatgtctgacaattaaaatattaaggaaatgggctggccatggtagctcatgcctgtaatcttagcactttcagaggcagaggcaggcagatcactagaggccaggaattcaagaccagcctgaccaaaatggcaaaatcccatctctactagaaaatacaaaagttaaccaggtgtggtggcatgtgcctgtaatctcagctgcttgggaggctgaggcacaagaatcgcttgaatccaggaagcagaggctgcagtgagccgagatcgcaccactgcactccagccttggtgatagagcaagattctgtctccagaaaaaaaaaaaaaaagcaatattaatgaaataaaaatgaaatgaaccctctttgttaacagaggaattacttaatggagtgaaatcctgattccactcaatgcaataaacatttgctaagctactattcttctatgtgactattttttctgtgattgtaaatgtaaaaacttaaagacagaattaaaaaaatcatagaatgtaagagttagaatggcccttaaatcaggttaccagtccacccactcctctaacattgggtgatcattcagcatacacttcatacccatgggcacagaggttcctcaagaagttcaccagctagtaaatgggataccacattttaaagggttttttaacatgaactttcatattctgcaacatatgaccttgttaaaagctctgtccaggatgcaggcaagatatctgcattttaagaataagaaagtaaagctccagtaaggctcaaacttgacaaggattacacggtcaatttacaccaaggacggaactctcttgtagcttgctgcttcccttcttgctcttgataattgtcctagtccaactgggctgctatgacaaaaatactattggcttacttaaaaaataagcattgatttcttgcagttccagacactggaagtcctagatcgaagtgctaggagatttactgtctagtgaggacccactttccggttccatggaccactgttttctcactgtgtcctcacatggtggaaggggcaaggaaggtcttccaggtcacttttatacaagcactaatcccattcatgaaggctccacaggaagaaagaagatgggggtagaaggaggaagacaagagggagaaggaggtgcgtaaagagaaaataactgaagacttttaaaaggaaataggattactagacaagtataagagaattagtaatggttaaatactgtatctccttgttctcacactacattctactctcagtctatacccttatactactgagtcctaggagaacttaatgtgaattttctctaatttttaactttaatttttcactaatttcatagtgaggagatttggaacatacagaaaagaaaggtcataccagaaaaaaaaatgtagcgctttcacttccaattggttcttaattttgtctcaggacttgccttgaattcttttctcttccctggataattctggaacacttagtaatggttagctattatattccttatacctatttctacattctactcttatttctacattctttccatctaaaatctaaagaaacttaaacagaaatttgttctcttctaaatgctcaattcattacaaatgcttggaaacacggagatgagatcaaatcagatgaaaatttatagagattttgcttcaagctgagtatttggcttagatacaaactactaccttgaaactttccaccgaagagtcaccccacagttctcatttctatgctcaagtagccaatgtcctcactccttgacattacataaacccctgacatgcctctgaaattttctcccataaaggttgactgtgtaatcctaattctatcccatgtgtgatggttaattttatgtatcaactcgtctggactaagggatgcccagataactggtaaaacatgatttctgggtgtgtctgtgaggatgtctctggaggagggtagcatttgaatcagtaaaccaattaaagaagactgccctcaccaaatgggtaggcataatgcaatcctgtggaggatgtgaatagaaccaaaaggcaaagcaagtgctacgttttgtttgtccccacaaaaactcatgttgaagtctgatccctgatgtggccgtgttgggaggagggacctagcaggaggtgtcagggttacggaggcagatccctcatgaatggcttggtgtcattcttgcagtagtgagtgagttctctctctcatgagactgaattagttccctcagtaatggatcagttccctcgaggctgggttgctataaagccaggacacccctcggattttgcttcttcacacatgtccacttccactttgactttccaccatgttgtgacacagcaggaaagccctccccaggagtccagcagatgccagcaccacgcttcttaaacttcccagcctgcggaactgtgagctaaataaatgtcttttctttataaattaccctgtctcagatattccactatagcaacactaaatggactaagacaggaaatgaaaaggaatttcacctgcagaataggagactttacaaagactgataccctgaatgagcgaggatgtggagaagcaagcactgtcagtcaaaagagtgaaaatgggtctaaggtttccgaaaggcaatacgtatcccagtttaaaatgtgtgttaccttcagactcagcaatgtccactcctcaaaatttatcttacgaaagtaactggaccagaatgagaaaatgaatacaaaggacatccattgcaatttcacttacaatcgtttttaaactatcaataaagtaaaaggtgatttaaaaagaattggtaacatatactatgacacaaacatataacagaatatgatgcagttacgtaaaaatggtgatacagcagcaattctcaagctttttgatctcaggatccctttacaatcttaaaaatcattgagcactccaaagagcttttgtatattgtagggaccatggagttgtaccactgagatctcccttcaaaggcacctactgtgaggaacacagttgacttccactctctagcctctaaccctggcatctgctgatgcactgcagcaaggtcgtccctttcctgggctgcttccagccaatgattggacatggtggggaactccaactgggccatttctgggacaatcagcacaaagtaccaaaagttggttccttcaaagtatgaataaaatacacaaaactttggcaagattgaaggggagaaaaggatagatatgaggaatgaaatagagaacctacctacagattcagtcagaagtgttataaaatcatcggtgagtattatgaaccttggacagaacaggcagtttcaaaaaaaattgtaacttactaaatctgactctagaagaaacagtaaactgaagaggcctataactaccaaagacattaaaagagaagtgaaatataactatataacagttgttggccctcatagtaacctaatcactttccctctttggataagagaatgccagtgtcagggaacgcttcaacagggttggagaagttccacatatctccaccctactaaaggggcagaagttcaggggcacagttaagatgactcagagaaaatgaaattgctcagtcgcaggtcaagtcaacccttcagatcaatttatgtacctagggcattaacctaggaatgtcttaaacaatggaatgccgccattccttctcaacaggaagtgggggaaacacgcgattggttttcaaacagttttcaaacagtagacaatacacatagctgctgtaacaaagcagcttcgaaagagatcgaatgtgtgcgcctttatacaaaacttgggacccactgaagtctgacagctaaaacggattacatgtctgcaaggtattaaaacagaaaacaaagaacctgggatggattcaggacaaaagtgtcttaaaaatttaacagtgcccgtgggccagagtgtccacaacactcattttatctggacaaataccagtagactttcgtattatgacccacttctgttaccggggtcgccggtcgcggccccacgcccgagtttctgaagccaccggagcgctgggcgccacagttcctccttcctctcctggcaacgcctcaagccgccgccctcctcggtcctcgcagtgtccccagcgcccgcagccctccctacgctcaggcggcgccccggcggcgacccacctcctcggcgtcctggcccagagggatgcccaggttcctgagcccctcctgcagctcgccgatgtccaccactccgtccccattgcggtccagtgcctggaagagggtctcgtagcgcgtcggctgctccgcgtcctggcaggccgcggtgggcagcacgaagtcccgcagccagcgcaacatggtcccagaggcgcaggcggcctggccgaggaagtcacgggagatcgagggctgcggggcgagaccgggaccagcgcgaggccgggctgggcggggcgcgcggcgcaacagcgtttggggcgccgtcggggttgcggctgcggcgcgcagggcgcagggcgcaggagcggagaccccacccgagcccgcgcggagcgcagggtgtggccgtcccgccgct

SEQ ID NO: 2144 - DNA, 58089 bp, Homo sapiens
gtaggatacaatttttgctttatttataatttttttttttcaattaggaaactgagacttaagaattttctctaaaaaaaataaaaactggaaaacaagtaattttagaaacaaatatatatttttgatagaaactgtaagtaaatattcagtactaccagaaatatactatcttcaactctcggcttttttccaaaagatacagaatcattttttggaaaagatacaagatgtacagacaaatcacattcataccttacaatttaaattcataatgaacaatgaatattttcatattttccagaagtttgaaatttcaaagttgttagcaaaattattcatttccataatttttacgagtaaaaatagaaagagctgatcatgtaccttaatattgtcactttatatattactcaaaagtacaaataaccctaaaagtagaatcccaggcttatcatattataaaaatactgagacatttatcaaacataactaatataaatgaaactacatttttaaaaatgtttcacaaacaccagtccatctttctctttggttcagaaaataaaagaggtaggttcaaataaagaaaatgcctattacatcattagattttcattaaaatgctggaaatttataacagaaattattagaagtgaaatgagtttaagaactaaattaaaaactgataataacttcaactagtaaatatttttctaagttctaatcacacaaataagaaaagatagttgactataaaaatggctttagtaaaataaaaaaatgctctcattattataaattaagtctcctatatcctaacatgttcctaaaacttggggcaagagagaatatgaatgtatatgtttacaaattgggcctttcatttaaatataggtatctaatgtataagagtaatacatactactattaatatgtatctctcacctttgtgctgcccatattgaaaacagcaagttcaaagatattcaacagtgagggagaaataagcacatcatttgctcatgatcaatccacttcatgcaattaaaaaagaaatttcaggttactaagaatggtcccaagaagtcttcctgactaaaacggaatctgattcaaaaggtaggaaacaaaggacaaaggaaaacaaagatgctctgcagaagctgatacaagtcaaaggatttcgtttcctgctgcttttcaaagcaatggcaggataaacggaatctttcaaataaattgccttgtgttggtaatttaacagtaatatactgaaaattagtgtataactccaggaaccaaataatggtacagtggtaaaatggaaaagtgcccactgaaataaatataatttcatcacttcccttcagaaattccaccactgtgttcattcgtattcagctgaaagaaaaataaggacataaaccctatacttatttggatgcttttgctgtaaggtatattttaaatgtaatgattttctattaatggttctataaggaaatttaaagaaatctataaagacattcaaaatatataaaacaagaaatttaaatataaaggaactggcataaacgtaaaccacccgaaataaagattaatgatttataactctaacacacaaaacaaattttgttcaagccagtacattttcagatttcggattcagggcagagatttgcaggattattaagaaaagataaagtataattgtgtggccttttcaaaacacattaaaactatgattttgaacatttctgtgtacatataatttagcccaaaagtttgaagtgaccattgttaccatcttcccttttgtgaaaaaaatgcagcttcttttgccatagacttgtttcaattcgaggagaaaaagtcactccagagattgttgaaagtttcaattatcaggctaaagcaaaaaatgcaacatcatttctgggttactcctaaagtttgcttcatattttcataaaccacataactgatgcctacagcagggagcaccttcatgaagtttggggtgatgcctctgtaaagtcctggtattccttctttggaaataattcgtcgaaagaggccaaccatattcagctgtggggaaccttctaacatggctaaaaaataaaaaaagagggtaatttaatattcaagtatgtttcattattatgacaacaaacaattatgacccagaatgatattctaaaatacagtaaaaggacaacatttattccaagaagcccaagacaacatcccttttatgatcctctttgtatagcacctaacagtgagtgtcctaactatagtaatgatggtaataatagttatttattaattactatgttctaaatactgggttaattaccttccataccaatcttgcaaggtaaatgttatatcaattttgtaagtgagcaattggaggcttagaaagatggagaaatttgtcctaaaaaaatctaagtagaaaatggtagggctgagatccaatggtctgactctaaagctggtacactttccaccaccccacagtgctgctgctgcctccttcttactagacaagcgctgaagagagaacagttaaatctcaggaagtaaggggagtatggaagaagctctgggaagcttgggaaaaagcacaaagacctgggccttggaaatgacctcaacaagcaggaagagaaagcgaaaaccagtgttgctggcacaaccaagacaacgggaggagtaccatgtgctatggagatgcagccaattgttgtatgtggttattacacagagagtgaacaaagtggggctagattattaaaggctttgaaattcccactaacaactttggaactgacaccgaaaggctgcaaagatgtctgaacagatgtaaaatgatcagacttttaggtcagaaatgacagtctatcagccatagacaatctatcagccgtatcagtcatgcaaagttctggatcagagctggcagacaggagggttagaatcagactgcatgtgtctgaatttcagtcccactatttaccacaggtataatcttgtgggagttacttaaattctctctgccccagttgctcatctgaaaaatggggataatgttagtattcccatccccaagatggttatgatggtgaaatgagagaatacacaagaaacgtgtagttcactactttgtgtttttctctacagccatgactgtctctcagctccttaaatacaccatgttggtgcctgcctcagtgtcttcacacatgctttccctcaactggaatgttttctgttcccactccactggcctgtgcccagctaactcccactcatctttccagtctcagcttcactgacagcattctgcagcgcccaagttaggttatagctccttgctctgtgctcccctaacaaaagaggagttggtttaaccaggttgtttacttgctggacataacgtcttctctactctacactggcggggccacacctgacttgttgactgctctacccctagcatctggcagtgtctagaatgggacaatggctcagggagtatttgccaattagttactgactgcttggctggggttgctgtggctggcacttggaagggaggttgggaatagagctgtagatgcccaaggtgtactacttaagaaaacaatggataagactgaccagggaaagcatcaaagagaaaagaaaggcatttgaatgcatactttaatagagtggggatagcaataaaagccagcaaatggtaaaagttatcaatgggctggcagaacaaccaggatggtacagtgtaatcaaagccaacaatggagactgtcacagtgaggaggaatcacagctcaaaacttgtagggtctacgcaacactaaaaaatgattccaaccaccatttaccaaaaatttaacaaacccaagatgctttatttatattgttggtaattcttacaacactgtacaattttcattcccattaaaaaccccaagaagtctgaggcaaggatctgaacccaaatccatcagatactaaagcttataatcttaaaacgtgcatgtaacacagtcaaaaaaaatagtactctgtttatctataaggcatatgtatgcatacagtacatatgcaatgcttctgtcgcattaaaatttcatgacgagggagcatttagaaaaagaatttctgaaaagattccttaaggaggcaataatgaaaaaaaggttgagaaatactgtcttaaaactacagtctgcatcttagtagaacttggagttctaaaagcacattactggtgcagcacttttatcggtgtggttctgtaatcaaaaattcaccttgagcctgcatgcgagttctcaccaaagccaatgggtagctggccagctgaccacaggtgctggataaggcaccgcatcccagcaacaccatgactccagggtttacagaatcttttgcaaaattatccagccaataggacttcaagagctgccagagaaataaagaagaaaataattaacgaactctacaacttcaacgtaaacattttcacagctattctcaacctcatgagaagccccgtttctgcaggatgaggccacgcatttgcagaagcagcaggcactgcaggaggcggtgactctgtggagaggtgggaggccactgggggtgcggaacacatgaggtttgcaccggttactgacattcttctaaacaaacgtgaactgcgcagcaaacgctgcaggatctaaagaacacctcttatggtgagtattaataaaataatataattctactaattgtatctcattttacacgttacatatatttcatttgagccttacagaaactcttacataaatctattattctgattttagaaatgagaaaaattcatctcagcggagtttttgtttgtttttttgagatggagtctcgctcttgtcacccaggctgtagtgcagtggcccaatctctgcctcccaggttcaaacgattcttctgcctcagcctcctgagtagcttggattacaggcacccaccaccacgcccagctaatctttgtactgttagtagagacagggtttcaccatgctggcaaggctgatctcaaactcctgacctcaggtgatccgcccgcctcggcctcccaaagtgctgagattataggcatgagccaccacaccaggcccagagtttttttaagaaggactcagaaccaggcgtgctgatcaaaaggccatactttatccctgttactctaggtccctgtatttcattagaaggcaataattaggagaaactgtataaaatatatatgataatcaactttttaaacataagatactttaagtataaaatacatgttaatatgttatataacaagtttaactttttaattttttaatcctgtaagactaaaaattttaaatcctacaggattaaaaaattatctcaatggattaaaaaatccattgagtgcatttctcaatggaaatcttgcaggttagaaggaaatggaatgttatattctatgttttgaaacttaaaaaaactgccaaacaaaaatactgtatgggcaaaactgcccttcaaaaaaggagaaattaagactgtccctgacaaacaaaagctgatacagcttatcaccactagaccggccctacaagaaaggctaaaaggagaaacaaaaggatgataaatagcaacacaaaaccacaaaatatgaaactctatggtaaaggtcaatatttagaatattataaaatcctatagtattgtaatgaaggtatataaataacttgaaaatctaaatttcaaaaacaaaatttaaacagaatttaaagaagaaaagcataaaaagtaactataaatctatgttaaggatatacaatatcaaaagacataaagtttgtggggaggaggtgaaatatgtaaagaaatagagttttatataccactgaagttaagttgtaaacagcttaaaataagttgctataactttagtatgctttatgtagttgcaatggtaaccacaaaaatagcatctatagaatgcacacaaagggaaatgagaagggaatcagaacatatcactacaaaaaaaaaaaaaaatcaacaaaacacagaagaagccaggaagagaggaagggaaaaacagaaaagccacaggacaaagataaaaaggtagctagccaaatgacaacagtaagtccttccctatcagtaactgctttaaatgtaaatggattaaatcccctaattaaaagatataaattgctgagtgaataacacatacagaatcaactataccttatctatgagactcactttagatctaaggacacacataagctgaaagtgaaaggatggaaaaagatattccataaaaacgggaacccaaagagaaaaggggtggccataattacatcagacaaaatagactttaagacacaaactgtcacaagagacaaagatggacattacataatgataaatgggtcactttaccaggaagaaattataacttcatatggacctaatattaagctcctaaatatatgaagcaaacacttacagaactgaagggaggaataaacagcaacacagcaatagtagtagaccaccaccccacttaatggtgttggggaggacatggagaaattggaatcttggtgtacattgatagaaatgttaaaaaacaaaaaggtctagttactatggaaaatgacatggaggttcctcaaaaacttaaaaatagaattaccatttgacccagaaattccacttctgagtatatgtcaaaaagaactgaaaacagtatcttgaagagatatttgcacaaccatgttcactgcagcactattcacaatagtcaagatgtagaaacaatccaaatgtccatcaacagatgaataaagaaaatgtgatatatatacccaacaaattattattcagccttaaaaacaaaaaagtcctgttgtatgctatcatatggatgaatcatgaggaaactatgttacatgaaataagccagtcacggaaagagaaataccacatgatttcacttatacaaggtatttaatgtagtcaaactcataaaacgagaaagtaggttacacagcgctggggtgaaggggaaattgggagctgttgtttaatgactatagagtttaagttttgagaagtgaaaaagttctagagatctgttgcacaacaaaccacaaacagttaacacttactgtactatatatttaaaaatggttaaaatcataaactttatgttatgtgtttttaatcacaattttttaaaaaactcagcacaagaagtaaagtcctgaaccataccacctcacacctaagaggacggccataataaaaataagcttttttaaaatggaaattaagtgttaataaggacgtggaaaaactggaacctttgtatgttgctggtgagaatgtaagtgcagccactatggaaaacagtctgatagttcctaaaagctaaacacagaatgaccatatggctcagcaattccattctgagatatatacccaaaggaattgaaggcatagactcgaacagatacgcagatgccaatgttcactgcagcattattcacaatgttggaaaagtagaaataatccaaatgctcttcaacagatgaaggactaaacaaaatgtggtatatacacataacggaatattactcagccatgaaaagaaatgaagttctgatacatgctacaacatgaacaaaccttagagacattatgctaagagtaataaatcagacacaaaaagaaaaatactgtatgattctacttataagatatcttgaatgggtaaattcctagacatagaaagcagattagaggttaccaaaggtttgagttacggagggtaggaagttattgcttaaaggttaaggtgtttctgtttggagtgaggaaaaggatttggaaatagtgttgatggttgcacaatattgtgaatgtaattaatgccactgaattgtacacttaaaattagtaaaatggcaaattttatattttataataatttttaaaaattatgtaagaagccaaaaaccatttgcttgtacacttcaaatgagtgaaatgtaaggaatatgaactaaatctcaataaagctctttaaaaaaaaaattcgactcttcttttcattacacattccactcttcctctacgctgtagcttaggtctcatcctaacatgcaccctggctcatgtctgtcgcagcacagataaccacgctgagttttagtcgtttgtctcccccaccagaccttcagtttcttcaaggcacacattgagtcctttgaatccccagatccagtgtctaacctagtggtttgtatagtgtgtgctcaataattgtttgtgagattcataaattattaaatgatttagattgcagggttgatccaagatttgtattcttccgtacaaggaatgaaactgtattactcatgttagtcacattagtcacttggcttaatgtcagatttttgcaaatccaaaacaaaggaaaaaatctctagaaacaccttttaaggtgaacaactatacctaactttgagtctactcttcattaacaaaagcaattcccaagaaaatctaatacaaaagtgaccccatgcatattcacactcaagttacttgaaagttcaaataacacatgcttgaatttacttctggtcacacactgttttctggtatatatctacttcttcatataaagtccaattctaacaagatctaactgcattttccaattcaaaagatttctacaaactcacctcatacacagcaagatctatgcctgcataaggtatgatacctaataaattgggaacatagcctttgtaaaaagctcccaagccttcatgtttcaaaatcttcttggcacaatcatatattccagagtactgcccagttttgcctacagccagcctggttttcataacctggatataaaaaaaaacaaaatatgattgttcatattaactctatcatcatgggattcaaatgaagtaattttacatggaacaaatacctagcacatattgtcactcaaaagactgtacaatttgttgatacattctctttcatgtattacctctattggggggctaagaccaaagccagagagacccgtttactgcaaggaggatctgatgaaggaagtgaccaaggaaatggaagcaagataatctattgatgtcttaacaaaactgactggtgaccacctgcatctggaaggtgagggaaatggtagtataaaggataaccccaatacttctagcttggaacacaggatggggcagtggggagttgggaaggtgatactattaactgatatggaggatatgagaggaaaaataggtattaagtttttttgagaggtgtgtggagtaatataaacaatcatattaagatgcttaaaaaaagctgtattagcatgcataccacatatcggtgaaaattgtatttatcttgcttaagtcatcagttactaaaaacccctctgctatatcaataaattccacatctacaatattatttttgctataaagcagtagttggaaaacttttcctgtaaagactaaatagtaaaatatctgtcgttgcaagcctaaaatattaggtctcggttgtatattacttttcttttcttttgtttttgcctactttttaaaaattgtactttaagttctgggatacatgtgcagaacgtgcaggtttgttacataggtatacacgtgccatggtggtttgctgcacccatcaacctgtcacctacattaggtatttcttctaatgctattcctcccctagcccctcatccccaaaaaggccccagtgtgtgatgttcccctccctgtgtccatgtattctcattgttcaactccaacttatgagtgagaacatgtggtgtttggttttctgttcctgtgttaggttgctgagaatgatggcttccagcttcatccatgtccctacaaaggacatgaactcatccttgtttatggctgcatagtattccatggtgtatatgtgccatattttgtttatctagtctatcactgatgggcatttgggttggttccaagtctttgctattgtgaacagtgctgcaataaatatacgtgtgcatgtgtctttatagtagaaaaatctataatcctttgagtatataaccagtaatgggattgctgggtcaaacggtatttctggttctagatccttgaggaattgccacactgtcttccacaatgcttgaactaatttacactcccaccaacagtgtaaaagcattcctatttctccacatatttgccagcatctgttgtttcctgactttttaactaactggcgtgagatggtatgccattgtggttttgatttgcatttctctaacaaccagggatgatgagccttttctcacgtttgttggctgcataaatgtcttcttatgagaagtgtctgttcatatccgtcacccactttttggtgggtttttttttcttgtaaatttgcttaagttccttatagattctggatattagccctttgtcagatggatagattgcaaaatttttctcccattctgtaggttgccggttcactctgatgatagtttcttttgctgtgcagaagatctttagtttaattagatcccatttgtcaattttggcttttgttgccattgcttttgtgattcagtcatgaagtctttgtccatgcctgtgtcctgaatggtattgcctcggtttttttctagggattttatagtttaagtctatgtttaagactttaatctatcttgagttaattttttttttataaggtgtaaggaaggggtccagtttcagttttctgcatatggctagccagttttcccaacaccatacattaaataaggaatcctttccccattgcttgtttttgtcaaagatcagatggttgtagacgtgtggtgttatttctgaggcctctgttctgttccattggtctatatatctgtttggtaccagtaccatgctgttttggttactgtagccttgtagtatgtttgaagtcaggtagcgtgatgcctccagcttcgttcattttgcttaggattgtcttggctatacaggctcttttttagtttcatatgaaatttaaggtagttttttctatttctgtgaagaaattcaatgttagcttgatggggatatcattgaatctataaattactttgggcagtatggccactgattcttcctatgatatgatattgattcttcctatccatgagcatgaaatgtttttccatttgtttgtgtcctctcttatttccttgaggagtggtttgtagttctccttgaacaggtccttcacatcccttgtaagttgtattccgaggtattttattctctttgtagcaattgtggatgggagttcactcgtgatttggctctctgtttgtgtattattggttaataggaatgctagtgatttttgcacattgattttgtaccctgagactttgctttaagttgcttatcagcttaaggagatttggggctgagacaaggaggttttctaaatatacaatcatgtcaactgcaaacagagacaatttgacttcctcttttcctatctgaatacgctttatttctttctcctgcctgattgccttggccagaacttccaatactacgttgaataggagtgctgacagaggacatccttgtcttgtgccggttttcaaagggaatgcttccagcttttgcccattcagtatgatattggctgtgggtttgtcataaacagctcttattattttgttatacattccatcaataactagtttagtgagagtttttaacatgaagtggtgttgaattttatcgaaggccttttctgcatctattgagataatcatgcggtttttgtcactggttctgtttattgatgaattccgttatattgatttgcatatgttgaacagccttgcatcccagggatgaagccaacttgatcatggtggataaacttttggatgtcctgctgcattcagtttgccagtattttattgaggattttcacattgatgttcatcagggatattggcctgaaattttctattttggttgtgtctctgccaggttttagtatcagaatgatgctgccctcataaaatgagttagggaggaatctctctttttctattgtttgaataatttcagaaggaatggcatcagctcctctttgtacctctggtagaattcggctatgaatctgtctggtcctgggttttttttggttggtaggctattaattactgcctcaatttcagaacatgttattggtctatacagggattcagcttcttcctgatttagtcttgggagcgtgtatgtgtccaggaatttatccatttcttctagattttctagtttatttgcatagaggtgtttatagtattccctgatggtagtttgcatttctgtgggattggtggtgatatcccctttatcattttttattgtgtctatttgattctcctctgttttcttctttattattctggctagttgtctattttgttaaacttttcataaaaacagctcctggattcaatgatttttggaagggtttttcgtgtctctatctccttcagttctgctctgaccttagctacttcttgtcttccgctatcttttgaatttgtttgctcttgcttctctagttcttttaattgtgatcttagggtgtcgattttagatctttctcactttttcctgtgttgcccactttttaaaaatgtaaaaggcattcttaggtcaagggctgtatgaaacagtccgtaggtctgtgttttgccaacctatgcactaatgaaaggatgtctaattaggataatcaccatataatcaaatcctgagattccattattaaatttatggtacagaaactctttggacaggaatggcagccagcctctaaagtggcagccagcctctaaagtgacccccagtgatatttgtctccggttattaacaccattataccagcccctcctacactctaccagggttggtctgtgtgatcaatggaatacagcagaagaggcaaaagataccagctttcatcttaggcactctctctctctctctctgttggaccactgactctagggaagccagctactgtgttttgaggatactcaggcagcctacagaaaggctcacgtgataaggaactgatgtttccagccaatagccagtgaggcctggcagcaacatgagtgagcttggaatccgcctccagctgattccaagctctgactaccatcttgactgtgggctgtgaaaaaccctgagccagaggcacccagctaagctgcttccagattcctgacccagagaaactgtgcgatgataaatgcttgttttaaactgttaattttgggataacttgttagagagcaatagacaaccaacacgaacaccatcacacagtcagacttgacaatggtactcacctccattggatatataaaagtctgtgcagttgctccagccatggaaccagaaataaatctctcaaatgttcctattttttgtccttcttcagtaagtaacttcttgtactgtataaacaagttttaaaatgcacattactacctgctgtggactgagctgcacccccaccaaattcatatgttgaagctgtaacctcccatgtgatggtattaggagatgaggcttctggaggtaattagggttatgaggtcatgaggatggagccctcatgacaggatcagtgttcttgtaagagcagacaccagagagcccactctctctctcccccttcacatgtgcaccaagaaaagaccatgtgagcacataccagctgtctacaagctgagaagagaacgctcactagaaatcaaactggcttggcccttgatcttaggctttcccgcctctgaaactgttagaaataaatttccgttgttgattccacacacactgtggtattttatggcagcccaagccaactagacaatcctagaatacaaatcagctcctagaaatcaataaattgacaaatgtgatgatgtgtctcgaaatgtatacactacattaataatacatagcagaagagcaaggcctaaatgctaatacacgcagtgactggacagtggttttcaagtcagatttccacaaaacacagatgtctcccagattggaccaagttgctcctttgctgaaacagcataacagcatccctccccaggtgtacagaaaatacaaggttaatcaagttttcacaatgtttggatattttccccacagtttttaaaagatgagtttattttcaccagtgcaaataaaatgaataaataggtgacaaacaaatattaacaaaacaatttataaaaacagtttctgtaggtaatacatagaattatactaacctatcaagcccagcatctccctggctatcagtactaaagtgacccaacatagctaactggaccaagggtataaatatgaccccaatacagccaaaatagtgactggccagtatattaatatcatgggattgagagtcaggcagacctgagctggaactccagagccacgtggcctcgagcaagttcatgaacaggtccacattgtggtttccttgtctgtgataacagtacttacctcacagggttatggaaaggattacaaaaaaataatacttgtaacacggttagtgcaggtctgaacacctagcaaatgttcagtagatgttattattattattaatatatgaatacactatctttacacaacttgctaagacattctgcccaaacatagaccatgggaattagccaggcaagccagattccttctctcagaaatgtgagggggtctccagaggtaagcagctgctgtcaccagagggacaaggggaaagtcaacagagagaagtggactcatgcatggagaagggaagggggaagtctcacctcctggacttctccagggatccttcccctacatgatccatccccacagtgatgcccattcctgtgccagccagtttctgttccctgggatctaaagtgcccaatgcaacaacatacgatgactttctcctagcaaatctgtgttttgctgctcatgataaaaattaagtatattatcatttcatgagattcccaaataccagacattcctccccagagagatcactgcttccaagggctctgtttcctgaactacagagtgttacataaaactcctcttctgcataggccctattaattttcctgcatgtcagattgtcaaaatcattaaacataatttgcttaaaaaccttcctgcactttaacagtaactttgaaggtaccttttataccttggacccccacagcacctatcaaaagtacagagtaaacgtttagtgactgatggaggataaatatttaaaggataagtgcttgaggctcctattccccgaaacataccatatacaaagggaagacttcaggacagagccaaaaagtcaggcactgtgcctggtatgtaaaactatgtcaccaagcttagtccccatcttagagatgaggtaatagtcacagagactttaagtaacttgccaaggctacagaactgaaccttcctaaaggagacttaactgagccctcaaaaccaccctgaaatccttttgtctatctcagttctctcccatttgttagactaaccattttgatcttctccattctcctccagcttccaataccacttcctccctcattctcagatcacatcctttctcaggagctcaaggaagagtagagaggccaccaggcagaatatcttggtattctgcccacctcctgcaaaattatccatagctactcacatattttttcttcccaaacacgtataagaagagttcttcttgtaatcaaagactaatccttttaacagtctctggatagaacctgtctcccccagcccctttccatctcccactccctttccctacacacaaactcccttgaaacacctaccgggttaatcaacctctcttacctatgttttcaacttctttatttgtattgacatgcttccttcagcaacaggcacattaaagtcaaatcaaaatcctccctccaggccaggcacggtggctcactcctgcaatcccagcatttcgggaggctgaggcaggaggaccacttgaggtcaggagtttgaaaccagcctggccaatacggtgaaacctcacctctactaaaaatacaaaaattagctgggtgttgtggtgcactcctgtaatcctaactactcaggaggttgaggcagaagaatcacttgaacctaggaggcagaggttgcagtgagatgagattgcaccactttactccagcctgggtgataaagtgagactccatctcaaaaacaaacaaacatacaaacagaaaaaaaacaaaaaaacaaaaaaacaaatcccctccacccaacatctttcttatctatcaccctctccctcttctagtttccttctcttcactgtcaaactccctaaaaatgtgtctctactgtccaagtttcttcacctcccattcactttaagctcatttcagcatggtttctcatttcattacttcacagaagcatttatactaagcttacctatctctgggttgagaaatcctaaaagatattcttattatattcactacccagtagtactgacccccatgaaaccgtttccttccactgactcctatgccatccctctctctggattttctcccatccctcgagctatttcttctcagtgtcctttgcaagtttcttcttttacttctccctttggacttattcctagaattcttctcatttataagctcttcttgagtgatcctgcccattccaatggctcaactcagcaacaacctctctatcaaagatctctctcttaatggctagctgatatacccaattgcttactggacagctccctgtacatgtcccacacatctcaaactcagcatgcacaaaatggaacctgatattgtattctctttgaatgcagtcactcaagttagaaattagaatatcattcttgactcttctctttctcacctccatatccagtcagtcagtgagttctgttgattctacttccaaaatatttctcagttcattcccttctccattccttaaagacatcaccttatactggtgttcatcatttcttacctcaattatttaaatattctccctgcctctagtctacctcactctcccccaacaatgtctccactcttttttcaggttgatattccttaaatgtgaatgtactcatttcacttccctatataagatgctacaatagcccctaccatattcagaataaaatccagactcctattacatttggcccctgtttatctgtccagctctttcatcattatctttccggaaacacactccaccagtcttgaggcacagtgaaccaccttcagtctcttcagtgagtgatgccttcttgtgcctacatttctgtccacatgctgctccttctgtttccaatccttatcttcccctttatttatttatttattttttttttgagacaaggtctcattctatcacccaggctagattgcaatggtgtgatcccagctcactgcaacctctgcctctcgagctcaagtgatcctcccacctcagcatcctgagtacaggcacacacccccacgcccaactaatttttatattttttgtagaaatggggttttgccacgttgcccaggctggtcttgaactcctgggctcaagcaaactacctcctaaagtgctgggattagaggcgtgagccaccacgcccggctccccttcatcttaatggcttgagattgaggcaagcttgagctctaattccagtctgtcagttctgtcttttcatttacttaataagggtttcctggcactgggcaaggtgctaagaatacaagtagctactgcctaaggaagctcacagtctcacaaagcagataagtacagagaacgtcagaattcaatgtgaaagtgctgtaacaaaaggaaactagaacagaaggcttcccagaggaactaactcctgagtaagtactaaagggcatttcccaccatatgacatatagaaagaggaagggtgtctgtctgtgttgctggagcagggtcaggagacagggagtagcagaaagatgaccatgcatggtggccatattgagtgggaggcactcctgggtcatgcaagcagagatgctgaaacacacagtacacaggtagacctacagtgttgagataaagaggaagatgttggagtggaaagcagtcagtacagagatggcagctgaaaccacaagaacactaccccacactattacactgtcaatgatacaatgacactactatggtaatgacaacccacagagaacacaggtttaccccatactgatgatgtgtttgacagagctacataccaggttgaaaagatctttttcttagtttcctaaagtactagctattcaaggaacaaaatctatctgaatctaaaagtgacctagttacatactctgggaaatttgagaatatatacagcctatttaccccgaagtaatttacaatccactgggaaaacaatgggttttccatcatccaatgaaaaatgggatattctgcaattcagcactcgagggaggctggacaggggaggaactggctttgattgagatgcttagtatatgcttgtcacaggaaggtggcttttagagagccccgagggatgaatggaccttcagcaggaggagagaaaacagcaccataggtccagagcccataagaacactacaccacactgtgtagacagctttctcttcatgtctaagaaagttagtgtgcagaaatcacaatactataaagaggtctcaggaaggagcttgggtggacagaagcagaggatgcctgttggtggtatccaaggtaagaatctgacaaatggcataaagcaaaatgtgcatatttgcttgcaatacccatggactttttcaaaaataccaaacttcttgcatactgaaataactgcattgagtatttatttattttaggctgtggctttcctatcataaaatccaagtatgtggtcagaataacctaagggtatctcaaacattagcccttaataatcatgatttgaatcttcaaaccttcatataaggaaaatagccttcccaaggataggttctaattaaaatcctggagactagattttctttaattttttttttttttttgcttctctatttcctaggcaaagaaaaggataccactggacttcgtaaacttctcaagagtattctcttgctcaagaacaaaacactctccagaataatctaaaatctacatggaataatacaaaaactatggggggggagttgaatttcaaggcccttacagtccttgataaacaatgatggaataaataatggaaaacataatctgtggctgctcaactagacagttctgctaatgaccataaagagaacccaaactctaaaacttacctctgtatttcccctttacattgagttaggctgaagcaatagctcaaataatccaagttaacaaaagccgacagagaagtgattcagaggtaaatgcatttgttcattcattgactcattcaacactcgcttgaaacttatcacatgccaagctctgtctaggtgctggagtacatggggaagaagccacgcccctgccttcatggaggtgtcactccaaactcagctcaattttacagcaacgtcaaattacacaaaggacttcaacttatagttttccttccagaggttagattgtgacactttcataaaacttatgttagtgtgctgcttctgctcaggattcagaatgaataaactaaaattctacccttcctttaagaactacttagaaaaaaaaaactttataaataatatgatgaattaagaatcccataacttggtcatgagaaatctctgattttatttagtctaatctcctataagtgatcctccttatggagtatatgtgaaagattatcatgtattaaaacaagaatcccaaaagcattatacattaacatttattgaatccgtttactaactcctctttgttaataaattccacgggtgataacaattacctgttcatatgcccagaatttaacagctgtctcaggagcaattttgatgacgtttgtaccatttcccctccaaagcgagcggatacctccttcttttaccatctgtcgaaagccaccaaatatgttcattttgtctgattttgaaccgtgaacctaaaaataaaagcagaatgatataaaatgctggtggcatattactattactttttctagaacaaccacacaatctttttcaataccctttctaactgcaagaagatatatttgaaaataaaatatagaaaggttgaaaaatatatataatgatgagagggagtattgccatgattttagaggcctgtctctgactctaaaactaagaataattggtatcttcagtgtgagaaagcagagagagaagacaagaagagtattaaaattatgaacaaccttcataagataatattaactaaattatgtatcaggcaatggaacaccctttgaaacatgaacaggctcagttaaagggaaataaaaaagtatactgcagataataatattatattattacatataatttaatgtatgtatattattacatataatttaaagtaatatgttactccctctcctcaagaagtagtacagacatgaactgtaaatgggtctgaaatggtttggatattgtgtatatcagggctaccaacactggaatgcatacagcctgaaaccaaaaataaaaattgcaccctctttggcatattttgaggccctctctaggcaataaattcattacaacatgtacccatcctgtgagtactgataaattacttggcttatactacagatgtggtagtcacttaaaaatactgtaccttatgaccacctacagataaaaactgattaagtccaatacaccaaaaataattaaacaaatcagctattcttctgattgtttcagctcacataaaaggggtgactaccactaaacacacacacacacacacacacacacacacacactcacagaacgggttgaattctgaaggccagccatgtggccagtatgaaaacgggccccaataagaactctgcacaccaaaggctcaggtgagcttccctggttggtctgcaatattccatgcctagtgccacataacagtgccaggaaagtaagacatggagactccacagggagaggacaacagaagctctgccctatgtgcttctttacttgactgattttcatccgcatcttttccccgtaataaaccataaccaggggtaataagctttcagtgagttatgtgagtctttctagagaagtatcaaacctgaaggttgactttggaaactcctcaaatttgcagaaactaaattccagagaaatccattttattttaaataaataaacttcacaataaaataggacaaaggaaaaaataaatgcttattcaagttctctaaaagtcaagttactactgttcctaaagaaaaacacacaccaatcccctctcctttttctttaaagcattagctttgcccctaaataaattttgagatttgggtacattctgaaggaatgctggcttaaaacagtgtcagaatctttttgtacagaaatctacagacaaatataaaaagtgttgaccataagtataacaaagttttaaaaatattttgtaaacaactactatgttccaataggttattccagtgtaccagacattatcacatacctgatattgcttgattcttaaaccattcttattagatattcttatccccatcccagaatgaaggaaaatgagacctcagaggtttcatgcagcatgagaaccaggagcactggaggcaaagatactgcattccccctctcatttgttgtaaaggaaaagtcaattctctgggcctcagattccccctggaaaaatgataaaatacctacttcactgggctgctgcaaggattaactgggttaccacagtgagcaaatacatattaattcttttccattccctctttccactctggccagcccaatgctacactgctagtaaatagcaaagtcagtctataaagccagatctttttctgctaacctcagctttagaataattttcaaaattacattgctgctctaagattctagatttcaaaaatactttacttttgataaagtatattaaaaagaaggaaactataaatcaggagaatcctacaacaatagctagagatattttttgaattaaatgtttgaatagtcatagaatgccaaagattaaaagttcattacacacatgtactaacaatttaaggtttggtacactgccatacttacatggactgaatttagagttaacagcaacaaaatagatttattttttagggtataaaagattattactgagaaattttaaaacttctttttcaaagcaccacatttctcattgttttagaatatttagggcaaacctggacacacgataataaagctcacctgcatcatgattttcagacggtccaaaggggcagtgcttgttcgagagacagcaccagcaatgcctcctgccaaaagctgcctccaccattgtccggattttttttcgtcttccgtgaattcatctggaatagttaagctatcccctatgtcaattccctgtaaaaatgaaaaaaagatccccatgcgccttagttaaaaataatcccagaagacgttttgttttagagaagaatcatgttattttacagttaatatgaacttcattccctagaatttatactaaaccaatttgagtacatagattataagttgtctactcacaatgaacaaagtacagtatcagttcacaagaaatgaaaataaacagtaattacaaatatacaaaaccaacagttacaactttctttcattcatcatagattcacagtatgttttctcttggtctaggttaaaatgaaagggcagcattttatcatagtcaatcttttttattgcaaccatttttcataaggctagaaaaccaactggtgatgacatcttttaagaaattcgttcatcaattcttaaacaatacttcctttatctcaaatttatatccacatcatatttataccatgatatgttttaaatatgtaaataaaaattaaaactgtatgtgaatacccctaaactcatttcctactgtttataaaaatatttttataaatctgacttatcatttaaaacatgcaatagattctatataaaatttagctaatggagaggtattgtttcaaatcatcaccccttcaacctattctacattactatagtttgagagaaacaattctataataatatttttacaattctattatctaaattgttttggcagaaaaatttttacaggcaagagtgcaacggggaggagctctcctatggtagtaaccctcccttccttcattttactatcaataaaatggagatacaattgtagtctcaactgttatcaactaccttaaaaaataccgtaagaattatgtaaataaaacttcacatagtgtacaatttatctaggcaactgaactactagtataatattatcttatactcatagctgagaaggcactaatcaccaacaattttataatgctttatgtaagcttaggcattgttactagtggcaatgtgaactcctgacttcatttaatgcatatttaatttagtcaaatctgaagtgtagaagacaagcccataaagaaaaaaaaaaaaaaaaaggccgggcacagtggctcacgcctgtaatcccagcactttgggaggcgaggcgggcggattacaaggtcaggagatcgagaccatcctggctaacacggtgaaaccccgtctctactaaaaatacaaaaaaaattagccaggcgcagtggtgggtgcctgtagtcccagctactccggtggctgaggcaggagaatggcgtgaaccccggaggccgagtttgcagagagccgagatcgcaccactgcactctagcctgggcaacagagcaagactccgtctcaaaaaaacaaaacaaaaacaaaaacaaaaacaaaaaataaataaaactccttcagagagttcctaagggtttcaggagcagattgcacaataatagaacttggtttacatcagtatgcagaatattaatgaaacaatcaaaatttgaaagtttggtggaaaacaaactggtatgaaatgctaagcagatgaagcaaaaagattctgtaacctttaatgaatattgttaagtgccttatgccagagataaacataatctgaccaaacaaggacacagatccttagcaaccatgaggtgctgagattatttggacaatatagtacctataaaaagtaaaagcctacaacttttacacttccctatggcagaatacttaaatgccaataaaagctagacagcttattcatcaaggtggtacttcttccaagttttcagaatggacatttatgcagtcttgggttgtttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcctgctgccttcaagcatctgtttagcaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacctctttctacacagacacagcaaccatccgatttctcaatcttttccccacctttcccctttttctattccacaaaaccgccattgtcatcatggcccgttctcaatgagctgttgggtacacctcccagatggggtggtggccgggcagaggggctcctcacttccctgtaggggcggccgggcagaggcacccctcacctcccggatggggtggctggccgggcggggggctgacccctccacctccctcccggacagggtggctgccgggcggagacgctcctcacttcccagacggggcggctgccgggcggagggtctcctcacttctcagacggggcggccgagcagaggcgctcctcacatcccagacggggcggcggggcagaggcgctccccacatctcagacgatgggcggccgggcagagacgctcctcacttcctagatgggatggcggccgggaagaggcgctcctcactttccagactgggcagccaggcagaggggctcctcacatcccagacgatgggcggccgggcagagacgctcacttcctagacaggatggcggccgggcagagacactcctcactttccagactgggcagccaggcagaggggctcctcatatcccagacgatgggcggccaggcagagacgctcctcacttcccagacggggtggcggctgggcagaggctgcaatcttggcactttgggaggccaaggcaggcggctgggaggtggaggttgtagcgagccgagatcatgccactgcaccccagcctgggcaccattgagcactgagtgaacgagactccgtctgcaatcccagcacctcgggaggccgaggctggtggatcactcgcggtcaggagctggagaccagcccggccaacatagcgaaaccccgtctccaccaaaaaaatacgaaaaacagtcaggcgtggcggtgcgcgcctgcaatcgcaggcactcggcaggctgaggcaggagaatcaggcagggaggttgcagtgagccgagatggcagcagtacagtccagctttggctcggcatcagagggagaccgtggaaagagagggagagggagaccgtggggagggggagagagagggagagggagagggagagctgtttttttttgtttaatactctataaatctatgcctaatagaataaatagaactctacaggttaaggagctactgggactcaggtatcctggcccataagtgttacagagtgttcttgggtgataactgtacctatggtttatagctccaaataagtataaatacataaagtagacttactgtagaatgtttccagaaacggataatttcctcaatgtctgtaacaggattaaataagaagtagtctctccattcattccagtccactgtcattgtcccatcaacatcaatgctgaaattttaaaaaaatgatcaaagtacaaaactaaattgataaataaaactaacattattggccactttacagaatgacagtttcttttctaacataatattctcattaaattaaaaaaccccatccacaaatataggttgttggaaatggcagcaagcattttatggtcctgtcagatagttttaattatctagataaaaatgggcccaaaaattacagccagctcactaaagaatactttcagcactctgtcaaactctgccaatgagctacaaaacacaaaaacttgaagataaaatattaaacgatggtaatgaatagattcattatccatttttttcatgcacttagtggatcatgaagataattcttaatgttctattgcaacatttgaatgtagttttgaaatatactcaaaacatgctatcaacttcctcgaagttaggaaaattaacagctattataaaaaatcaaactgtcagtgactgtgcctttgagtcttttttttttattattatactttaagttttagggtacatgtgcacaatgtgcaggttagttacatatgtatacatgtgccttgctggtgcgctgcacccactaactcgtcatctagcattaggtatatctcccaatgccatccctccccctccccccaccccacaacagtccccagagtgtgatgttccccttcctgtgtccatgtgttctcactgttcaattcccacctatgagtgagaatatgcggtgtttggttttttgttcttgtgatagtttactgagaatgatgatttccaatttcatccatgtccctacaaaagacatgaactcatcttttatggctgcatagtattccatggtgtaaatgtgccacattttcttaatccagtctatcattgttggacatttggcttggttccaagtctttgctattgtgaatagtgccacaataaacatacatgtgcatgtgtctttatagcagcatgatttatagtcctttgggtatatacccagtaatgggatggctgggtcaaatgatatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttctttcgagaagtgtctgttcatgtccttcacccactttttgatagggttgtttgtttttttcttgtaaatttgtttgagttcattgtagattctggatattagccctttgtcagatgagtaggttgcaaaaattttctcccattttggaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggggttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctggtttggttactgtagccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattgccttgggcagtatggccattttcacgatactgattcttcctacccatgagcatggaatgttcttccatttgtttgtatcctcttttatttcattaagcagtggtttgcagttctccttgaagaggtccttcacatcccttgtaagttggattcctaggtattttattctctttgtagcaattgtgaacgggagttcactcatgatttggctctctgtctgttgctggtgtataagaatgcttgtgatttttgtacattgattttgtatcctgagactttgctgaagttgcttatcagcttaaggagattttgggctgagacaatggggttttctatatatacaatcatgtcgtctgcaaacagggacaatttgacttcctcttttcctaattgaataccctttatttccttctcctgcctaactgccctggccagaacttccaacactatgtcgaataggagtggtgagagagggcatccctgtcttgtgccagttttcaaagggaatgcttccagtttttacccagtcagtatgatattggctgtgggtttgtcatagatagctgttattattttgagatacatcccatcaatacctaatttattgaaagtttttagcatgaagtgttgttgaattttgtcaaaggctttttctgcatctattgagataatcatgtggtttttgtctttggttctgtttatatgctggattacatttactgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagaaattcaacttcttcctggtttagtcttgggagggtgtatgtgtcgaggaatttatccatttcttctagattttctagtttatttgcatagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaacaaccagctcctggattcattaattttttgaagggttttttgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagagcgtctttatttctgccttcatttcgttatgtacccagtagtcattcaggagcaggttgttcagtttccatgtagttgagtggttttgagtgaaattcttaatcctgagttctagtttgattgcactgtggtctgagagatagtttgctataatttctgttcttttacatttggtgaggagtgctttacttccaagtatgtggtcaattttggaatagccgtggtgtggtgctgaaaaaaatgtatattctgttgatttggggtgcagagttctgtagatgtgtattaggtctgcttggtgcagagctgagttcaattcctgggtatccttgttgactttctgtctcattggtctgtctaatgttgacagtggggtgtgaaagtctcccattattaatgtgtgggagtttaagtctctttgtaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgtctttttttgttttccatttgcttggtagatcttcctccatccttttattttgagtctatgtgtgtctctacatgtgagatgggtttccttaatacagcacactgatgggtcttgactctgtatccaatttgccagtctgtgtcttttaattggagcatttagtccatttacatttaaagttaatattgttatgtgtgaatttgatcctgtcattatgatgttagctggttattttgctcgtttgttaatgcagtttcttcctagtctcgacggtctttacattttggcatgattttgcagcggctggtactgattgttcctttccatgttaagcacttccttcaggaactcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggtttgtagagtttctgccaagagatccgctgttagtctgatgggcttccatttgagggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggaggctttgctcgtttctttttattcttttttctctaaacttcccttctcgcttcatttcattcatttcatcttccatcgctgataccctttcttccagttgatcgcatcagctcctgaggcttctgcattcttcatgtagttctcgagccttggttttcagctccatcagctcctttaagcacttctctgtattggttattctagttatacattcttctacatttttttcaaagttttcaacttctttgcctttggtttgaatgtcctcccatagctcagagtaatttgatcgtctgaagccttctctcagctcgtcagagtcattctccatccagctttgttccgttgctggtgaggaacagcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaaccggctgtgtgaggtgtcagtgtgcccctgctggggggtgcctcccagttaggctgctcgggcgtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaagcaagcctgggcaatggcgggtgcccctcccccagcctcgctgccgccttgcagtttgatctcagactgctgtgctagcaatcagcgagactccgtgggtgtaggaccctccgagccaggtgcaggatataatctcctggtgcgccattttttaagcccgtcagaaaagcgcagtattcaggtgggagtgacccgattttccaggtgccatctgtcacccctttctttgactaggaaagggaactccctgaccccttgcacttcccgagtgaggcaatgcctcgccctgcttcggctcgcgcacggtgcgcacacccactgacctgcgcccactgtctggcactccctagtgagatgaacccggtacctcagatggaaatgcagcaatcatgcgtcttctgcgtcgctcacgctgggagctgtagaccagagctgttcctattcagccatcttcgcctttgagtcttaagaaatcctggcacctcattttcaatcttaaaattaacatactgtactcaaatatttatcattaatatttggcttgttttacaagtttcttggtaattaatgccatttgtatctgttttctcctaagagaaactctgagtgtaccaggattttgactgttttattcccttccttgggccacctcttacagctgctggcacaaagaaggtgctcatttatttattgaattaatggatgtctctaaaaaaagctttggtgcatcctacaaattttattctataattagtatgaaaatgatgcaaaaggatggcagtcaaataaaatgcaattttcaggtattcattattgtgttttctagtgtcactttttattttgacttgcatatgggaaattacacttaaactttcatttgtcccagcacagaggtatatctgcatgagagtcctagtcactacttacatttataatataactctgggttgcaatatttataggtttatttatgtcactattttctattttaatgtaattgttgtttgaccccaccacccaactccccacacataagcatcctccacaaggcaaggattttttttaatttcattcaaagttataaccaaggtttctaaaacagtgcctgccactgagtatttattgaataaataaatgaattacaaactctgtagcttaaaaccacagaacatttagggtattgacaaacttcctagataagatagtcttgctgtgggtataacttgcatttcccttcaaattactaaacgtgttgagcatctcttaccatgttcatttgctactgctgtttctttcacgtgaaatatgctgttcatgtctttgcccgtttttctaaccggttgtatgtctttttcttatttacatagttctttatatcattcattctaatccttcaagttataagctggcaaataccttctctttgtctttccactctatgctgtccaagtacagatgctcttgattttaacgcagctgaatttaatctttttaatgcagctgaattcaatcttttcattcctatgtatggccttttgtgtcttctttttaaaataaattcttccctacactgagataaagatatttcttccccaccacctcaagctgttatagtttaactttcacgtttaggttggtgtttgtgtacggtaagaggcaggtatcccaatttcctttttgtctgcatgagcacgagcatcatctattgcacacactctccttttcccaaagttttgcaaagctacttctttcacgtgacaaatccaaaatatggatgggtctgtttctgggctctctattatgtttcacttgttaacttgtctgtttctgtagaaacagcactgacttggttatggcttaataacaacccttggtatctgatagggcaggcccctggctccttacagttcttcaggaatgtcctggatattcttaggcctttgctctttgatataaatttgagactcagcttgacaaattcctcaaaaaaaccaggtgggtttttttaatggcattgaatctctatcaccaatttggagagaaggtacatcttttctatactgagtcttctttaaagccttctaacaaattttgttaagctgctcttatgaatgcattgattgtggtatattttttaaaatggctgattcagtttgctaatattttctttaaatttttacatataagtcataggtatcttggcctctaatttccctgtttcatatactgtctgcttttggtgttataatgatctcctagaaaggataggacagtgtacttctacactctggaaatgtttgtacatctgttctttaatcatttgcaagaaccatctggggctaacgttttgtttatgagaaaattttaaattactgacccaatctcttcaattgcttaggtactataagctgttgcttcttcattcagtcccagtaagttatatttttctagaaattcacctactttgtctgttttcaaatttattggcattaatgattcatattattttattagttttttaaaagtccttatgtgcctatttataactgaacatgatttatttacatctcatttctcttttttcttcatcaatctttccagaggcttgtcttttccaacagtttctggctttgttgatcctgttactgcatctttgctatatattctttattatctccttcctcctaccttcttcgagattattccattttctctcccctaacttagcacattaattttcagacttaattcttttctaataaaagctttcagactataaaattcatacaagttccatcttagaaatattccataagttttaatgttttcaagtcaacgtgtccttgaatttccacttacgatttcctttgacccataagttgagaagtgtatatcacactttaaaatattggcatttttataatttatgtctgtaattaacttctattttaatgcatagtggtcagagaaagcagttcttgtgataccagttctttgaaatgtgttgaacctggctttatggcctactatgaaatcaatttttatacatgttccataaatacctaagaaaaaatattttttctaattttttgatgctaggtcctattacatgcccattaaatcaagcttatgtatttagaagtttttgtcttcactaaagtttttctctgcttgacctatcaaatacaggaagaattgtgttaaaatctctcaccactatgatggatttgccaattaatccccagaattttatcaaccagcttaaaaattgtatatcctcatactgaattttaaaatgtagtgacactctatttttattaatgtttttactatataatctattattaatagattattaataataattaacagttgatattaacatagctaccccagctttttttcagtaagacttttattttgcttgttctttcatctgacaatctctgccttctgatgaaatttacattaatttttattaattgaagactaaactgagaaagtcctaactgatcagaaggtgattatcttctaacttactcgtcacccacctcaaacccccagggaaacaggataagaactctatttaggctgccccatttgagaatggggatgaagggaaatcatgccccaacattactgcagggcacattttagtggagttttactgtacttgaatttatttctcacatcttacctattgctttctaattatctcattctttctatgtttttccctcttctctctactcttcattggattgtttcaatcttatgtttatgtatttattttcttattccatttctttcccccctgatttggaagttatatactcaactactacagtttcaatggtttaccttgaaattttaccacatatatataacaaagtctaaagttaatgtctgaccccatcatcctaaataaggtaagaattttagaacagtttaatacaaatcatccccttccctcctaacttacatactattattgtctagtattgtagttgtcctttttcttagaacccacaaatgggtcattattatcatattcatggatgtttccaacagactgctgaaataatccataggccactagctaagaggtggcccactatggtctagagagtaccaagaaacactgtgtgacccattccccatatatgctgcctccagggctgtatatgtcctttcccctacctaccttccactcacccttttcagtagcataattctactcattctttaacatattcttcaatattttctgagagtccattattgcaacgtggtggacatagaactgttaaccagatacacatggtctgtgccctcagtgggaacaacaggcatggcactaaacaaaagcaagcaatactcaatattcattgagcatttgccaggcattgttctaagtatttcacatgttaactcatttaatccttaaaacaagcccatgtatttactatactctccattttacagacaaagagaggctaagaattttgttatagtcacaagactagtaagtagagtagaattaagagtttcaacccaggcattctaactccaaactgtactcctaaccactgagctatacaaacaagtcaaggattacaaaccataagtgccatgaagcacagaaacaaattgcatagtcaaagaataactggagtgaagggttccaagcttctgaacaattctggagaaagaaatgtaaagatatgaaaatgagagtaaacaggggaaatgagatggagacaaaagcctaaaagaaaaatgagagcagaagataattatgacatatgtgaaacacatgtttcagagggaatgcctgcttcagctacttcatatctacagcttctactgaacaggtgtaagtaggaggctatatttcaactcagtgactcctctcttacaccctgatgacccagtcacagctgtttcaatcaacactgtgttagtctgttttgtgttgttttaaacgaacacctgagactcggtaatttataaagaaaagaggcttatttggctcacagttctacagactgtacaagcatggcaccaacatctgctcagtttctggtgagacctcaggaagcttttactcatggctgaagaaaaaaggtgagcaagtgtgtcagatggtgagagaaggacaagagaaatgagatgccaggctcttatcaacaaccagctttcatgaactaatagagttcacttattaccaagccattaatgaaggatccactctcgtgacccaagtagtccctacttccaacactggaggtcatatttcaacatgagatttggaggggacaaatatccaaaccatattaagcaccattcagatgtttttcccatgaattcaagtttgggacacaaagagacagtgaaatggaagaaaacaagctgacatttggagtgacatgagtaacactaatggcttagcacttgagggaaggtccatgatggttatataactacaggaaactctggtcacattctgcctttaaaaattgtttctaacacttttactgaagaagtataaacactagtaataataataataataataacaatatcccaaaagtacaaaaaaagtcactagccatgaaagaaatataaatcaaagccatgagatatcacttcataccaattatatattagtcagggttatctagagaagcagaaacaatggatggttaaaatcaaaagaaatcaaaagacagttcagatatggtggctcatgcctgtaatcccagcactttggtagggcaaggtgggtggattgcttgagcccaggatttcgataccagcctagatgatatggtttggctgtgtccccacccaaatctcatcttgagttgtagttcccataatttccatgtgtcacgggagacagctggtgggaggtaattgaattatggggggtggtcaaccccatgctgctgttctcatgatagtgagtgagttctcacgagatatgatggttttatagggcttttccctctttgctcagcacttcttcttcctgccaccatgtgaaggacatgtttgcttccctttctgctatggctgtaagttatctgaggcctccccagccacgcgaaactgtgagtcaattaaacctctttcctttataaaatacccattctcaggtggttctttatagcagcgtgagaatgaactaatacagtaaattggtactaggagttgggtgctactataaggatacccaaaaatatggaactgactttggaactgggtaacaggcagaggttggaacagttaggaaggttcagaagaagactgggaaagtttggaacttcttaaaaatttggagagctcagaagacaaaaagaggtgggaaagtttgtaagttcccagagacttgttgaattgctttgaccaaaatgctgatagtaatatgggcaatgaagtccaggctgagatgatctcagatggagatgaggaacttgttgggaactggagcaaagatgactcttgttatgctatagcaaagagactggtggctttttgcccctgccctagagatctgtggaactttgaacctaagagagatgatttggggtatcaggcagaagaaatttctaagtggcaaagcattccacaggaagcagaggacaaaagtttgtcaaatttgcaccctgatgatgtgacagaaaagaaaaatctattttctgaggaaaaaattcaagccagctgcagaaatctgcataagaaacaaggagtgaaatgttaatcactaagacaatggggaaaatgcctccagggcacttcagaggtcttcaggaagggccctcccatcataggcccagaggcccaggaggaaaaaatggtttcctgggccaggcccagggccttgctgctttgtgcagtctcaggacttggtgccctgcatcccagccatggctaaaaggagccaaggtacagctcaggccatggcttcagaaggtgcaagccccaagccctggcagcttccacaaggtgttgagtctgcgggcacacagaagataagaattaaggtttgagatcctctgcctagatttcagaggatgtatggaaatgcctggatgtccagacagaagtttgctgcaggggtggagcccttgaggagaacctccgctagggcagtgcaaaagggaaatgtggggttggagccttcacacagagtccccactggagcactgcctagtggagctgtgaaaagagggccaccatcctccagtacccagaatagtagatccaccgacagcttgcaccatgcacctggaaaagccacagacactcaacgccagcctgtgaaaagagccagaagggggtctgtaccctgaaaagccacaggagtgcagatgcccaaggccatgggagcccacttcttgcattagcatgaactggatgtgtgatgtggagtcaaaggagatcattttggagctttaagatttgactattccactagatttcggacttacttggggcctgtagccccttcattttggccaatttctcccatttggaacaagtatatttaatcaatgcctgtaccctcattgtatctaggaagtataataactaccttgcttttgattttacaggcttataggcagaagggacttgccttgtctctgatgaaaccttggacttttaggttaacgctggaatgagttaagacgctgagggactgctggaaaggcattattgtgttttgcaatgtgagaacatgggatttgggagggaccagggcaaaaatgatatggtttggctgtgtcctcacccaaatctcattttgaattatagttccaataatccccacatgtcacaggagggacccagtgggaggtaattgaatcatggaggaggctaccctcattctgatgttctcatgatagtgagtaacttctcatgagatctgattattttataagggtttttttccctctttgctaggcactgctcttcctgccatcatgtgaagaaggacgtgtttgcttccccttccaccatgattgtaagtttcctgagggctcctcagccaagcaaaagtaagtcaattaaacctctttcctttataaattacccagtctcaggcagttctttatagcagcatgagaatggactaatacaccaggcaacatggcaaaaccacatctctacaaaaaatataaaaattagccaggcattgtggtacaatgcctgtagtcccaggtactcaggaggtgagaggatcaattgagccagggaagttgaggctgcaatgagccatgattgtgccattgcactccagatgggatgacagagcaagaccctttctcaaaaaaaaaataaaaatcaaaaaatgaaaagacagacagtaatgagtattcatatagctatggagaaactgaaaccttcattcattgctgctgggattataaaatggtgcagccactttagaaacaatttggaagttcttcaaaatattaaagatatttaattaaatattaaagaatctctagacaggctgactgttgaagggcattctcagacaaagccagtctgcaaagactgaaataagtgcctacttcttcaaatgcacagatgtaaacacaaggccacaaacatcaacaacaatcaggaacaaatgacaccactaaagaaacaaaataaagtaccagcgaccatccctaaagaaacagagatgtatgaactgacatagaattcaaagaaagctcagcaaacttcaagaaaatacaaagaaacaattcaatgaaattaggaaaataacgagtgaccacaaagagaaaggtaataaagagatgaaataataaaagaaaaaatcaaacagaaatcatggggctgaaaaatacaatgaacaaaattaaaatgcaatatgggagcatcaactgcagaagtgatcaagaagaagaaagaaactatgaactcaaagacaggttatttgaaaatacacagaggagaaaaaagaatgaaaatgaatgaagaaagcttacaagatttatggaacagcatcaaaagagcaaagttttgagtcacaggagttgaagaaggagaaaaggaagataaaaggggtaaaaagcttaattaaagaaacagtaacagaaaattttccaaacctggagaaagaggtaaatatctacatgcaggaaaagtccaaggtctctaatcagattcaatccaaacaagactaccccaagacatattacaatcaaactatcaaaaatcaaagacaatgagaggatcctgaaaacagcaaaagataagaagcaaataacatataagacagtcccaatatggttggaaacagactggtcagcagagacctaacaggtcaggagagaaagggatgatatatttaaagcgttcaaggagaaaaataccaaccaagggtaatgtacccagcaaagtgtccttcagaaatgaaggagagatactttcccagacaaacaatagctgagggagataatcatgaccgcacctattttataagaaacgtaaaaggagctcctcaagctgaaagaaaaagatgctaatgagtaacacaaaaacatctgaaagtataaaactggctgataaaagaaagtacacaggtaaattcaaaataatactgtaatgatggtatgcaaatcacttacatctgtagtaggaaagagaaaactattaaaagtaataatagctacaataatttaagggatacacaatatgaaaagaggtaaactgtgacatcaaaaattcaaaatttcaggggattaagtaaaagtgtagatttttttgttttggggggtttttgcaataaaaattaagttatcaagttaaaataaactattataactcttaagatgttttttgtaacctcttggtaaccacaaaccaaaaaccaataggagatacacaaaaaataaaaagcaagaaatcaaaacataccactagagaaaatcacttaaccacaaaaaaaagacagcaagagaggaagaaaagaataaaggatctataaaagaaccatgaaacaataagcaaaatggtagtacaaagtccttacttatcaataattaccttgaacatgaatggattaaattatccaatcaaaaaacacagtgtctgagtggattaaaaaaactagatccaactatatgctgcccatgacagactcatttcatctgtaaaaatacacacagactgatggtgaaggaatggaaaaagatattccatggaaacagaaaccaaaggagagcaggagtaactttacttgtatcatataaaacaaactttaagtcagaagttgtaaaggagaaacaaagttcctatataatgataaaagggtcaattcaataagaggatataatagtaagttatatgaaggtacttttactccactcctcccattttaaattttcagtgtcacaatttatatattttatattgcatatcccttaataagttatgtagctattgttttttataaatatatatgaacccaacatcagagcacctaaagataaataccaaacattggccaggggtggtggctcacacctgtaatcccagcactttgggaggccaaggcgggtggatcatgaagtcaagagatcaagaccatcctggccaacatggtgaaaccccgtctttactaaaaatacaaaaattagctgggcgtggtggcatgcgcctgtagtcccagcgactcgggaggctgaggcaggagaatcgcttgaaccgtgagacgggggctgcagtgagccgagaccctgccactgcactccagcctggtgacagagtgagactccgtctcaaaaacaacaacaacaacaacaacaacaaataaaataaaataaaaaccattaatacgtctgaaaggagagagagactgcaatacagcaatagtaggggacttcaacaccctaccttcagcaatagacaaatcatctcaacagaaaatcagtaagaaacatcagacttaaactatactctagaacaaatggacagatcagacataaaacatttcacctaatggcaagagaatacacattcttctcaactgcacatggaacatgcaccaggggatatcatatgttaggccacaaaacaagtcttaacaaatttaagcagaatgaaatcatatcaagtttcttttccgaccacaataataaaaaactagaaatcaggccaggcgcggtggctcacgcctgtaatcctagcactctgggaggccgaggcgggcagatcacgaggccaggagatcaagaccatcctggctaacacagtgaaaccccgtctctactcaacatacaaaaaattagccgggcgtggtggcgggtgcctgtagtcccagctactcgggaggctgaggcaggagaatgacgggaacccgggaggcggagcttgcagtgagccaagatcgggccacagcactcaagctcgaggacagagtgagactccgtctcaaaaaaaaaaacaacaactagaaatcagtaacagaggtgcttcagcaaattcacaaatacatggaaattaaacaacatgctcctgaatgatcagtgggtcaatgaagaaactgaaagcaaaattcaaaaatttcctgagatgaaaaaaaatggaaacacataataccaaaacccatggaacacagtaaaagcaattttaagagcaaagtttatggcagtaaatgcctacataaaaacaaaaaacctcaaataaacaaccaaaaaaccccaatagacatttttcaaagacatacaaatggccaaaaagtacaaaaaaaaaaaaaaagctcgatatcactaattaccacagaaatgcaaataaaagccacaatgagatatcacctcatactacacttagaatgactattaccaaagagacaaaagataacaagtgttggcaagtatgtagagaaaagggaacttttgcaccctgttggtgaggagttaaactaatacagccattatggaaagcagtatggagttcctttaaaaattaaatatagaactaccatatgatcctgcaatcccaccactgtatgtatgtgtgtgtatacatatatatatacacatatataaaatgaaatcaatatgtcaaagagccatgtgcattcccatgttcattatagcactattcacgatagccaagatacggaatcaacctaagtgtccaccaatgcatgaagagagaaaatgtgctatatatatacaatagaaaactattcggccattaaaaaaagaaggaaatcctgttatctgtaacaatatgaatgaaataagccaggtaaagacaaataaatactgcatgatctcactcatgtggaatcagaaaaagttaatctcatagaagcagagagcagaatactttgggagtcgggtatggtttgtgttaaaggacacacaatttcagcttgacatgaggaataagttcaagagctccactatacaacatgaagactacaattaataataatatattatattcttgaaaaatactaagagaatggatgtaaagtgttctcaccacagaaatcattaagtatgagatgtatcatgttaattagctagacttagtcactccacaatgtacatatacttcaaaacatcatgttgtacatgataaatacatgtaattctgtcaatttaaaaataaataaatgttttaagtcactgaattgtatactttagaaaagtgaatttatggcatgtgaattacatctcagtaaagctgctggctaggtgcggtggctcacttctgtaatcccagcactttgggaggccaagatgggtggatcacctgatgtcaggagttcgagacaagcctgaccaatatggtgcaaacccgtctctagtaaaaataaaaaaaaatagccaggcgtggtggcgcgtgcctatagtcccaactactcaggaggctgaggcaggagaattgcttgaacctgggaggcggaggttgcagtgagctgagatcgcaccattgcactccagcctgggcaacagagctagactccatctcaaaaaaaaaaaaaagttaccataaaatatttatattaaaaattgtgtagctacttttaaatatccaaccctctgcattatcctttgctatggactgagctgtgtccctcccaaatccaaatgttgaggccctaacccaccgtgtgattatatctggagatagcatctttagggggtaaagtcaaataaagtcataagaatggaaccctgatccaacaggactatggccttataatagaaagcaagagaaagatctctctctctctctctctctctctctctctctctctctctctctctctctgccatatgacaatacagtgagaaggggtctatctgcaagccagaaagagagccctcactacaacccaaccatgctggcactctcatcttaaacttccagctcccagacctgtgaaaaactaaatttccattgtttaatgcatccagcctatggtattttgtcatggcagctaagctaatacttcttagtctattctgaagcttgggcttagaatttgcattattcctaaagctatcaaagaaaatataggaatatgatttctggcctaacagccagggaaaagccctcactttcctataagaatattactttagaagcagaatattatatgctctatatctcactgtccaaattctgtttatcttcttttcatgttttaggttttcatttcctcaggaaagcccttctcatctagtactaacaaaagtcattacgtgctcagccttgagactttgagccttcctcttgagcagctgtttgtaaaagaaattatgaagagagagaaaggatgaaaatgctattggcacagatataaaatgagataaattcaataacaaagccatttagaaagatttttagacaatgtgaggactgaaaatattcacaacaatattaatacaatataattgtcctttctgttttacgttatcataaaaaatcagttcctgccctgtgtttatagcaacagagtatttgagagcacctgggctgcagagattactgctctatcccatgaaacaaaacattaagagtataaaagtctgacttaaatagtcaaactgattgccccagacaataaggttcaaatttgcatttctgttttctgaaagtttaaacaggtatttctttgttagcttggagagcttagtaatttcccttttttccagtcacatctaggttaaataatgtgatgaatctgctagtcttcttagtttgaatcaatgagttttactgtcacattagaaatcaaatggagaaaaagcaacaccaaaactcttcagctcctcatctatggagttaaaaccttacttcctgccattccactatcctttgaggccttgaaagaaagagtccagtctgagcttacacttcccattcttacactttagataaatgtacacatacaaaatgaatgggaggaaaaaagacaaaaagatcttggatatacataatgaagactagggaggtgttttaaagccacacttacaaacacagagttctaatgcagaatattaaagtgaaagtcaattgttgaccaacatgaagagcttacctttgaagaatcaactctgcttgttgttcagaaatagtcagacccagtgtctggagagactggacaatttctgaagcctcaatttttcctttaaaaaaataaaaagggcaaaaaataaaactcagaactggtaagaaccacagaaattatgaatttcaaatctctcatttaagagaaagctttaaactgattaaggcaaaattgtgcatgtaggtgagttatagacttgcttaaatgcctatcccaacatcaatactaaaaatgtaacaaatacattaaaaaataaatacacattttttaaaattcagtaattgtaacagccttatagataaataatattcctccaaagagactgacttcacaagtggccttaccaagtaatgtaattaagaagtagcagaactaaaatccaaatcaagatattctaactccaagataaattcaattaaagtaggatctattcattttaaaagtacctatttctacatttttaataaattactagacatttactatgcaaaacatcatatatgactgagttaaagagaagtagtaaatgaggaaatagagctaaagcacagactattcttttaaaaatctggcagtaaaaggccaggcacagtgactcacacctgcaatcccagcacttttggaggctgaggcgggtggttcacctgaggtcagcagttagagagcagtgtggccaacatggtgaaaccccgtctctactaaaaatagaaaaatcagccaggcatggtggcaggtgcccataatcccagctacttgggaggctaaaagaggaaaattgcttgaagctgggaggcggaggttgcagtgagctgagatcgcgccactgcaccccagcctgggtgacagagtgagactccatctcaaaaataaataaataaaaataaaaatctggcagtaaaaataagggagcaaggataaaagaacaacaaaagacagaaaatttttaatactagggaaattagagcgtgtttgtggacagaaggagaacaatcagaagacaggaagagaaaatagaaaataaaatagaagcaataaatgtaagcactgctgtatttccttctagcagctcacaggctcatgagaatcctaagactactgtacatgaaaaagaatgaaacaaaacaaagtaagagagggtctggtgctgaagcagcataaacagctgacttctccagaaaaagaggaagaccaaaattactgttagtggtgaaaggatagactttcttggagaaaggaccctggagagatgacaggattctgagagaatcctcctggggagagggaaggagcagcatgagaatctggaccatgtaaggacagtgagaggcagcatctgttagtaaagaaattatgcaaatacccttctgaatattctcctttagaaatgcactcttaaagagatatggttaattctcattattcacagcaatcatcttccataaagttctatattcattgcaaacactgaattagcaaataccaaaccattgttcctacaggaaaaacagggttaggttcctgtgagcctctgattacaacactttcatcaactgattaatacataaccatgtcttatgtctgtttctgtttgaacgcacctcatttaatgtgtgctgttgattcactaacattgaatttggggcaaagcttatcaaacgcatatattttctccataaggcatgctatggctttcttgcacttaggaacactagacagcacttcagcactacctttggggaacattttaaaaaggaaattaccaacaaaaatacaaaaatgcaaaaactggcacaaaacagaccttgaaagggatacttgctagttaatagtatgagagctgaaacaagaaggcagagtattgccttattctactagctaggaatgtacatgctgagcaactcaagtttttcactgctctgtgcatgtccatgaatgcctgggaaagtactgtgagtatatattttggggttactttggggataaattttattgagtaggcaaatttgcaaatacagaatccccaaataatgaggatcaactgtatatgttttgcattaaggaagtctaaaaaataaaaatatgaaccaataatgccacattgttttaaaatacacaaacatgggaaattagggaaacattgtgtagatttcctacaaatataccatcaaaatttcatctttaattattgcctctggttcatttagaattttataaaatgaacaattgatatgtacactacttatgcactgggataattgacctctgattatctggcaattgatcttaaggtagctccatctctcagctactgcctgccatagcagcacacagacaatctgacctgcaagacaatctgaactgcagagggtcgatgttggaatgaaagtttgcagagaagaaagaaaactgagttttgctagaagactggactaaggctagacttaggggcatatattgtaaggcttatgggcaacaaatgttccaatagtactactttccaacccaaactcagctcttcctggctgagagtcacagatgtgaataatcttcaaaatcatctagagtttagtttgtttgtttgaaggaacttgctttgaattaaactttaatattcattgtaaatcaggggatggcaaactataaccctcaagccaaataaggtgtattaactatctttgtaaataaagttttattggaaatcagtcatccccattcatttacatattatccatggctgcttttgaggtacagcagcagagacaagtagctacaactgagaccacatgacccacaaagctaaaatatttattatctggacttctggacaaaaaagtttgctgatctcagacatgaaccacatttcctctcaatctatttgtttaacctgtttctttaataacaagtctgtaaatgaaatgaccttgactattcacaagtagggagggatttggtgctgcattataatttttataaattctctcttcctgttaaaggttacctctagtgatgagggcttcaagaccctatttccaattagaattagataaggtcttcagagtagggcccccatgatgggactagtggctttttaagaagaggaagagagatctgaggtagtgcatttgctctgtgatgcctgctagcatgttatgacatagtaagaggccctcaccagattcggctcaactttgaacttcccagcctccagaactataagaaataaatttcatttcttcataaattacccagtctgtggtactccattacagcaacagaaaacagattaagacaaactccaacctattaatcgaaatatagaagtcataatcttaaccagaaggtacacacttaaacgtttatatgctatttttccctaatttccaggatcagagatatcttctctaaattaattcttccaaaaaaactaacagatgcaagataatctgaaagttttttaaattttagatgacacaactgtcattcttctatacaaataaaaagaaatctcattttacccagaggacaagaaaatataattattatttttaacctacaggtttaactcaaatcagcataatgttccatagttaacatttacaacaggccctgcccacagtttttaattcagaaatgtaattcattacatttcaaagtaatgaaaaagaaaagctatctataagttttcttcactaaataatataaactctacataaaaatcacattactaaaaaaaagtattaacacaaataataattatcatctaaaaccagagagattaaataagcatccttttagactcttgaaagcatgataaatgcttcttcatagctggtgataaatacaaaagaaagacacaccatcattatttttgtctaaactcttaaatgccaatttcattttcttctcatggtctttaaggtacttcataaattcttcaaaatccagcttcccatctttgttgacatctccagtagtaaaaattttctataaaaaaaaattagagagaagttattgccaatatgggctgatgcactaaattatttctacacatatttcaagcagattagctgttttcctaaaagactatagtacctatttttggccagatgtatcatcattcattatcgcaaagatctataataaaagtaattccactactgcaaaaagattctgagtcttgtgttaaattttcaatcagaaaaatgatgcattgatttttataaaacatgacatttttaaagctaatctaaccataccctaaatttcttgacatgtactttataaaccccaagatagaagacaaccacttgacctaccacaggatttaaaatattgcagcactttgggaggctgatgggggaggatcacttgaggtcaggattcaagaccagactggacaacatagtgagacctcatctccataaaaaatttttaaaattagccagatgtgttggtgcatgcctgtaaatactagctacttggaggctgaggtaggaggatcacttgagcccaggaatttgaggttacagtgagcaatattgcaccactgcattctaacctggtgacagagcaagaccctgtctctaaaaaagaaagaaagaagaaagcctaaactagtgttttcccctttgatttcaaaaattaaataatcttttactaaggatgatccatataaaaagctgtcatagcaaactgtaagccctctcctaccaccacccaaaatataacctatctacctattatgacactcatagtcacccactcaaagcttacaaattctactgttctcatggtcatgctcttctgggtaaataatgccaagttgggccgggcacagtggctcattcctataatcccagcactttgggaggctgaggtgggcggatcacctgaggtcgggagttcaagaccaacctgaccaacatggagaacccccatctctactaaaaatacaaaattagttgggcatggtggcgcatgcctgtaatcccagctacttgggaggctgaggcaaaagaatcgcttgaacctgggaggtggaggttgctgtgagccgagatcgcaccattgcacaccagcctaggcaataagagtgaaactctatctcaaaaaaaaaaaaaaattaaaaaaataatgccacattgtgactggatggtttcatggtcatggtcagatctccaacctccagactgagagacagatctgaaacttgtgagctgcaactaaagctacacttagagaaagatttctggtttaaaatgcataattagaaaagaagaaagactggaaatcggtgacccatcattgaggcttatctcaatctcaagaaattattttaaaattaagcaaaaaagaagttgaaggaaataaagagcaaaaagtaatgagaaagaaaacacaccattgggaggattaacaaagccaaaagatggttctttgaaaagactaataaaattgataaactcctaaaactggcaaataaccaatgtcagaaagtaaagatggaaactactagacactatagacattaatgatattatgaaaagctttatatcaaaaatatgaaagtgagataacaaacgcctacaaaaacaacttattaaaaactgacataagacagcagaaagtctgatagccctatactcagattttaaagaaatttaaagtgtaatttgaaaacatttccatgaagaaaaatcgaggaccccatggttttaacaataatgtctaccaaactttaagaaaaaaacaccaattttccagagaacagaaagggtgggaacattttccaacccattttatgaggcgggtatacacttgattctaaaacctaacagggacatcacaaaaaaaggaaaattacaagcaatgtcaactagtgaaaaagatgcaaaactcctgtataaaatattagcaaatcaaatctcataatacacgaaatggataagacattatagatatatatatatatatattcatgcactgtatacatttcagtcaatgatagaccatatatatgacagtgatttagtaaggttatagtactatattttcaccatggaatactacacagccataaagaagaataaaatcacgtcctctgcagcaacatggatgcagctgaaggccattatcctaagcgaatcaacgcagaaatagaaaaccaaacaccacaagttctcacatacacatgggagcaaaacatggggtgcacacggatataaagatgggaaaagcagaaactggggactacaagaacggggagggaatggacaagggttgaaaaattatcgattgggtactatgctcactacctgggtgacagggttcaattgtaccccaaacctcagcatcatgcaatatacccttgtaacaaatgtgcacacaccctccaaatctcaactaaaagttgaaaaaaattaccatatttttactgtatcttttctatgtttagatacacaaatacttagtgtgttataactgcctacggtattcagtaaagtaacctgttataatccaagagaaaaatgtcacagcattctgtggcgccatttacgtactgaagtttcatctaagaggtttatattttggccaatggaaatatcagcgaacaagaatagtcaccgaccaaaaggggcttgctgcccgatgaactagaagtcaatactataataccaggtgttgagaaaagaaaagctttttattgcaaggtgacccacaagaagacaggagtccagctcaaatctgtctccctatgctggctttaaggtagttattagaaaaggtttgggggcggattctgggattagtgggtgattggtggaaggaaatggggaggtctcccaagtccttaggcatgcatagttacctcttcatgctacctcacagatcatgtgtgaaaatccggggggagttagtataaaatatgtggtggaaatttgggctgtaacatcaccaagttagttctgtgcagacttgagttggccatattcattccaaccagttttagccagttttgtgttatcttacaagtggagagattttcagtgtttcagcaagttgcttcttttttaatctgtcatcctgaaaacaagattttctcttagtcatttgttcctttcactctttggggccacagttttcactaacattttggaagtaacaagttaaaggacatccctgaccctatttttgaacagttttttttaacccatatttctgcagcatttctgatggcaaatcaagagttatgattgcctaatgagtctgacttaacaatacaatagtcctcccttatccacagtttcactctctacagtttcagttacctgcggtcaatcatggtctgaactattaaatggaaaactccagaaacaaacaactcataagttttaaattgcacaccattctgagtagcatgataaaatctctcaacattctgtgccatcctgcccaggaggtgaatgtccttttgtccagcatatccacactatagatgctacttgcctgttagtcacttagtagctgaaccagttatcagatcaaaaatatatagtctatggctgggcgcatggtggctcacgcctgtaatcccagcagtttgggaggccaaggtgggcggatcacttgaggtcagaagtacaagaccagtctggccaacttggtgaaatcccgtttctactaaaatttaaaacaattagccaggagtggtggcacacgcctgtagtcccagctactccggaggttgaggcacaagaattgcttgaacccggtagacagaggttgcagtgaaccaagactgcacccctgcactcagcctgggtgacagagtgagactccatctcaaaaaaaaaaaaaagagctaaagctaattaaagataaagtaaaaaaaaattaaaaaatatatatatatatgtatatatagagagagtatatatagggttcaatattacccacagtttcaggtattcagtgggggtcttggaaaatatgccctgcagataaaaggggactactataatatgaaagattaggaatggattcccctttaaattttcttgtatgttccttctagaaataaaagaccaatcaaatgagaaaagtaaaatctacttggcccgagtttgctatagcaagggagtcagacaccctcacttgtgtattgacagagactcaaagccaggcagaggagtgggaaagctttacagtgagaaaaagggaaggcttcaggcgtttcctgattgggggctgctggcctggggaagctgtaggagggttcattagaaacgcggcaccctatttgattagtaggtggtgcatatttagctttctctggttcgtcctaagttggaagtgaagaaaaaaattaggggggctgtcggttattaatcaaattctgaccatttggggctgttacagcagttattgcatagctttgtgtattgtctctagagatagcaacctgacttcctataagtctgacataacaggctggtttcctggtctgtttattttagataaagggctggttttctgggcagactgctgtaaattttgagtcaaagttctatttttatttatggtctgaccattatctcttcgtatatttagtttctcaactttcacaggaaaaaacaaaacaatatattgttcaaaaacagactattttcacaataaaaagttattgcttttgtatcttaacacgacaatgtaagtatcatttcttttttttttttttaatcagttgagttttgtctatataaacaaattttcctactggggaggtggagacgtgtgggaagagacctcacatcaaaacctcctaacgatgtgactgccacttgaggaaaagtcacaatggtgctcctctgaaacagaatgttctgtgtggttggtgcagaattctctggggacacccctcccttgggttttgacatgtgaaccctcctcagtcaccactaggtacacaaagcgtccttgccaaaaatgcaagacagctctacaaaccttttgtttcaataaggaagaaatgtgtttcaaaagattcgacttgatagctaacccagaatttcttatgaaaggctagtttgtatcaaataaacaaatacaacttacacttgcaaatctaaatataagagtgtctttaaacaaatatgaagaacacttaactttttttttttctttttgagatggagtctcactctgtcacccaggttggagtgcagtgatgcaatctcagcttgctgcaacctctgcctcccaggctcaagtgattctcctgcctcagcctcctgggactacacacacccaccaccacacccggttaatttttgcatttttagtagagatggggttttaccatattggccaggctggtcttgaactcctgaccccaagtgatccacctgccttggcctcccaaagtgctggaattacaggcatgagccactgcacctgaacaagaacacttaactttaaaaggagaaacactgcttttttctaggaattaaaaatccagataagctttgcagaaataacattttggactgaattggtccacagaaagtacacagtccaggcctctgatataacagatgaggataccagggtatggggcttggaatatagaatgtgctcaaactagaactgacccatgactgaatggatgcttcaatattcccaaagttcacatggctaatagaaagagttttactaaatttcaacatgacagaactcaactgacagttttttgggcacgaagtaccaattatccaaaataaactcaatagtccacatgctcatgatctcccagtctaccgggtcaaacatccaaagagcaaatatacttataaagtaattattatatacaataataaattccaaatgaaaaatgacttggaaatactgcaataggagtatgtacgaagcacaacatgctgagaaggagcctgtaggttagccttctggggaagagaagggttagcctaagctcggtactgataactagggtctatcaattaaggcatattatgaggaaacctcagcactagtgaaacccgagagtaaaagccacttccactgcccccttccaggaacagaaaccgaaacataacatcagaaaatttccaatcaccaccccactcccaaatacacgtagagtgattattccagttctctgaactggggagggcgcatctttagcctagacgcccctctgggtgactaatgacaggtgagcacattgaacaaggtgactcctaagacaaggctgtatgtagccaacatcttgagagcaatctgaagttggagattttactacagccaaggagaaaacggagaaaaatacttgagaaatgtgttagctgtgttgttattcttaataaacggtaacgctggtcaacgacctgaacactgcagtgggcccaggtcaagcttgacaacatgtaaattttgccctctctgcccaatgcctctccagggctcccagccccaacgtctctctgattacagccccagtgagacccaccttcgcttcctctagagattgaatggcccctacatcctccaggccttcctgaagctcaaaaatgtccaaggtcccatccttgttatagtccaggtaccaaaagagatctccgtagagggagtccatcgaggatgtctccctcgcagctccgcggcctgagtgagccccagcggggtggaagtgcgaccgacgaacgggatctctgcccaccacacacgtccagtgggaagaggcctaagacagcatcctcctcaggggcgccaaacacaatgcaccttcatcggttaaagctctggaaggagagggctcatcct

SEQ ID NO: 2145 - DNA, 102488 bp, Homo sapiens
tagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagttagtatttttgtcaccttattttctccaccagtctcgtgaggtctttgcaagagtcacaggattttcctcttccgacttagtcatggggggagggaaaataataaacattttaatacagaaattcttagcggtagaatggaagtggcttggtagtaagtgcatagcacgttcctgaccctaaagcctgtgcagtgggcactccgctttttaactcgagtcctagacactgttcccaggactttgttcccggtgctgtttgtggggagggggatgttttcagggatactgccagaacaacgtgaattgcttctgtttataatattgtcattgcaagatattcctgaccatccttccagtttggtagaactaattcattagatatataagtagagattagttgtgcagtcctagtaattgaggagaaacaactgcccacagcagtcccaggttgactcagcaattctttagtaatcacatgagctgaggccttatccctcctctctctccccactccattcccatcctatcttcatctcttgcagtcacaaggttagtcatggcccttcctgaactctgcctgtcttgtgtactggtggaaatcattttcctaagaaaccctagattcctggagctgcagtagtgggaggtgggaaggaaaggaaaggaaattagtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttaggtgagtcttcatattttagcatcaaatttttttttccattttgataatatacggagaagtagagagatagattccagaagctgctattatacaatttctagttagttatttctggggttttagcatttttcttgttattcttgttgctagtgtgtaccttggagggctactacatagcttcttaaatacacagaagtgtgactagtttttaaaaatgggaacttgatccacatttcatttataatgaaatatgacacttaagagtggcatattcattgtatctccttggccaaagtgaatcaaagccatgcagattaacttccaaatagcaattttgtgagtgcaaatacaacacataatcttttcattcctcgctgtctctttgtattgttaagtagtcttatttcactttcagaggccagacatgtgttttgtgcctgttcttttttatgtttcaggacttagcttgtaggccagtttgcccaaaatagaagacaatcctggatattctgtgctttcatagtactttgtatattcattctgttattataattgttacaatgatatgtttggaaattaatgttcccactaaactgaaatcctttacaactggaggtcaaggcaggcggatcactggaacccacgagtttgagaccaacctgggcaagatggtgaaaccccatctctgcccaaaatacaaaaattagcctggtatggtggagtgcgcctgtagtcctagctacttgggaggactgcttgagcctgagaggttgaggctgcagtgagccatgattgggctactgcactctagcctgggtgacagagtgagatcctgtctaaaaaatttaaaaaatagaaaaatcctttataactggaccttattcttagcatctagcaccacatggctaatagaatgaattaacaaattggctttgtcagtagaagcagatctatttactaggaaatttaaaatgcctagggagtctcttttatgtttatttcctgcttttattccaaattttttgataagcaaagcaacttttaagtaacccaacttgcttttattatggaatgtactcacaaactttcattatttttaaaattaaaaactatatgtgacaccttaagcaagacatagtcagaggactttttttttgattctctttgaaaaatcataatttatgcaccagggtcttacatgcagatatatactgctgaatgtgtgctcacccagtcatagcaaccatcatttttggtgatgctaaagtgttattttgtgaagttcctgatgtcagtttaatgacatttgtacttttacctctcaattttatttattaacaagtattaactggaccacagagagaaaatttcttcaatgactggggcagttcactggggatagctgtatagaagcttgtcctgctggtgtcttcctaaaaatgaataggaaattatctaagttttttctttcacactgttggtgagaggacctcaatcattacattgtttgcacatttttcaaattgcatcattagaggtgtgttaactacattattttaatttagtttggtttggagagtgtgtgcgtttaatagatgctagaaaatacagcctaaataaatcttaagtacaccttaataagatgaaggtatgataaggaggtcaatatcactggaagtagagggaggaagggaaaaagagaagacaatgagattgcataagtaaaacttctgtttagacttaaaataagaagaaaaccagtcataaaaaggaaatattacaagattatttaatggctgattcagcagtcagcagacaagactgcaaaatgaggaagtttgcttgtatttttaaaaaagtttggtttttatttttttttattttaaaatcagtatattttcatttaaataaaattggtaaatacaaaaaagtagaaaagtatcttcttaatttccttaatgaacataattctgctactcagagatagttcctgtgaatatttgactgttaagcaatttgtttttgtaatgagacaccatacaaaagacaaacttttgggaggttttgaccaggtgttcttttatgttttagcttcttgctgctgacagttgctctcctggcttcttactcagtccatcttctgcttagtatgtgtattcagacaggtgagtaaaaatgttatgctgcttcatttaataaaggagtctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattatagaagtgcttttctaagattttccttttgtcattaacaaatattctatgttcatcagtcctggtctttttatctgtctagtctcttttgtctttggattaggtcagctttgatgccaaaatcatgggtttaattcttatatggatgagttcgttttgctttatctggccttgtgatgttcagattttaagaagaaaagtagatacacaaaatagataaaaatggatttcttaattcatttagtgtttctataaaagaatacctgaggctgcataatttataaataaaagaggtttattttgctcatagttctacaggctctgcaagaagcatggcccttcttatgaggggcttttctgctccatctgcatctagtaaggggctcaggctgctttcattcattgtggaaggtgaaggggagctaggatatgcagagatcacatggcaagagaggaagcgagagaggaggggcatgccaggttctttttaacaaccagctctcatgaaactaataaaagtgaaaactcactcattaccccaaggaaggcaccaagccattcatgagggatctggccccagggcccaaacacctcccctttggccctacctccaacactggggatctgatttcaacatgagatttggaggggtctgacaaaccaaactatatcagtgagactattctgtgctgaaacaggtgagtgaagcccagtgatgtttcttaagaattttaagactcttcagaataattctgaagccactgctctagtttgttttcctaaaacctgtccatcatcagaaatactcatagatctttttatacacagagagctctaagcctcagggattctaatttcaaaaatctgaggtgagactcaagaatatgtttttaacaaggcaaaaccagtttaggatccatagtttatagctctaacttgtaccagtgctttggccagccagtgccagatatgtttttaacaagtcctccaagtgattcttatgcaaatctagtttaggattcatagtttatagccacaacttctaacagtgctttggccatccagtgcacgcctttgctctcaaggggcttgggtgaatgtgcagacagatgaaaatactaggaagcagtacaaatattaatcctaaagtaacaggttgttcataaaagcatcctgaatttaggaataatagctttagataaatatatttgtaaatcctgctgaaacttgaattttaattgcatgtattgaaattttgctgaatgtgaaaaaaattttacttaattgtgatactttaacatcttggtagattctttcaattcattctgttaaaagattaatactttagtcaactatgtggcaattatgtctttcaagcttcattttaaaacttcattttagttttaatttaagtaaaatgttttatttcggttatgtgggagtagtattcagtgtgtggagatttctaagtaattttaattttttactccttcggttcacatgtatttaactttaagattctgacactgtgtttgttcttttctgtaactctggggcgtatgaagtgaatatatctgtttctcttcttttttctttttctttgatttctgtagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactggggcaaaaatccctaaagattgcagggtgttgtacacactactatctcagaaatagttggttcgttgccattcttttggaatacttctcatgctctgatactaaacccacagctcccctccactggcttccatgtcactgtcaactggagagagtgagagtcctagaactctgcatacctctggccgaaccacaactccctagtcgttgatccctactactcactggattgtcaccattatttgccttgagaccatttggattatgacattataccatctatctcaatttgtgttagtcatttcaagtatattaggttatctttcatttctcagactcatcccatatggctgtcatctgtttctgacctcgtcttccactgctctctaactcctgaaacccttccactgtgctctctggaactcacagtcaatcatcagcaaaactcacatgtctctaattctcttctgaacatttctgtctgtttcttacactacgagaacctcctctgaggcttccctgtagttctctcaagtggtcagtcttttctctttatgtctctcatactaatttgaagatggtataggtgtcctgtttgtcccacatttctgcttctcaaccatcttcctctccttgaaccccccagcttttaatctcatgaatgtataccatctacggctctccttactattgtcatctatagactcctagaccatttcctgtcatttcatgaaagttttagctaaattttagcttctactcaccttttagttctcttcagtattacccctgttataattctggatgatttcaatatgcatgtagctaatccttctaatgctttcagttcctgaacctcttcttctctaatgatcatattctctacctacactggccacttattttctcctatggtcataccactgatcttgtcattaccaaaatagcatttgttagtatctgcccatctgccaccaccatctcctttgtttctaactcaccctctcaagtacttcaactctgacagttttcacccctaccaagacttctatcaattcattgattctaccacctttgcactgaccccccacactcattcttacttccctctttatccagttgaggttttgtagtatgttatttaatcccttgcctatcccttgaaccatcatatttccctggtaaaattccaaccatagttaaatataactctgcctgcttcacatttgcacccatgcatttgaatcttcctgaggaaaagcacaaccatgcagactgatatcactataattcaacgtctagtgtacctatgatgctatcacacaattctggttcacttctttggttcatcacttcatttagctcattcatctgctatctaggagattgcttttttatatcttctcctgtcaaaccttcgacacttttttctttgatttcacccataactgatattcttcgctttctgtttcactgaaaaaatagaagcaatcataaaagaattttataagctcttgccaccacttatttatctgtgcctatatactctgttccttgggatgaattctttgtgtttatttctaaggcctaccccccaacttgtgctatgatcccacctgctcttgcctacatcactccagccactttctcccttctttcttatttcttggcccttttctaccatttccttcctatcattttacaaatagtctaatttctgtcatcataaaaatctcttttactttgcatcttttgaatatgcctcatgtcttcatgacagcactccttaaaataattgtctaaaccaggccaggtgtggtgtctcatgcccgtaatcctagcacttcgggaggcagacccaggaggatcacttgaagtcaggagtttgagaccagcctgggcaacatggtgaaaccccatctctacaaaaaaaaatacaaaaatttgtgtgaggtgacatgagcctgtagtcctagctactggggcagctgaggcaggagaatcacttgagccagggaggcagaggttgcagtgagctgagatcatgctgttgcacttcagcctgggggacgggagtgaaaccctgtctccaaaaagaaaaagaattatctaaaccagatgtctccagttcctctcctcccactcctatcaggcttttccactgaaactgttgtagcagtgacttccacattgctaaatccaatgatcagttctcagtcagcagcatgtgacagagctgataactccttgctctctgaaagacaagtcacgctttcctagttcttcctgtttcatcaaacactccttttctcttctgttgaattctcttaatctccccatcctctaaacattggtgtacccctgggactattcctctgatctcttttcttttcccttcttttcttttttttttgagacagagtctcactctgtcacccaggctggaatgcaatggtgtgattttggctcactgtaacctccgtcctgcagggttcaagcgattctcctgcctcagccgtctgagtaggtgggattatagatgtgtgccaccacacccagataagttttgtatttttagtagaaacagggttttgccatgttggccaggctggtctcaaacttctggcttcaagtgatccacccaccttgtcctcccaaagtgctgggattacaggtgtgagtgatctcttttcttttacactcattatcgggctcatggtgattctgaaatttatatccctggcctggaactctcccctgaatttcagtctcatctccagctgcctccgtgacatctccacttggatgtctaacagctcagatttgtaaaactccccatctttatactaccaatctacactttctactgttcccatctaagtaaatggtaatgtctttcttctaattgcttaggccaaagatctttaagttattctgtatctcccctttttcccctcatcctgcatgttcagtccatgccatactgttcccttcacttcaaaaaaaattttttttcgagatagtgtcttgctgtgtggcccaggctggaatgtagtggcgtgaacatagctcactgcagcctcgacctcctgcctcagcctcccgggtagctggtaatcacaggcacacatcaccatgcacgtcaccacacctaactaacctcagcctcctgagcagctggtactacaggctatgtgcgtcaccacacctggctcattttttaattttttgcagagatgggctcttaccacgatgcctaggctgttttccaacaccagctcaagcaatcctcctgccttgacctcccagagtgcttgggattacaggcatgagccatcgtgcctggccaaaaaattaataatctgataattttctcatttaattgctaccacccatcttcagttactattaccaccatcaaaagtaatagtttatctttttgtttttacttccactcttacttcctgcagtctattcttaacaaaacaaccataatgatctgttaatgtaagttaggtcatagcattcctttgctcaaaatcctccagttgcttcccagttcaatcaaagtaaaagcaaaaatcattacaaagtccaacacaagtcttctgccctttttatctccttgatttatcttccagtactccctcactggtttcagtcacacttttaatttttatcttatgtaacatatacttatatagcacttagcatcattctaaggactttatgaatatgaatattcatttaatcttcataataatattatgaggtacgtatcaatattatttccattttttgaaatgaggtaactgtggcacagagaggttaaagtaacttgtccaagagaggtgaaagtaacttcccagttaggaagtataggagccaggattcaaacccacacagtctggctctaaaattgtgctcactcttccccagtcgtgctgggtagtctcctgcttccatacctttgtgctttctgtgctcttcttggacgtttcttcccccagtttcccacatgactttgctcactcatcaccttcaaggctttgacaaatcttacctcttctgtgaggtctttttatacaatctcatttaaaattacaaacagcaacggttgatctacagtgtcatcaaggaaggaggatctacctttctgttccattattcttgtgtgtgccttccccatccttgaggtctaggacgacttgtggagtgcagacatcgcatccgtgttctagagagcagaaagagagaaagggatgcctaccagctgaatctcacttaagactccattttcttgttgccagaacttaatatgcccgatggccatactaaattgcatagggacctagaaaatgtagcgtttattaaaggtggcaatgagcccaactaaaagtcagggttctgttactcaggtagaagaagggaagagacaaccagcagtctctaccccaccagggttccatctttatccgtacttgtactttactatctttgaataacattataaacttttatagcttagctaccaaaaataggttgacgactctcatccatgctgccgaaacatatcagctacctctgatattggagatctccatttagatgttccagaggctttgtgagctcaacgtgtttaaaattaaacttatctttcatctttaatggctcaaatgtgctcctcttcctgtaccgtacctccgtgaatggtaccaccagtttatatctccttcacctcgtacattcacccagttataaattaattttgtaaatatttctcggatctgcctaattctccttccttattgctactgtgtagatcacgccataacccctccccaggattacagtagagttaaatcataacaggtatttaagttcatgtcattttaattcatacagttcaaaagtggggaagaaaataactttaaatagtgctgggtaatcctgcctgtattctactcagtgaacatatattcatctggggactgagtgtgaggtgggaaatataataatgttgctccctctgttatattttttttctttaaagataacttttttttttttaagacaaagtctcgctctgttgtccaggatggagtgcagtggcgcgatctagccaaaccgcaacctccgcctcctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagccaagtatcaccagatatttcaggaaaacctttaatgtgaaagatatatactaaaacagccacatacacacacacaagccaataatgagatacctctacacatgtattagaatgacaaaaatctgaaacactgacaataccaaatactggcgaggatgtgggacaacaggaactctcattcattgctggtgggaataagaaatggtacagctactttggaatacagtttggcagttttttaaccaaactaaatataatctcatcataggatccatcagtagtgctccttggtatttacccaaatgagttcaagacatatttctacacaaaaacctccataaagatgttaataacagccttatatttaccaaaatctggaagcaactaaaatgttcctcagaagtgaaagaattttaaaaactgatatatttgtacaatgggatattattcagcactaagtagaaatgaggtgccggagccttggctcacgcctgtaatcccagcactttgggaggccaaggcgggcggatcacctgaggttgggagatcgagaccaacctgaccaacatggggaaaccctgtctctactaaaaatacaaaattacctgggcgtggtgctgcatgcctgtaatcccagctactcaggaggctgaggcaggagaatcgcttgaacccgggagttggaggttgcggtgagctgagatcaagccattgcactccagcctgagcaacaagagcaaaactccgtctcagaaaaaaattagctgggcatgatggcgggcacctgtaatcccagctagttgggaggctgaagcaggagaatcgcttgaaccccggaggcggagactgcagtgagctgagatcatgccattgcactccagcctgggcgacaagagcaaaacctcgtctcaaaaaaaaaaaaaaaaatacccagcatggtggctcacgcctgtactcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattccaagtatgtgacattctggaaaaggcaaaactatgcagaaaataaaaaagatcagtggttgccagagtttagcagagggagcgtgaataggcagagcaccctcacctttaggacagtgaaatgaatctgtatgatactataaagtggacacgtgtcattatatatttgtcaaaacccatagaatgtacagcactaaaagtgaaccctataatgtaaattatggactttgtgtgataatgacatgttaatatagatacattgattgtaacaaatgtaccactctggtgcaggatgttgattgtaggggaagctgtgcatgtgttgggggcaggaggtatatgggaactctgtactttctgttcaactttgttgtgaacctaaaactgctcctaaaattattaaagaaaacacaaggaaagaaacagactcagaggaaaagaggaaacagacaatacaagaccagatgaaaacttaaaaagctacatttaataactttagagaactaaaagaagatcctgcattcttgaaacaaaaataaggaattataaaaagggtatattcagaaaaccaaaagtcctagaagtcaaaattagttcaattgttgggttgggagagttacagaagtttcctgggggtggaaaaaaagagaaagcttgaaaatgggagagaaaagataagaaaattagaagatcagtccaggaagtccaacatgcaaataatagaaattctgcaacaagaaaaaagtaaaagggatggtagaaaattattaacaaaataatacaaaaattgatgtaactgaaggaaattagtttcaagattaaaagttttcctcccggtatccagtataatacttgtaagataattgttacccaagacatactgtgaatgatcagaaatccagttatatagataatattctaaaagcttacagagagaaggaacaaacaacacaaaaaaaattcctgcaaagaatcaagaaccacagtagtgaaagtcttcctaggagcaatactgtaaactagatgactataaaacaatgccttcaaaattcctggggggaaatgattttaatatagaattctataactagccaaactgttgcttaagtgtgaagtttgaacaatgacattttcatatatacaaggtctcaaaaatttttattcacccttacttagtgaacaatagagtataccctttaccaaagttagagagtaacaaagaaacaaggaatcaggcacaggaaagaagtggagggaattcccaggacataactaagcagcagatctaagcaccatctacagattggagttgtgaggttttttgtggttttgggagggggtgtttagatgggatctcactctgctgcccaggctggagtgcagtggtgtaatcttggctcactgcaacctccacctcccaggctcaagtgatcctcccacctcagcctcctgagtagcttcccacctcagcctcctgagtagctgggactacaggtgtgcaccaccacacctggctaatttttgtactttttgtagagatggggtttcaccatgttggtcaggctgatctgaaactcctaagctccagcgatttgcccacctcagcttcccaaagtactgggattatagatgtgagccactgcctggctggagttgttcttttcacaaaggcacagtcctcgctccaggtcatgcctgccctctggattgtgttcaggatggaaactcttttcttattcctctgagtaaagggattgtctttctcatttgtcggtctaactcttaatttgtgttaacagtgcttgagtagattagcagtcaggccgggctgttaaaaaagtcagaataaaatagggattgaaccaaggtagtaataaggtgaataaaagaaagaaacaggttaacaaatggtggggtgcagcagagttccagttgagaggagctgatatctgagtaaatgtggacaataaaggagaagtagatgtctggtgtatctcccaggtttccggcttgagccactggattaatgatagtgtcatcaatgaagataggaacacagtaggaggaggttgttcaaaataaaaatgagttcagttttagacttatatgtaggtggacaaggcttagaactgaagcacaggctagaaattcattcattcaatactcttgtctactaataagaaagagataaataagagccagttacttccctgaaaaagctcatagtctaataggggaaacaaatacataagcaaataatttatatctagtatgataaatttaacagtttaaatatgtataaggcatagtgatatcttagaagagagagtgactttgatatgggcaggaggcagggaaatactgggtagaagagggtggttccccagcaaaggcccccaccccccaagcctggaaacccatggccctaattgggaacaggcatttctgttttcatgtccaaatgttgccttctgcctgccatccccgcatcctgtacccatataaaccccaaattccaggtccacaggcaggagagcagacaaacagaggagcagaagaggagcacagtaaaggagagaagagaaggagtgtttgaacgtcaaggagaggtcggttggggacagctggagaggagattggccatgggacagcagaactccaggggaagatcatcttcccactccatcccctttccagctccccatccatctcactgagagccacctccatcacctaatacaattcccacattcaccatccttcaaatccgtctgtgacctgattcttcctggacacaggaaaagaatctgggtacgaagagggcactgggctggttaatacttaagcaatctgtggaaggcagagctaaaagagcactgtagcatgcccactggggcttcaggagttgcaggcatgtattcctagatgctgctgtggggctggagcccaaaagcgctctccccgccccctacacctgccggtctgcgagctccgcctcctgtaaggggtttgagagtgcagcagccgaacagaacagacaagccacagccctgtcgcaggccctgcccttcgtgggggatcaggggactctcccgtttcaactttcccttagttggagggtgagggtcagtaaatgttcatggacaactaagctgaaaaggaatttgactagcagacaaggcaagagagaatattccagcatgtgcaaggatacaaagccatatactacctattgtattcaaagtaccaaaaatagtttactgttattagtagtacataaagtacaaaggagaaaattaaactggagagttagacaagtctcagatcccaaggaatttgtagtttttgctgaagcagtgagaagccactgaggttgttgaaaaagagtcaaagtagatactggaatccactgttggttgcttccaaaaagaattttggtcctttctagtgcccagaacataatctctttctctggcaaagaaaacgtagtcttctgtcttccttttcctaaagaaggttacaattattttatgaagattgtaattttgagtaatgataatggaataaagaaggagtgaaatggcctttgtgtgctcctcattttttttcttttttaaggcaaaaaggttttaaaaccctctggagcactgattctgaataccttctttttataacattttctaaatgctccctttactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaagccatgaagtttgtgataatttcttacagcagccttaggaaactaatacactacttacataatataatgccataacaatgaaataaagaagacacaaaaagtaaatgttagtgatgtgactttccatttaggaaacaattttttgcaaagttccaaacaaaacaaattatagtcttttctgcatttacatggtaattgtatttctggaaaatttaatatatattcaaaccattaaccaatgtttgtagcatctgccatgtgcttgacacacagagagtatttaataaaagctggatacatgggtgatgaatagatggatgtattaaagctacaaagagagtacataagttccaaaataaacatgcaaggcaaaaattatgtgtagtcaaacgtatctttaaaaattcttgggcaggcccagtggctcacgcctataatcccagcactttgggaggacaaggcaggtggatcacgaggtcaggagttcgtgaccagtagcctgcccaacatggcgaaacccatctctactaaaactacaaaaaattagccgggcgtgatggcgggcgcctgtaatcccagctactcgggagcccgagtcaggagaatcgcttgaacccgagatgcagaggttgcaataagctgagattgccaccactgcattccagcctgggcgacaagagtgaaactccacttccaagggaaaaaaaaaattctttacatagcttatcaaatacagtgttcaatatctacatgacgtactggacactgacacataccatttctcaataaagagctgacagccctctctccccattccctcagcatcgtttgggtatcttatgaaggacatgagttgttttagggatgtaatgaattccattcagcactatgaggtactctcaccgacaatcacagaagaattaaaactgactgaaaggcaatagatatgtttcccatttcaaagctcactgtggacattttcttatggtttggaatggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgacaatatttactttctgttttataattatatttgtttgtttttatccataggttgaagccaaaagttgaaaactattaccatttataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctgggctctttactatgaccagagtttattaattgtcctatttcattgaggaaaaaatgcaaaacagaacactggaatgactagctggaaatattccactatttcatgggaagcaggtttctaaacgattcctgtggaggccaaactcttgctctcgccaaaatattatagcattaaagtgtgccttgatggtacattaaggaagaaattttccccgaatttacttaagatttatagcctttctgctctcacaaaacgtagcattgatttctttaatatcaaaaaaagtttcctaaaataaactgctaatgattgctttcagtcatttgtttacttgaggtcagtcatgccaagtactgtttgtatcaattcttgtaaaagactcaattaattttgtaattgtcataattactgttattcctgttctgtaggaatatgctattaatgtaactggacatcaccacatcttatttttgtatctctcaaaacatctttcataaaactttgatggtaggaaagagctgaaaaaaaatctcctgttagtagaccaagtagtacttcaattactaaacaccagagaaaattaaaattacaccttaaataaaaccaaccagatatttggtagagaaaatggaactgtacaaaaatatggtttttaaaaataaaattctaccacttgtattatattcattatagactattggaaaccgttccctgccaaaaaaagaaagaaaaagaaaaaagtttgtgaccatttgtaattcattttagtctttttatgtatttttttcacctaaaataatatgggcatttaaatattttaaatatagttttaaatggctacatattattctatcaaaaatacctaccataatttatgtaaccactttctcattgttgagcatttaggttagttttgtttttccagttgaaacaataccccctgagtatctttgcatataatgatttctcttgattttagttttaagacaagctcttaggggtcaaatgttttaaatattttaaaggttcattgttcaaattgcatttcaacagtcaataccagtttacactgttttcagcattttaagaaattgcccaaatgacagagcagaattttaaaagtatttccctagtgttgatttggtttatatgctgagatgctgcagattttttgttgttaaaaagtgagtatgtggagatcaaacatttggctgactgtgtacacattttatttagtaaagcctcaatgttaagcaagaagccattactcatattcatgttgtctcaggaatggaaaagtgcttctaatttttgcaacaaaagaagtctgatggcagtgacagaaaggaatgactagctagatatgctgaccggaaagctagaattaggatttgaccattgtagtcagtctccatttaagagcctaatggttttttcttctcaatttggaagtttgctgcatttagagatattcttataaaactaaaaaaaatagacccagggagcaagtttgaggttactaaaatgtatcccattattgtcagagttgcatttcaaactgtcttcattaaactgttagtttgattacattttctcaaacagtaactgttgtgttttaattttttaaattaaaaataagttttaaatttcaggtaattgaaagaccaattctttttggaatctttcagtattatggttttggttcacagcgaaggtatttgcttgctacatttgctaaatatactatctatacttcattttgttgcataaaaataagacatactccggttagcctttttgatgggtattaccttgatgacttgctcactgacagagaaactgatgtaaaataggtcatttgaaaagcaggtgtttgatatatccccatatgtaacactgaaaagccttcttgctctagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccatgatcaagtgggcttcatccctaggatgcaaggctggttcaatatacgcaaatcaataaatgtaatccagcatataaacagaaccaaagacaaaaaccacatgtttatctcaatagatgcagaaaaggcctttgacaaagttcagcccattcatgctaaaaacaataaattaggtattgatgggacgtatctccaaattagaagagctatctatgacaaacccacagccaatatcatactgaatgggcaaaaactggaagcattccctttgaaaactggcacaagacagggatgccctctctcaccactcctattcaacatagtgttggaagttctggccagggcaatcatgcaggagaaggaaataaaggatattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaagtacctaggaatccaacttagaagggatgtgaaggacctcttcaaggagaactacaaaccactgcttaatgaaataaaagaagatacaaagaaatggaagaacattccatgctcatgggtaggaagaatcaatatcatgaaaatcgccatactgcccaaggtaatttatagattcaatgccatccccatcaagctaccaatgactttcttcacagagttggaaaaaactaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacacctatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacattagatctaaaaccataaaaaccctagaagaaaacttaggcattaccattgaggacataggcatgggcaaggacttcgtgtctaaaacatcaaaagcaatggcaacaaaagccaaaattgacaaatgagatctaattaaactaaagagcttcttcacagcaaaagaaactaccatcagagtgaacaggcaacctacaaaatgggagaaaattttcacaacctactcatctgacaaagggctaatatctagaatctacaatgaactcaaacaaatttacaggaaaaaaacaaccccatcaaaaagtgggcgaaggacatgaacagatacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaatagaaacacttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagtggattaagaaaatgtggcacatatacaccatggaatactatgcagccataaaaaatgatgagttcatgtcctttgtagggacatggatgaaattggaaatcatcattctcagcaaactatcccaaggacaaaaaaccaaacaccacatgttcttactcataggtgggaattgaacaatgagaacacatggacgcaggaaggggaacatcacactctgaggactgttgtggggtgggaggaagggagagggatagcattaggagatatacctaatgctaaatgacgagttaatgggtgcagcacaccagcgtggcacatgtatacatatgtatctaaccttcacattgtgcacatgtaccctaaaactttaataataataaaataaaataaaataaaagaacagaccagatgcagtggctcacaccagtaatcccagcactttgtgaggccaaggtaggaggatggcttgagtccaagagtttgagattaacctgggcaacatagtgaaaccctgcctatacaaaaagtaaaaaatgaaaagttagcctgggcctggtgtatttgcatgtgcctgtggtcccagcaactccaggggctgaggcaggaggattgcttgagcccagtagttcaaggctgcagtgagctgtgattgtgccagtgcactctagcttgggttacagagtaagaccctgtctcaaaaaaataagaatgtacatatttaattgtaatatgaaacggatgctgaaaatgaacaccgatataagtgacatatcagagatgctctggagacttggttcatataatatggaacaaaattaccttctcaatgccaaattagaaaatgatatgtacataattttcaggtttaaaatatatataccaaggctttgggatgttaaatataaggaatgttgcccatgtataacattatcaattaagcttaagaatattaaagatttgttgattaaaataattactaatttttgtgatagcttttactttagaatatgtgatttgaaaaaaaagaatgttgacatttcacatagttggaaaaaattctagttcttagttttgtaacttaattttatgttctaaaatatgtctcaaatccacccttgtaaaattattagtcttttattattaaagcataaagtttgctactcataaatcaaattatatatctcaaattcaaagctaaattgcccttgtgcattgtttagcagtatgtaaatacattttagaaaagggctgtatcattcatgaagtttccaaattcgttgatcaattctgataataaagttaaaatttttgttcttaattagtagatctcattattttttcagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaataggtagagaaaaataattgtcttccaccagtaatcaggagttgaacgttactgttagtgctatagtatatatattttttaatttctgaagaactactatacttctaaaattcatattcattttggctccaaacaggaattcttttgtttgtaaatctgttgtttgtgtttttatgttttcgattgacaaatacaaattgtatatatttattatggacaacatgtcattttgaaatatgtaaacattgtagaatggctaaattgacctaattaatatttgcattacttcacatacttaccattttttgttttatttttattctaaaaggatactctatctgtaactggctaaactaacttctgaaagtgagtctggaggaaatatatatagctatacaatggaaagaaaacctgtatttacattccagttaactttggtggagttttttgtttttgttttttcagacagagtttcgctcttgttgcccaggctggagtgaaatggcatgatctcagctcaccacaacctccgcctccctggttcaagcgattctcctgcctcagcctcctaagtagctaggattacaggcatgtgtcaccaggcctggctaattttgtatttttagtagagacagatttctctatgttggtcaggctggtctgggcctcccgacctcaggtgatccacctgcctcggcctcccaacgtgctgggattacagcgttagccaccgcgcccggccctaactttgtttttaaagtacaaaaaggaatgcttaaatcatatactatatagcatcatggcttggaccttagtcacctgaaacttaaacaaaacagaatatgttacttgagggtaaaaggttttgttaatcttccttagtagcaatgtttctgttctagaggattaggatgtttggtgtagccagggatcagtttcctccatctagtttaaacaaagaagaaaatattttttgtatgagaaaattccacaattaatataacataacctataaacataactctaagtatcaacactgacatcactgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcatatctgattaccttgagttccccaggaatctcatcaaagatgataagctaacaagcctacagactgaatttagtcctcaggcacattttatatggctcaaatattttttatttttaactgattaccaactaagcatcattaaagtatgaaaaaatttcatttctgactttctttgaaaaatcagatctggctacattggatccacattctcacatattatcaactggccagagctgagtagcacctgccccattgaagggggaggaattctccaatatcctacagttcttgccaactcccattgtcttatattcagcttaattcacattattgagtttggaacattttgcctatattttcagggtttgagagtaattgggctctagactttattaatctctgggactgggatgctcaaagtctgggatgctgatatagtcagaaaacttatatcatttccttttaggcaatatagcattggcatagcacacccagccggtctttttctacttatttaagcagtgtgataaaaccagcaagaagggaatgagacaccactcccacacttttaatttttatacttgataatcatcgattactagcttttaacacttttaacaatttaaaagtgactgccaagaaaaatttcaaaaacttctttatagtaactttggaactattaaagaaatactttttaatgtgatgattattaattttatgtatttcaaatgactggcagatttctttttagtttctcctcacaacttctgcatctgcttttttagtaatagttactggattttaataaaatactgatccttttatattgtttccccttctatcttctgaatatttctgttcttttacagttggtggtggcaggcaccataataattcagaatattggaggtaagcaattgcaagtgcactgtttatacataaatgtgatggcaataatgtcctttgaattgttatcttactacagatctagctgggaacttctgtagacatagctatcttcagaagcctgtgtgttggcctctttactctttttttttttggatcctttttagcagcacttgtgacagtagcttctaaattcagtttgagctaaaccctgattgcagtcgtgttattaggtctgcaacacacctctaaaacattggctttctgtgattctgaaggtaggatacagtctggaaaagctctcctggtgattttaaaatattttccctctacttttgttctaatcaccctattggcagatactactttagagggattagtgttccgtgggctgtgaacaagcaagtatggacaacagtgtcctcttgtaaccaagaatttaaaatgaccaagtggtttaaaacataaataaatctgagataaataagcattctcacatttatcctgtatcttgttcctattaataaccaattctagaaatgatctcaatattgagaactatgtagaaataaaactactgttaattatagacagttactgagtaaatgtattaaacatttaaatccaaaatatgggtatcatgtgtgtatatgttgtaaagaagttgcgtagtgctgaacaatatcttcgttttcttttatcattgactggagtgctaaataaatgctcttaaaggaaaatacacagaaaagtttgacatgtactttggatcttatacaggattgtatagtcagaggacattttaatcttattttttacatgtaacagtttaattcaaagatgacagttttaataaacttcagctctcataatcaagaggtctgagctatatcactttaagtattgttcaatcaaattccatcgttaataggtttttttggttaaggaaaaattgacattccaccagtgaattgtgctgccattgttttagaatcctgttttaattctttgaattttcatgaaaaaatatgaataaaaagaatgctttcttgcatgccataccaaataattttctcctaacacacactacttcacacttcacagtagaaagtcaagaaaaccagtctcttcatttatgaatttattatagtcattgattttaagatctattttggaataatttatttagcaactaagtattgcttaactgtgcactgataatgtttctgaatatgatgtatatttttatatttttaatccctctttatcctctctgtatagattctaagaactatcacatattgtttaggttagattgaaccattgtttaacagtttatgtagactgttcagttcagcaatttagatccaaatttgtgaccctggcacaaggcccactgttgtattctttgtccctttcaccttgattccttccttgttctctaatcttgtttataactgttattggagatggctatactgtagcacttggctgctactagatttaacttctctgtatgtatgctcctgtaccccactatattgttaagttcctttagctcaaaagtatgcctcatttctctttgtactcccagcacctattacacctgggaattgataaacttgttgagcagaatagagctgaaatgatttgtataatctctttctaagtaccttaaatattctagatatatttatcaagaagagaaaagggaaatgctagaccggcatctagcttcaggtatttgaaagactgaacatgaaatataaaaaagacactagactaattcaagtattgttccagagggcagaactggtgctaatgtatagaaatctacagagaagctgttttgggttttcttattcggagtacccttgtaactaagctgtgtgataatgaggatggcctacatccctttgaaaatgctccttagccctgaaaacattcaaacagagctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatatattggatatttaaaagattatattaagtgtaaatcagattgaatttttacacatcttaagtgcctgtctgcaaataatgtagttcagataacttttttttaaaagaatgtttgttagtataaattatctgacttttgcagtggttgtttacattaaaactgaaaaataatgtaatagattctatttaggtcaagcactctactagatactttaattataacaactcttcaatatagatattatcttcattttatagagaagagatcagtgtgcagtggagataagtagcttgctcacatttatcccataatgaagcttggattcaaaccttgctcagttggcctttattctttctgctatgatatagcaaatgtttgaaaaatgtgaaaagattaaatgttgaagattttctaacttcttggggacaggaactatgtgtttttatttgttttcctaactttacctagtttctgagaagagctcaataagtagtatttgttgaatgaattggacagtttttaaagttctgcttaaaagcctaagattttgcctcaaagagacaattgaatatactatgtaagtgataaaaaaagaaacttgaaagaccatagaatgacttctagtttagaattatataaaaatttaaaagttcaaaatactggggagagttagatctcatttatgtaaaatgggttaacaatatattgaaataggctgggtgtggaggcccacgcctgtaagcctagcactttgggaggccaaagtgggaggattgcctgagctcaggagtttgagaccagcctgggcaacatggtgaaacccagtctctactaaaaatacaaaaaattagccaggcttggggttgtgtgcctgtaagtcccagctactcaggtggctgaggcaggaaaatcgtttaaacccggtagacggaggttgcagtaagccaagatctcgccactgaactccaacctgggcaactgtctcaaaaataataataataataataataataatatatatatatacacacacacacacacacatatatgtaaaatatctattattttcaggttaagaaaatcatatcttaatgtttcttaactctcttattctttgtaacatttaaatacttctcagttttcatgagatacaattcctgtggtgaatccatgaaaaaaattgaaatggaaggcctttaaaagcaaaatgaccatggattgcccttgatcaatatttgtttcatgtgtctttcgccaaagacccagtttatttcccacatttccatattccataaatcaaattaatgtgctcatttatttacatccctagtacttagcacatagtatacatttagtaaataacatttattataggaagaaagaaaggactaagaggggagagggggaaaagctagtgacctggcttagtactccttcaagagcaaaaagagagttgattgaccaggaagagaaagcccagtatatgtaagtgagcatatagtttttaggaaagcgtctactgttagaacttcacagaaaatcgtttttctcccccaagattaatcaggcaccaagtattagtcacaaggctctagtgtggtctgacaaattgattgaaaaaatctactgtctgtaaatctctaaattttataatggaaaaaaatgcaacacactagatttaacactcttattctaaggttatagaaatccttggctttggaaatttgggaaccatatagtaaattactacttaaaagcaattcctgatatcttcccaatactaatgaataacaggctcaacattggctagagccagaggtaaccctctgcagcccatttcctcaggtgctggagtagcatttgttgagagccactgctactgggacccaaagtcagaaaagatgtgtctggaagttttaacatttaatgctgttataggggacaattctggcttagagagtttgaatttggcagcctaactaaagataaaagattaataactgtagtagaaagtaagtataaggtagttttcacatagttcctgtaacagtgttgtattatgtgattcttttcttaaaaactaaggtaagtagttggtttcacattcatttgaactcctgaagtaaaccattcagtaggctagaattatcactagaaatcaaacactacatcccaatcatcttcttagtcaagccagaaaaagtcttattaactcttacaagcacatgataacagtgaagtcaattgatgttatttctggtttcacaacttgcccaattcaaaatgtggaaagatgagtagctcctagggggatgttatattcttattttgctcttataaatatgaaggattactatgaatagcatatgctttccttaattcttcaaagccccagttctttaaaggagattaaaaatttaatcattactacgttttgtgaaaggaaaaccataaacattagtagtcttactgaaacctcctgaaattgctagaatgacccagatgtttcagtctggcacagaatccacacaccttactcttgcagcctttattaacacctcagtttggtaatctatggactcgggtaaccccatttctaaatctcagaaaggtataaataagatcattttcaattgagaattataaaaatctcaaattctcagtatttgaaaaattcacaatattagatgctagaaactacttggatttgctttcttcctgtatattcattcatgcattttatttatttactttttggtaggctagtaaagtactaagagtgtttcagatatactagtttgtattgtctcttgggaaactaggattgggcgcgcagatacatcgccatctgctggtcagtttatctgtggtgaaactgcagctttcttgagacttgtctagaaattctagaaagcactgccttagaataggagaggtacaggaaatttggagagtctttttcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttctggtagactttccttatttgtctttgttttgttggtttactttttcactttgctcctgcactttctcatggcatactagttaatagaacgagtttctcaacccaggcgggctgtttgcaccatcactagcttgggcaagttacttctttgtgcttccttatattctgtgaaataagtaatatgtacctcacaggtttgtgtaaagattaagtgaggaaataacttgtgtagaatactaccaagcatacagtaggcatctaaaaaacaaagatgttagctgttttcatggatctctgcccagagtcccttccctgtttctgtgtttctaacatctctcctctcaacctcccgggcccaattcatttatttcactttataattagatcagcagatattaacaccttgcaacttgctattacctaatcagattttaccccattttagtcactttttaatattactgttgcttctccatgttgtttttaaagagtgctttcaacttctgtgttttcagttgacagatgttttattttttcccagagaagtttctattaaatgagttatattagtttaaaattaagtagaaaagaatacctatttagttaatgtgctaaaactaagtgatttataatggctgaatacctgacatcaaggtatatcttctggcactgattttggctttggtggtttggggccacttaactatatgcatggctcttgtggatgacccagttgcagctattaatttagagtagaacatggtgtgtcttgttttaggaatctatactaggtgtccatgtcacccaaaatcatttgcaaatttttgcttatgattggtctgtaagataagtgcttaaacactttcttatgccatttataaaagacataagacaaaaactgtggcagacagctatttgatctagtaaaccttttagttaaaaacaaaggcaatatgagcattcctatcaatagtatatctttaaaacttttccagttcattttattgagctgattgttcttttgtatgaatttaattaagatatatttcctaacttaatgtgtatttggtaatctttttgtttcttttctgtattatatataatataatgtgttaaagtgctagctagttcttacatgaaagtttacttgtgattaagaaaaaaataattttcatagtgaatagaatggtggtggcctttgttttactggcttaatccgtgtgggttttcccctatagtaagttctgtggttgtatactcttaaaatatatactaacattctctagaaaagaagcaatgttttgcatgttttattatatttgtatcttgtatgtgaggtcttctttgagagagaaacacgtttggtgagttcatatttcttaaaatatacatgattcttcagactggaatctaatgaaatagtactcccatttgaaaaccaaagagttgagggtacaacaaaggataaaagtgatcagatgattagccaggggctaatagaaattctggaaagaatgacagatattatattagaaagaaataggatctcatattcactgaagctttctacagctaaaggtccaaaagaaataatagaaaattactgaaagagatgaatgtctgaaactttagaaatgcatgtggtgttggattaatccaagcaagaaagaaagatgggcagataataaattacattttataggaagtctgctttccttgttttcaaagtattttgtcttttttcttttctgtctctctcacaagatatatttaagtaagtctaggccggtttcagaaaattcagttcacaatttttatctttgcaccatatgtgtagagttctttggaatcggtaaaatattataaaaactccaaatccttgaatggagaaggttagtctaaaccttccttctgttctgtgccaaattgatagcatttttccttacgagaatatgaacaatacagaacacattttcacatacaatcagttgtaataccccataactaaaagattttgcagaaatgtctcagtggattttagtcaacccactgagacatagctgtacttctgctagggaaaaagaaatcgttgtaaactgaaaaaatatgtatatgtatattttcatcacagagaagtgattatttaactgttctaaattttactttgacataaatacatgttattttactaaaaaaaattgagagtgtatgtttttgtgtctatagtattatctatctccatacaaatttacacgcaaagtagcatgtatcctttttttcctcaagttaaatggtcacatagcattgtaatcatgaagttcagctcctttcaaatgatgttgattgagaaatatacattcttcttaaactatttgagccttttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccatacctattaaacttctgtgtctatgtctgttgttgctaaactaacctctaatgccttagacggagtgataacatataagagagtttttgtaaaactttgtacaaaatttcatttaaaagtagcctgtaatcaagactgtttctcttacctagtttgctttggacttgaaatgtaaacaaaagatacttaatgaacttaacaattgttattcttctctacagttacttttctgtgtgtgtgtgtgtgtgtgtgtgtgtgtgtgtgtgtatgtatctttggtatagtgtgttatatgttaatcttccatatgttgtcatagctctaatggacatctcttttcctagatggattattgtttaaatggttaagaatcatagaattctaataggaacactatttattcttttgcagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaattcttttggcttaaagagaatgtatatttagatcacagtaggaaaacaggagttctgttagatcgttctttattccccccttaggaaaaaattaaagttagtacattcttctgaaatgcttatttacaaaataaatgtatttaatatgtactttttgagatttctttttactagtttgtttttctcaggcagcagttttattttgtaagtttaataatttctgttctttagaaaatatccattgagaaacacaattcatttgtctgtgacacacatgtgaaatctaaactaattttactgtgctttactgtgttgcctttattgttaatgaatggtaaagaaaagcactgtatttaaaattggctttattaagatgaattattaaggataagaaatgattaacgataaccagtagccaagacaaggatagagaaattacattttacagtataattatttttatattaagaatttaaagttcaatcctatgaaaaggagaatgcaaagcatgatcttgaaataaatgaggtagtatctgaaagtatttccattgctactgtcaccttccttttgctgattttacagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatggaatctcctttggtactcctttgggcatttttcctcctggcactgcaactgtctgggtctaacattgggtcccagaaggaaacacatttcagacatagagccctgggccttttgccagcttcagaaatttggttgccaggtgttcctcaatgaaagatcttttgaagtttctgttttgattcttactcaagagtgactagaagataaacacgttgagtatcatttttgtattattgatatgtgtactcttttagtacttcctgcataccaggaattgaggggcatgtgcaaatggagagagcaaagcttcaggtccactaaagctgtaaatacttatgcataggttatagtttctggcatatgtatttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaaaaaaaagcaaagaaaaatcatgcataacatctctaacctagtcactgtccttttaattcttttgaatttttcgcaaaagctttcaaaactatagttaataattatatttatatcatcatcattttccattttattcattgtgttttttcttaaagccacgtaacattccattgagtatgctgttctaaatattttcaaatgttgggtatatagagttttcctccagcttctcaatattataataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctagatgacgggttgataggtgcagcataccaccatggcacatgtatacctacgtaacaagcctgcacattctgcacatgttctacggaacttaaataaaataaaaatttacaaaaagtgtatgttcttattatttttaatagtcttttataagtgttttcaagtatataattatttgaaaattctttatatctattgccaaattgctttccagaaaggtaatttatataatttgcattttcaccagctttttacacacctcatcactcctcactaatgttgactattatcttatttttaaatatttattaattcagtagttggaaatggcatctctttgtttttattcatttctaaatgtcaattcattaataagaaaaataggatcccacaagaacattttaatgaaaggaagtaggcttttcctaatagctggttgtaatggttataactctgtgtgtgtgtgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggtaagtctttatagagcacattatttgtttagaaaaaggaaagaagggagggagggaaagagagacaaatattaaggggctttaaaatttcacagtaccacatttttggcagaaggatggtggttgtgtataattttaaacttggccttattttaggttgttcagccttcagccctgcctagttaacctattacttggtttgcagtagtattttgtctgccccactaaaataaaatctttacagcggaacattaaagagcagcctttccttacagtgtaccattagtggtaagccagttccaattctgctgtacagagctacataaatgatctgtgacagatagttggaatgttgttattctgagccctaagccccagataccaaccactataatagaaaacatgcctaagatgtatagctttagttgtacgttaaaatcgctttccttataaattgctttttattttactgttattttacaggctttcttggctacacaagtagtttatcatttttctttatgatgttctttgctcttgtggtaagtttaaaatataatacattgcttatctcctcactaaaattggactcattgtgttagtcttttttacttttaactgttttgtgttgggaagggtatctcattttatttcactgtgttattaaaagcacttttgttccattaaattatttccttcattgtatctattttgaagaggcttagctagaacagcatttcaaattcagcatttcttgtggttaactagagaggagagcgtgccaattctgttaaaatcctagatggagtgtaattctttgtgtaggtgtgtaaatttattcctgtaccatactgtatgaagaatcagtctggttctaatctgtaaaatctgtttgagactagtcatcttaattttgaaactttattccattaataaaaaaacagagcttctggtactacattgaggagatctagtaagaactgggttgactgaattctattttgtctggtttattcagcatagataaattctcataaaaacactactacaaatatttttcttcacatgtgggatatattccttattttttaattagctcatttttattatataaaaatatcagatggtaaatttaacttattttgatattataaaataatataaagataagaatttaaatttatttccttctaattcttctaaaacatcttaacattctaaagatagtacctttgtgtgaaattttttaagtcttttttctttgtatagcagtttattccataatcagtatctaaatgtcaaaccttaagtagaaataaacatttttaactttccaagaatatacatgtccaaatgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttttttttttttttttgtatttttagtagagatggtgtttcaccatgttagccaggcaagtcttgaactcctgacctcaagtgatccacccacctcggcctcccaaagtgctgggattacaggcgtgagccaccgtgcccagccaccatatttattttagattctctgaatgttatcttttaaaatacatagtggttaggaaaaggaaacgtatatatattaacccagaattttggaaggataccagtttttcatttattattcttgtcaatatgtgtttgtaaatatgtatagcatttatatcatattttttaaaaatcagttcaggaactattattttcttatattctttgaataatataaactaaaacctatattttatctgttctcccagatctgtattttcattaaaaaaatttaacctaaatttttgccccctctaaaatattttgcaattttaaaaataaattatatctgtctcagaatgataccatcaagatggatttacctttttttggtaaatttactttttttttggtgtattttagagcacaagcggattaccattcgttctaaaagttctatcttaagtacagattagtattctaagcaacgttttaatacgtcggtaatccagttagacaacttttttttttaagagacagaatctcactctctccagtcacccagactggagtgcagtggcatgatcatagctcactgcagactcaaactgccgggcttaggtgattcttctgcctcagcttcctgaatcactagaactacagctgcataccaccacgcctggataatttttttttttttttttttgagatggagtctcactctgtcacccaggctggagtgcagtggcgccatctcggctcactgcaagctccgcctcccaggttcacagcattctcttgcctcagcctcacgagtagctggaaccataggcacccgccaccacgcctggctaattttttgtatttttagtagagacagggtttgaccgtgttagccaggatggtctcgatctccagacctcatgatccgcccgcctgggcctcccaaagtgctgggattacaggtgtgagccaccgcgcctggccagataaatttttttttaaatgttggtagagacagagtcccattatgttgcccaggctagccttgaactcctatgttcaagtgatcctcccaccttggcctcccaaagtgctgagattataggcgtgagccactgcactggcctgaaatagagaattatttaaatggtttttagtcagaagctttgcttctactgaacactatgttaggcattttaggatgtggaaatttaacctggacactagtcttaaggatctgtcaatctagtaggggagataaatttcttttcaaacatggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgattctgtttacttttttaggtaataattaaaaaatggtccatcccttgtcctctgacattaaattatgtagagaaaggtttccaggtaatagcttatattttcttttcagtttcttcctttttattttaactaaaaagaaaagaaagactaatgattcttttctgattgatgaaaaagtaatggctatattgcattttagaactttgttttgaaatactttcatttgaaagcctagtaataataaattcatcatttttattgatatattctgaaatttaatggctgttggtttctctttttcccctcaatgctcttaaacagatttcaaatgttacagatgattgtaagccaaagctctttcatttctccaaagaggtgtgtaagttattaacagatacttttagttgatttttcacatttcaagttttaagaggtttgtgtaacagggtctcttaggtctttgtacctgtgactaattaattttcatgaaagtgctaagtataggattgcctaccagaagactactattatttaacacagggtggcctattatgaaacagccacctttttttttttttttttttttttcctggtatgcctttgaatggagcctgttttaaatgggcctctgcctgaaagaacagatttaccgaatgtctggtctggccaataaggtcctctgtgtataccaacttcctgttgccctctgcacttgtaaagctaaatagccaattatatcaaaaactcttcccctgtgagtagaaccttggtctgtagctaaacagcctcatcattggactagggattgagcactgccaatatatcttctggccgacattccaaagttgaaattcatgatgccaggagtagagactaggagaccaagtccctttgccttccctaaaagccataggatactggaaatgcctgtaagagcccctgagcatcagcagaggagacaagaactgtgacatggatggtctctgctttaccactctagaagagctcaaagtcttccctgttgctgcaggcttatttgtctatactttctgactctgctgaaatgctattttgtatagttcccagatgctagaatcccccctgctcatgtaaaactctattagtgtagaatgttagcttggttactccaccatgcagaattttcctttttatctctagtttttaaatgagaaatatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcagagtgcttatgccttaccaaccatggctttttcatttctctgccatacctcaatattgcccatatactgtgaacttcaaaggtactgtagaatcctggaatattttaaatatattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttatacagacttgaactcaataagacttttctgtgtcaataagatactgtaacagggtctcttgggatccaaaaatattttgtatagtggaatagctatatatttcttttattaaaattgctacctggcacaaacactattatatttagggatcttcagcaataagaaaaagtccaaaaaaactgacctccttcttctccctatggataaatagaactatctggaagaaacctcagatggcttgccaatatccaggctggctgagaaattgttagatgaatcaccattaggtgcttagaaactgtattaaattgtagctgtattagattgaaagggatgtggaggaaggatggaagctaatacatttattgagctaacatttaagacagtgtcaggtattttatatatactccctaacttaatccttataacaattctgcaagctcagtgtaggttcatttaggttgagtaattagaccagatacttgaagccagttaatagtggaattgggatttgaatctagttttgtctctctccaaagccaatgcctttattactgtgttgtctactcagaaattgtgctatagaagccagatttcctttattccaagtttttgttaaggtgatcttttagaaaaatatgactcacttaagctctaggcatctatctatgtatgtatctatgtataatctatctatctaacattgctgcttgaacacaaaggctaaaggttttcatcatgtagatggcatgtttcctagacagggatttgtctaatatcaagtaaaaccattatgttgtctctgatttaatctcttctccactaatgcaaattcttcagagtatgcaaattttatataatagagaaatacacatctaagaaaatcacatggtaggtaggtatatgattgattaataggtaggtgggtaggcagatagatgggtggatgaatagatgatagattagatagatagatagatagatacatacatacatacatacatacatacatacatacatacatacatacatacataaatagaataaatgatacaaaagtagtaagttcttctccaaagacagaagaggcagatattgatttgctcttggattgtgaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgctttagttcagatcataatacactgttctttgtaagtcattattgcatttctgtggcctaccaggttgaggccacatctcatgcagaactgtattactaggtctgaaatgcatttccagccctatcacccacacactgtttcatccactgtagtacttactagaccacttattttctcagatgcacattccctttgctttgtttgtgctgctccttgcttctagagaatctcttcccccacatctttgaacatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgtaagtactcttaaagggttttgttgcctagtatagacgcttcctaatagggaaacactaattctttgcagaatagaatgtttgaatcacatctagtcttgtatatcttattcacttgtcaagtaattgatcaaagacttcatacttgcatatggccccgtaaaagcataaaaataacagtgagccactaagctaatttgtgctttttgagatttagtttagatttacgttctcccacagcattgtttccaatttagaaactatagttcttctaaagttttgggtttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaatatattgggttgatcttttgttttttaaattaatatttttatggtagttttatgtttgcagaaatactgaacagaaagtacagagttcacatataccgttttaccccaacatacagtttcccctattattaactcttgcgttcatgtggtacatttgttacatttgatgagccaatattaactattattattaactaaagttcatagtttaccttaggtttcattcttggcagccactagcaaccactgatttttttttaacttttattttaggttcaagggtacatgtgaaagcttgttacataggtaaactcgtgtcacgggaatttgttatacagattatttcatctcccaggtattaaacccagtactcattagttacgttttctgctcctctccctcctcccaccctctacccaccagccccagttgtttttttctttgtgttcataagttcttactatttagctctcacgtagaaatgaagacatgcaatatatggttttcttttcctgtgtgtgtttgctaaggataaaagcctccacctccatccatgttcctgcaaaagacatgatcttattttttatggctgcatagtattccatgatatatatataccatattttctttatccagtctgtcattgatgggtatatagggtgattccatgtcttggctatagtgaatagtgctacagtgaacagtgctacagtgaacatttacgtgcatgtgtctttatggtggaataatttatgttccttggggtatatattcagtaatgggattgctgggatgaatggtagttttgcttttagctctttgaggaatcaccatagtgcttccacgattgttgaactaatttacactcccaccaaaagtgtataaatgttcccttttgtccacaacctcaccagtatgttattttttgactttttattaatagccattctgactgatgggagatgataatctccttgtggttttgatttgcatttctctaatgatcagtgctactgagctttcttatgtgcttgttggcagcatgtatgtatgtcttcttttgagaagtgtctgttcatgtcctttgcccactttttaatggggtggtttttctcttgtaaatttgttcaagttcctcatagatgccggatattagacctttgttggatgtatagtttgcacatattttctcctgttctgtaggctgtttggttttttttgctgtgcagaagctcttaagtttaattagatctcatttgtcagttaatttttgcttttgttgcaattgcttggtgcctttgtcatgaaatctttgcccattcctatgtctgggatggtattgcctaggttgtcttccagggtttttaaagttttgggttttacatttaagtctttaatccatcttgagttgatttttatatatggtataaggaaagggtacagcttcaatcttctgcatatggctagccagtcattccagcatcatttattgaatagtgagtcttttccccattgcttgtttctttcagctttgttgaagatcagatggtcataggtgtgtggccttatttctgggttctctatactgttccattggtctatgtgcctgtttttataccactgtcatgcagttttagttcctgtagtcctgtagtatagtttgaagtgggttcatgtgatgcctccagctttgttctttttgcttaggattgccctggctattcaggcccttttttggttccatatgaattttaaaatagttttatctagttctgtgaagaatgtcattggtagttttataggaatagcattgaatctgtaaattgctttagccaatatggccattttaatgataacgattcttcctatccatgagcatggaatgttttttcatttgtttgtgtcttctctgatttatttaagcagtgttttataattctcattgtagaaatctttcacctccctggttagctgtattcctaggtattttattctttttgtggcaattgtgaatgggattgtctgatttggctctcagtttggttattggtggtgtataggaatgctagtaatttttgtacattgattttatatcctgaaactttgctgaagttatcagctcaaggagcttttgggtggagaccattctagatatagaatcatgtcatctgcaaacagagatagtttgacttcctctcttcctatttggatgtcctttctttctttctcttgcctgactgctctggctaggatttccaatactatgttgaataggagtggtgagagagggtatcctcgtcttaacgccagttttcaagggaaatgcttccaggttttatctattcagtataatgttggccatgagtttgtcatggatgcctcttattattttgaggtatgttcctacaatacctagtttgttgagagtttttaacatgaagcagtgttgaattttttttttttttaagtctttttctttttttttttctttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtatctgttcatgtccttcgcccactttttgatggggttgtttgtttttttcttgtaaatttgtttgagttcattgtagattctggatattagccctttgtcagatgagtaggttgcaaaaattttctcccattttataggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccaagagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggaggttttgggctgagacgatggggttttctagataaacaatcatgtcgtctgcaaacagggacaatttgacttcctcttttcctaattgaataccctttatttccttctcctgcctgactgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttatttatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtaggattcagctgtgaatccatctggtcctggactctttttggttggtaaactattgattattgccacaatttcagagcttgttattggtctattcagagattcaacttcttcctggtttagtcttgggagagtgtatgtgtcgaggaatgtatccatttcttctagattttctagtttatttgcgtagaggtgtttgtagtattctctcatggtagtttgtatttctgtgggatcggtggtgatatcccctttatcattttttattgtgtctatttgattcttctctctttttttctttattagtcttgctagcggtctatcaattttgttgatactttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcgtttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgttgggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgacctgcttcggctcgcgcacggtgcgcgcacacactggcctgcgcccactgtctggcactccctagtgagaagaacccggtacctcagatggaaatgcagaaatcacccgtcttctgcgtcgctcacgctgggagctgtagaccggagctgttcctattcggccatcttggctcctcccccaagtgttgaattttatcagaagccttttctgcacctattgagatgatcatgtggtttttgtctttagttctgtttatgtgatgaatcacatttattgatttgcatatgttgaaccaaccttgcatcccgtataagtgtacttgatcatggtggattaacttttaatgtgttgctggattcagtttgcaagtattttgttgaggatttttgcatcaatgttcatcaaagatattgacctgaagttttctttttttattgtgtctctgtcatgttttagtatcaaggtgatgctggcctcatagaatgagttaagaggagtccctcctcctcaatttttttggagtagtttctgtaggaatagtacctgctcgtctttgtacatttccactgatcattttactgtctccatagttttgtcttttccaaaatgtcatatagttgcaatcctatagtatgtagccttttcagactgccttatttcgtttagaaatatgcaattaagtttcttctatgtctttttgtggcttaatagctcctttctttgtagcactgaatagtattccattgtatggatgtaccacagtttgtttatccattcacctgttgaaagatctcttggttgcttccaagtctttgcaattacaaataaagctgctctaagcattcgtgtgcaggtttttttgttttgttttgttttgttttgttttgagacagagtcttactctgtcacctaggctggagtgcaatggtgtgatctcggctcactgtagcctccatctcccaggttctagcaattctcatgcctcagcctccccagtagctgggattacaggcacccaccactacgcctggctaattttttctatttttagtagagatggggttttaccatgttggccaggctggtcttgtactcctgacctcaggtgatccatccgcctcgacctcccaaagtgctgggcatgagccacgatgcccagcccctgtgtaggtttttatgtagacataatttgcagcttatttgagtaaataccatggagcacagttcctacactgtatggtaagaatgtatttagttttatgagaaattgccaaactaccttccaaaatggctgtaacattttatattccagagagcagtaaattagagtttctgttgtcttacatcctcaccagcatttggtggtgtcagtgttttagattttcaccattctaattggcatgtagtggtatctcgttgttttagtttgcagttccctaatatgatattgagcatcttttcatatgcatatttgccatctgtttattttctttggtaaagtatctgtttagctcaactctcttttgccttttttttttttaaatactgggtcttgctatgttgccccgactggatttaaattcctgggctcaagtgatcccagtgcctcagcatactgagtagctgggactgcaggcacataccaccatttgttaattgttttctcattgttgacttttaagcattctttttagattttatatttctggggttttgttttgtttttttgagacagagtctcacttccgtcacccaggctggagtgcagtggtataatctcggctcactgcaacctctacctcctgggttcaagcaattctagtgcctcagcctcctgcatagctggaattacaggcgcacgccaccacacccagctaatttttgtatttttagtagatagggtttcgccatgttggccaggctggtcgcaaactcctgacctcaagtgatctgcccgcctcagcctcccaaagtgctgagattacaggcatgagctaccatgcccagccaatttctgttctttatatgtgttttgcaaagatttttttttccccattttgtggcttgctgttttattctcttaacagtgtctttcaaagagcagaagtgtttaaatgttcttaaatatattgggtcaatcttttgtttgtttgttttaagaaatcagtgtattaaatttatatacaaaattgattcttagctatgttttaattttgttagcatcagtcactaataacaaaactgagattgttctacttggtagaatttagagggattttgccctccctctaaatcctatctaaaaacttttataactttcctcttctgttcattatgagatagacctgtgatgactgcctgtgtacttcaaagtcctttctctgagttttcttagttggtcactaaaacaggcaacattctacttggcagagacaaaatgttgatcatttctataatattttgtttggaggttataaatcattgcagcttctcattgacatggcttatttcaggttaggaaccagaacctagggctctcctcccatgaaattctactaaagccagggtgtatcagtaaaaatgtaatcctaccccagtacacatgtaaagtagagaattgcatgcaaagtgccggttttcatatatggaaatacactcttttgcaggtgcacctttgcttctcacttaggaaataagccgaaaaattgacaactgagcttctcttttgagaagatcaagatatttagcaactggagaacagtgtagtgtaatggtaaaagaccaagctcttgggttagaaagacttggattcaagtctcagtgtaaggcacactacgtaacctctataagcctccatgttcacatctgtaaaatggagttaatgcctattatacagggtcatattgatagaattaaatgctctgtataaattaggtgcagaccaaaacagactcttttgatagattaaatgtttatcccctttgtccattcccttatctggaccaatgaaatgagtttgctttccactaaggacatggaaacataccttgaatttcttcatcttgcatgagaattattttcagaatctttctctagccttcactcacaggggaactggccccaggtgcacgttttgagtgctttcccacagtttacctcagctgtactctcctactaataatgccttcctgaaactaggcacttagaatggtcccaggccacagccagacatggcctcccatgtggcttcaggtcagccagagccagtcaatccgatatcctactactcgtaccctcttcttctgtttatgacattatggatccaaatacagataggtgtgcagctacttaaataagtctaactccagtaataccaaaataaccctaaatctgcaacagatgcaaggatgccccctgggggcaattgttaagtgtgatgacagctgggcatcaattaatacatttgtcacctgctcatgagataggatcatgggaggtttggcaaagggacagtctgttgaacactgcacaaaacttagtagcaagaaaaattatttgtgcaggtattcatttttattttactttaatgttctgccttatctagttgcctgttttgagtcacaactttctctgtgcatttagatgaggttaataagatggctggtgagagcagtgcccccttcagccaagattaccaaaaaaaaccttgttcaaatgcccctcagaatttttcctgggaaatatgggccttctcattatgggcttaatgttcataatttattaggtaataactatttaaaataaaactaagtaaagcagaaaatatatacttttctaacatttggagacttgtttgctaaattaaaagacgaagtgccaagactataaattactttcgtatgttgagggtgaatgtttaaattgtacttttttatttttaacagaatgtttactcatgagcttagcatttaaatggttaaaacaaggctttgaagttaacactccattaagatgaatgggggtaattcacacctctgcttgtgctatattatttcagtctggttgcagagaaaacaagacagcagtaggttgatttactgtgtgaaggccctttaaacacccaaggtctggaaatctttggggtgtgtgtgtgtgtgtgtatgcttttccatctagaagcaggatctgaaattcaatacaatctaggtatagaatcgaggtcttgaaaatactaaagattctctgctatccagcaattccatatctggcatttgacgggtagcacgttactggatcaacccaacctctctggctttgtttgctactgtactgtagtgtttcttcctaccacagcattttttaaacttcagcttagtatactggtaaatccatcagtggaaaagcagaaacgaattatccattttccggtgaactttgtatgtgccttcagatgggttatgagctaagcattggtcttcatgtgctcctttttaaaacattttcatctttgcaaaatctcctgttctatatttacctacatataaagcatctacctttaagaactttacaattttttctcatatccctggggtagtgaagtaagcagagatcagttgaaaaagagacatttctttctcaatgtgtcctttaaaccagttctatattgtatttgaaatgtgtattccacccattggtggaagtgctacagccatttgaccctgaaatgattcattttagggcctgggaataaggttatcttaacacaaatgaaatggcaaacactgtataagatgttaatgagtttggaagatctatctttaaggtaaacagatttttctcttctctcttctctgtcctgcatgtttgcaggctcaggttactgggtaatctgtgggtagctaggtgtggagagtacttccactctggctggctgtagtgctgacactgccaatacagtatatacagagagaaaatagatgctagaaacagagggactcaaactgaattaattttaacctgtttttctttttggcatgttaacagctctctgtggctgtgttagaattagccctatgttaaacatactttacttcctgcaaatttttctgcctagattttaggtgtcataatttttgaccttagaacatttcagaatctttttattgtactgagaaatttgttttttaaaaaactcaaatacacaatttattcttctgataatcttcctgtattttttccataaggaggtaggaaaagtaggaaacaaaattttgatggaggatgaataaagatattgtggacatggtttctttattgcaatcagaatcctttctgtttgtcacccttcctaaacaatctgataaatgtgtttattatcacagtaatctgttgtcctgctttgccaagctgtcagtcaggacaagcaattataaggaacaggaagactcatcttggctgatggccaggtgggcaggtgggaataagaggtttattcacctgtggtacaaagtaaatgggtagaaaggaaaattgagttgccagggagaaaaaaaaaacacaaaaacagatggatgaaaagacattgtaatatgggatgctataaagaaaaagacttgcagagaaatgtttctcacttgtttgagtgtacagtcatcccttgggggattggttccaggatctccctcatatatcaaaatccatgcacattcaagtcctgctgcagaaccacatatacaaaatatcaaccctgtgtaaacatgcgcagattttgcatcctgaaaatactatattttttatccgtatttgattgaaaaaagtcaactgttagtgaacccgtgcagttgaaacccatgttgttcaagagtcaactgtgtatatattttatctagtgttcatcagtggacagatacacaacacaagcaaaagggctggctaattcattcagcaaattcttagcacatattatgtcctagaagttgagctagtcccaaggtcatgaaactatgtaagacatacatacatcttgcttgaaaaaagttcagatacaacttttatttttctgactgaacattttcagaccaacttgataagtgaaattgcttaaatgaaaaattatacatgtatttttaatatatacatatgtttttaaaaaaagattttggagtcaaaattacctgtgttcgaatcccagcttctgtctctttctatatctttctaattttggacaagttactattctctgaacttgctgaagactcaatatttgactgggttttctctcaaccagaggaaactctccttcaagtgagattacatatttgggaaaaactcgagtaagccgttaagcattgaatatacgtacacttttattactttactgtccctcaaatcacataacttccaaccatgttgtctcttctgccgtctctgcttcagacatttagtcagcagcctgactagaaaacggtattctagaaatatcctgaccaatgcatttattttcactactgatgtatttttccccggaaaaagtaattcttgtagtttcatagtaaatattatccacatattttgactttacatcagcatttttagcaatgacattacacttttggcttataaagtatgtggtcagaaaagctgcaggccttttttaggtaaattaccctggtttctagaaccctgtacttgtgctgttgatttacattttttaaatatgagggaatatacatgcacacacacacacatatatatatatacacatatgtataggtacacatatacatacatacatatgtatctgttatctatgtgttaaatttcatcctgttagcttcagtgcaccacttaagcagttgagatcttttttttgaatcttgattctagtgcatcagtcaccattcccgcttttgtgacattcttcatcatacttacattttttcatcccattcacagataaaaatgttaaatgagacaagactaaccagagggccctgcagcccaccgctatcagtatttctcttgagttgttattaatctatactttggatgaagttgttaatattcctgtagtgtcatctaacctgcatttcctcacttcccttggaagtgacccccaaatcagtgggtacagcctaaactcctatctgttttctgtatttctagttgcttcagaacatttctgcttgggggctccacaatcacttcaaacttaacatgtccaaatccattcctcactacagttttctcatatctgtcagcagcccctgttttcatccaacatcccaactggctttcttgcttccattcctgctacctacagtccactttcatactgcaaagtagttgtttaaaaattcaaatcagattatattgctaccctgattaatttcctccaagggctttccatctcacttagaatgaaatccatgccatggcctacaaggctcaattttgtctgtacctacttatttctctgatgtcaatgtatctttcattctccagccacactggcctttctgcccctggaacacaccaagcttgttccctcacacttactgttttccctacttagagcataattttcaaagacctttgcaagccgggcttcttatttaagcctcgggtcaactgtcaccccctcagagaggtctgccctgcctgtcttatggtcatgaccgtcttatggcccccaacacatggtagtgcttttaactttaccctgttatacaggtcactgctggaaatcttgtttatgtgttgtctgtgtccactagactgaaagtttcataagaactgggacataactgtcttatttataaccaaatcctcagagcttaggacagtgcctggtactttggagtggcttaatatttgttgaatgaatgcataaaggaatctaacagactgtgtccttctactctttacctctaatctgtcacaatgtcagttcttctttgaaatgcctcctagatttgcttttatgctgacccagcctcctgccagactcctatctaaatctcagccttcatctctttgtgcctgaagtattgcagtgattatcacttcaggctgttctttggcatcacttgggcaactttgcaaaaattaccacatgcaggttccaccccaaccagttaaatccaaatctctgagggttacgacccaggcatcgataaacttcttagagcttcccagatgactccaatgcacaactactggattgccatatctacctgctagcagatgtatgtcttccagcccattttgcctgttactgttctctggtctccttggaatcctgctttcatagtattactctcttgctcaagaacctataatggctcactactacccccattaatcccagataatggctcactgctacccccattaatcccagataatggctcgctactacccccattaatcccagattcccttgcctcatccactaagctatatttgagccctttcttacgtatgttctacaatacccttaaactgttttttctgtctagcacttgatttgccttttattaccctcttctatattgttactcctctccctactcccacttccaggtacatacccagaatgtgacttattttccacctatccaaatgcttctcattcttcaacacccagctcaaatcccacttctgtaaacactttattctccactctagtctaccccttattatctgtatgattattttggtataccattagtaccttgtaagatttttcgtatttttttcataaactacttttgtaattttgtattcagtttttgagtgggtaatgtgcacatggtacagattttaaatttacaaaaataccctcccatccaattctatccccagcatccagttttcctccttggaagcaaccacttttacaactttctgtgttcttcccagtatattctatgcctctcttagagagagagagagagaatacacaaacacaaggagaatacacggatatacacccgcaaatgttggcatacaacatgaaatcctttgcccctttgacttctctttacttaacattatgactttttttagttgtgctaaaacaaaaaataaacaacacctaacatgaaatctgccctcttaacaaacttgtaagtgtacgatatagtgttgttaattatatgcacattgtatagtagatacctaaaactttttcatccggcatgactaaaactctgtgcctaattgaacagcaactccctatttccctgttcctgcagtccctggcaactgccattttactttttgcttctatgagtttgactgctctcgccatcttgtaccaaggaatcatgtagtattttgtccttttgtgactggcttgtttcacttagcatattgtcctcaagtattatgcatattgcagcacatggaagaattttcttcattctttaaggctgaataatattccattgtatgtgtataccacaatttctttatccatgaatctgccaatagacatttaggttgttttcacctcttggctattgtggataatgcagcaacaaacatgggagtgcaaatatctcttccaagattctgttttcaatcattttgtttaaatatccagaagtgagattgctgtatcatatggtagttctattttaaattttttgaagaatctctatactggtttccttaatggttgcactattttatgtttctatcagcagtgcacgagggttccaatttctccatatccttgccagcatttgttttttgttattttgataatgatcatcctaacaggtgtgaggcaatatctcattgtggttttgttttgcatttccctgataagtagtgatgttgagcatcttcatataatgtctggtcgtttgtatgtctttggggaaatttctttcatgtcctttgcccattttaaaatttaatttttttgttactgagttgttgtagttccttctatattttgtatattaaccccttatcagatatgcggtttgcaaatattttctctctccttaagatttttattctgttgattatttcttttgctgtgcagaatctcttctgttggatgttgtcccacttgtctatttttgatttagcattatgttttggagattattttgtatcagtatacacaaaactccctaaatattttaacagctgcatagtattctgttaatgcatagaccataatttaattagctagtttcctatcaatgcatattgagggattttttattttcaaatgttgcaattttatataatgcttcaaatgttatctttgtatacatatgtcatttagcacatatattaatatatctgtagtatatatttctatccatttaactggaattctgggtcaaagggcatgtgcatttttaattttggtaggtattactacattgaccttcattaaagattttattggctgggcacagtggctcatgcctgtaatcacagtactttgggaggctgaggtgagtggatcactcgagcccagaaattcaagaccagcctgggcaacatggcaaatccctctctctacaaaaaatacaaaaattagccaggtgtggtggcgtgtggccatagtccgagctacttgcgaggctgaggtgggaggattacatgatcccagggaggttgaggctgcagtgagttgtgattgctctactgcactgtagcctgggtgacagagtaaaatcctgtctcaaaaaaaaaaaaaggaaaaaagaagatatactgatttatattcacaacaactatgtaggaattaccctttcaattttgtgttgttatttagcttttcacatttaaatactttacctctctgactccgttgtaattaacccaaagacaggaactatgacattacatattagcatctctcacagtagttggtgctcagtaaatatttgttaaatcttgtgtatttagggagttttcccatgagtggcgtttctgatgagtcccatgtgagaattgtcccctttgcatgtttgctgtttccaggaaagggtgtgattgtgtgtgatattcttaggcgagatgcttagtctattttgtgttgctggagcctgggaaatccaatatcaaggtaccaacacgtttggtgtctggtgagggccttgtctccactcccaagatggcctttgaatgttccaccctctggaggggaggaatactgttcctcaaatgacacataagtgaaaagagaaagcccgcttccaaaggcacttttattttattttatttttattatttttatttttaatctttgtgagtacatagtaggtgtatatatttatggagtacatgacatgtttcgatacagacatgcaatgtgaaacagtcacaccatggagaatggggtatccatcccctcaagcatttatcctttgtgttacaaacaatccaattatacttagttatttttaaatgtgcgattaagtaattattgactatagtcatcctgttatgctatcaaatagtaggtcttactcatattttctatttttttgtgctcatttaccattttcaccctgcccctactaccccacaacccttgtcagcctctggtaaccatccttctgctctgtatgtccatgaattcaactgttttgatttttagatcccacagataagtgagaacatttgatgtttgtctttctgtgtctggtttatttcacttaacataatggtctccagttccatccatgttgttgcaaatgaaaagatctcattgtttttatggctgaatagcactccattgtgtatatgttccacattttctttattcattcatctgttgatggacacttaggttacttccaaatcttggctattatgaacagtactgcaacaaacatgggagtgcagatagctcttcagtatacctattttctttcttttgggtatacactcagcagtgggattgctggaccatatggtagctctatttttagttttttgaggaacctccaaactgttctctacagtggttgtactaatttacatcccccccaacagtgcataaaggtcccctttccccttttctccacatcctctccggcatttattattatctgtattttttataaaagccatttttattggggtgagatgatatggcaattttgatttgcatttctctgatgatcagtgatgttgagcaccttttcatatgtctgttagccatttgtttgtcctcttttgagaaatgtctattcaaatattttgcccattttttgattggattattatattttttccaatggagttgtttgagttcctcatatattctgattcttaatcccacttcagatgggtagtttgcagatattttcttctgaaagcacttttattatgatattaaacctactgaggaaggtggagccctcatggcctaatcacctcttaaaggctccatctcccaataccattacattggcaattaaatttcaacgtgagttttggggggaacaaacatttaacccatagcagacaccattcatttatatttttcttccaggatcctgtattatcattaactcagaaaggccaactaatccttggatctattatcaaatttggtttgtttgaataattaagtataaattagctaaatggaaaggctctcctctgtaagttctttaccatctttttatgatgaaaaattttaaacatgaatgcaagttgaaataatatgcccatatacctaccactgaaacttagcatttggtcgtatttattttgtgactcacatataaattatatttatatgtaaatatacagttaactttagaacaacatgggttttctaactgtgtgggtccacttatatggggatttttttctgcctctgccaccccgagaaggcaagaccaacccctcccctgccttcttctcagcctcctcaacatgaagacaatgagaatgaagacctttatgatgatccagtttcacttaatagtaaatatgttttctctttcttatgattttcttaatgacatttttgtttctctagcttactttattgtaagaaaatagtatataatacaaataacatacaaaatgtgtgttaatcaactgttattggtagggcttacagtcaacagtaggctattagcagttaagttttggtgggagagtcaaaaattgtacacagattttcaactgtgtggtgggtgggcacctctgacccccacattgttcaaaggtcaactgtaaatacatttatatttgctgaataatttgcaaagtaagttactgacattccatgaagcagtaagtaaagttgaaaattattttttgtaaaagtcaccatctaccttagctcaggctactataacaaaataccatagattggatggcttaacagaaatttatttctcatagctctggaagctgggaagtccaagaacatggtgctggctagaattattttggtcctggtgagggcctcttcctggcttgcaaatggctgccttcttgtgtcctcacatggtggagaaagagtgatctctgttcctcttcctataaagccactaatcccattatgagggtctcaccctcatcacttaatctaaccctgattatctcccaaagaccccatcttgaaatacttgtgggttagggcctcaatatgaattgaggggttggaggagacacaattctgtccacagaactttctgtgaacaagcctattattccctccctccctccctccctccctccctcccttccttccttccttctctttcttttctttctttcttctttcacaaatgttgtccctttctccaaaaggataagaagctgcttgatgcagctgtcaccagaacttctcttagtaagggaaatatccttaatgtctttttttttttggtggtggtggggaatatcttgataagtcatttaggtatgaacggtgaattcttatacagtggcacagcaatgtgagtttactaaatgcctgtgaattgtatactttaaagagggtcattttatgttatgtgaatttcacctcaatcaaaaaaaatgtgaccctatgaaaatggttggcaagaggagaggaagtgagagagatagctaaaccactctgcataaaagagaaaatgtgaatttgggaactggagaaaagcaaagggaaagaggcagagagtgctaacccagtggtgggagtctagaggaaaagtggctgacgggcattttaagaacagaagcgtttaatattcagttttaatttgcctgtctctgtctcctgaaactaataaagtcagtagacacaaaaataccttgtgtgaacagaattgtgcatgtaaacccttctttagactcacatgggacagaacacatacagccttatgctatccaggtgatccagaaacctcaaaaagtgaaattcaaaggcagagatggccaagaaaaaatgtaagccacttgcttcctcccagagtccgtgggcacatcaggagggttgtgggacgatcctcatatgagggatgtgattgaaccaacttttcctaattctcaaagtgtattgaactttccttgacatctcattggcaatatattgtcatttcattgctttaagggctcattatttactagtcatcaattgtacctgtaggggaatgcctctttttagagacaagagaccagacctccacagaggtagatcttggagattggagcagttctagaatttctaacatttccccttacggtcatcttgctaggttctctgtaacaaagcctggtagttcagaaatcaggctccaagaacgtgccatagatcaacctgtttgtgtgtgtgtgtgtgtgtgtgtgtgtgtgtgtgtgtgtgtgtgtgtgtgtgtgtatgtatttgggatcagagccactcaacttcctttttttttgaaacggagtttcactttttttgcccagactggagtgcaatgctgtgatctcggctcactgtaacctccacctcccaggttcaagcaattctcctgcctcagcctcccaagtagctgggattacaggcatgagccaccacacccagctaattttgtatttttagtagagacgaggtttctccatgttcatcaggctggtcttgaactcccgacctcaggtgatctgcccgtcttggcctcccaaagtgctgggattgcaggcatgagccaccacacccggccttcaactcaacttctacttagatggtggcagtaggaatcagagggagtggggcccctagggaagagcactcccatggaaaaagagtagaaacaaattttataattccctggttttcttacccagttctccaacctgctaaaatctgaaaaagtttcatactttaaatgaatggaagatcattagtctcataaaataatatgacactactgagctggcacttcggtgtatagaccaggttctatgccaagcacattctcatgtaatctgaggtaagcacagttatattccccatttaatagattagaaattaaagtttagagagactgtaaggttaaatgacttgttcaaggttatacatccttaagatgccatcctaagaatagaaactgaagtttgactataaaggctgtgtgcttaattaccatgtaaataaagtgtatccaactgttggagtttttttctacaaaaaggttctgctcatagcagatacatagtcaatattgactgtgttgaaggctgctttattcatttaaaatgtggcacctaaatctgttctgttacatcagccagacagtattttggccggccttgtgtcctcttgagtcatggttcattgccacagcactgttgtttctcctttgttaagtatttcagaggaaattctggacaaaggaaaggtatatgggtcttcaagtagagcagggatgtgttccagtagttgtcaactagactgagaaaacttggatgtcttacgaaacaatgtcagaaatccatttctgtgttctgtgactttctacaaacacaatttttaaaaatccaaatatagcttagaccatcagtagtctaattcagtgtttcccagatttgagatttcttttggaactttagaacgtcaaaatgaatcttgggacattgataagattgcagactttttattttataaattgattaaggatattaaacttgccactttcaatataaaaaattaaggaaggttataacctttgtgaaaaacttgctacatagttatttatctcatcaaagaccagtgaaaactttctcatagaccaacacttggaaactatcagtctaaataaccagtctatattcaaaaattcagtaaagatttcttcacttctaatgctcattgacttcagttatcttataggtggaaagaagtagatacaaaaacagatcttgattacaaaattcgttgatgacctagttgactctttccccagtcattactaatcctaacctttgggagcgaaaaatatctaaataagttctggtttacaaatttgcaaaatttttgtcaacacttcagaattcagaaaaaaacacaggacatttttactatataacttcctaagtttatatgatatatcaaaagtcagtaaggattataccataataatatttacatttcacagggaagcaaaatacttggagcctctccttgtctttgtctaaagatttgtcattcatttgcattcaaataaattctttgctttcattcatccagaatggttctcaatttattagctcatgagactacataaatagacttgtattcatacattttaatttcagtgtaaaatggctttcctcaatttttttttctactcaactctcccaaaagatgtctaatcactcccacactcagttacttaaacatttcataatgttgttacttctatagtaaaacaaaaagtaatttgcttttaataaatcagagagccctactgtagcaatctagaactttattctggcgagagcaaattctcaaattatatttccagcctcatttgtgaatagctgattttccctgtcacaaagcattgttaggtaggtacagtatttttctttagttggtaaactactggaacttacaatccaatggaggtgacctctatacaatacctgggacggtaataccctgaagcgcagggtgtggctattgcatgtgccacatgcacatgaggccatctgtgcgtgcttgttgaaagaatgacatatcttggtgagtaatatgaacattaaaagctctgctggataagctcatagaggtggggttcactgccttctgggtgagtggggaagactttgtgaagaaagcaacaactgaagtaaaattgaaggataaccaaagtagaaatgagaatgaaaggaagatactcctgtttggaaagaaaatactaacaatatgtacaggaaaatacaaggtatactttggagatgacaagtaaaaattttgccaggagcacagatgtaatagcaatttgagaagtaaagctgaagggtaggatcctgatgtagagaatgctggacccaggctgagcttggactttacatcaagtagaagtggtagagaaagattaattgcctctctgcattggactagtgccatcgtcttccaaaagctaaaaagaagcactttaggccttcaagggctagttatctaaaaaccacacttgatttgttcttaagtctcagctcctgggcatatgaggaactttttctggagttttggaaaattcctcatgccctcagatcctattaagacctctggcatctttttttttttaattatttaatttatttatttttattttttattttatttatttatttatttatttattttgagacagggtctcattctgtcgcacaggttggcgtgcagtggtgtgatctcagctcattgcaacctctgcctcccggactcaagcaatcctcccacctcagcctccagagtagctgagactacaggtatgcgccaccatgcccagctaatttttgtactttttgtagagacagggtttcaccatgttgcccaggctagtctcgaactcctgagctcaagcaatccgcccactttggcctcccaaaattctgggattacaggcgtgagccaccgagccaggtcaagacctctggcatcttaagagacttcctatgagttcctgcctccaaacttttttttttttttttttttttgagacagagtctcgctctgtcgcccaggctggagtgcagtggcgggtattggcttactgcaacctctgcctcccgggttcaagcgattctcctgcctccacctcctgagtagctgggattacaggcacacactactacacctagctaatttttctatttttattagaggcggggtttcaccatgttggtcaggctggtctcgaacttctgacctctggtgatctacccacctcagcctcccagagtgctgggattacaggtgtgagccactgtgcccggcctcctgcctccaaacttttgcacaaaccattcatgttgtttttctctttcccctccaaagcgtttcttctccctcaaaacctgtttccacactcaacctcctctagaaggacttacctgactatgacttaatgtaactgctccattactcaggaaacctatgctcaacatcttgatgctacatttaatttctctaaatgataaaatatacaaattcttgtatatttgtatgtctaaccaccctgcgacagcctttaggaaaggttccacatctgccaactcctttgtatcctccatccagaacctgcctcccatccctactttacccatccacctcagagacttcatggtacagtgcagtatacttggtgagtgttgatggtttaagagtgtgccctgaacaacgaaggatttctttgaggctgaaatcctgtgggatccatggaatgggagtttcacctgtctttggcttctgctcctttccccagcatgtgtagagcttctagaacagtccccagcaagagaggatcacttggtacacctctttcttatcctcactgtctccagtctctgctgtaggcctgctagtgatgatcaggatacaggttttaacatggccaagctgttaataacctgagattgggcaccatgaacaataagcattaaaaggcaataacaacaacaacaacataacctgttaattttatgcaggcttaattttttaaagaactatttcttcctaacttgcttttactcttcttcatctactttctcatacctatgactgacaatgataaggacacccacccactatacacacctaattccatccctccaaatttgatttcgtgttctctagagctggcgtgttatgtgacctattgtggggagaggctcagctgagggactctgtgatgccaaatggacaaaggcacacttttttctccaggtcccagcctggtgaaagtcatagcacctgagaatttggagctgactctctcctttggaaattgtgccttccaaaaatatatcttacactgcctgtacctgcatgcaataggttttggttcttaccaactgcagcttcagtctgaacttgagttctaccctcatggatgcaaatcaaaacagctcagaatcaagtctgggaagcaagtcgaagtggtttgatttgcatggggagcttttgtctctgcatgaaggcagccaaattccctaggctccccagccctccggaaatatgctttacaggacccgggggcccaggcccagtcgggtgggtgtgatttgaatgttctctgctacagctgctgcaccgggccctggtcactgctgttggtttcgctccattttactgcctcagaatccccctgtgcatgttagtggttaatacagcagccaggagacgccagacagctctcggcacctggttcaaatttaaggctcatttacacatgatgtcacacacgcattgtcagcgcgagggaggtcaggatggttcattttgggaaggttcacattgttgagtctttacaacactcactgctattaatgctttaaccatctgacttggatttcggttttctggcatgaggtaatcccaggcactagatttatatgctgaatgggaagccagcaatggtggctaatcatgctggtttgcagatctgcacctctggagccttgggatggaattagagggccacatggcaagtagcaaatcataggcgttttgagcaggagaggaattagccagacctggaagcaggggccatagatggggtgttgtctgagccaggaagtttgattgaagaatggaaaccaaggtaaattggacaaggatctgggcccagagaccacaggaattattctactttgaccagtgctttgggtcattgcttgaactgtccttttgctcatcactcatagaaatcccagacccatcttcccaggtccagcgtaagtctttcatgttccatgaagcctttcctgaccacccatcccacagcaggggctgaggtggttagatcaccagaggtcagaagttcgagaccagcctgaccaacatggtgaaaccccatctctaataaaaatacaaaaattagctaggcgtagtagtgtgtgcctgtaatcccagctactcaggaggtggaggcaggagaatcgcttgaacccgggaggcagaggttgcagtaagccaatacccgccactgcactccagcctgggcgacagagcgagactctgtctcaaaaaaaaatttctctcctgaatccctaagtacttttgttactgagtacttaatttgtgcgactagctcattttaccctcacaattccaaagggaaggctttattatttctcttttacagatgacaagacaggttcagagaggttaaataatgtatccagtgtcaaacttttaaaagtcaggatggaatcctgattccaagcttaggttctgaaccactggggtaggctgtgtagtactacattttctgtggaacgtggtatcggtaacatgggagagacaggctgtgcctcaggaagatgccacatgggagtgcacagcagtgctgtagtgcctcgtgtttatgtgtagtcccaggtgcctggctgtaaacaactgcagggcagtgaccatcacctctgcttttctgcatccccacacttcctaacacagtgtcccccaaagtgtgcatcaatggatggatgaatattagcacccccgcaccaccctcacctaaaacatactgaaaagtttgagatctttggataaccaccccatcccctgctgttgtcttctgtcatacggctgaaatcgtaaaactggtctgcctgtcacagctccagtgagcctacttactcactggaaattcagagaatgtctttagtcctgttgactgctttgattttgttttttaacttgtaccaagacctgttgccatgatgggtctctgcaaatgggctttcttgttccatgagtctctgttttagtcaagtgaagggcacactccttttcattggccacctcttacttttcctccaagaggagtactcactcccagaaccctttgctgggctctcatgccgagcttaggtgccccttcagtgtgcttctgcagcactcattaccccgtagtagcattgtagtttaattcctgtttgcttgactgaagcagagactcacctgcagacgcctgtaggtgccttccacgttgctcagatgaacagtagagaagggtcaggcctgccctaggtttctacccctctcctcaaggccctttctagtcaccacgccacatcctgctcatgactgcagggatcatgcctctgggcctctgtccatgcagctgcctctgcctgcactccaggacaggggccttctctgctgtccactggagccctgtggaagggactcctgaccctagccttagggaagtcatctctaaaggctgttttattacagtgtttcctcagaatgaccctatagacacagtgttttctcagtgtcctctcacctttgaacatatccgggaataattgaaaaaaccaggcaatcaaatgtgcctctcataaatcaccatcacttcagagcagaacttaagagtttggtttgcaagccacaccaaatagtttgagcttggccctctaccatttcctcctgctctgagcccagaggttcacctagtggactgtagcaatggattcccttgcccctggcttcctgttgggttcagccagagagcagcaccagtgggagcctacagagggaggaaagtgaggtcaaggtgtctgctgcctcctccctgcctgccaggccactgtgggtagactacacctcaggtggccctccccatgtgtagccatgcttgccaggttctgggttctggaaacctccacctcctcttgccccttcagtcatagggtggtagcccccttcattgctattagctgttatgcactcaattgtgttccaaccccaaattcgtaggttgaggccccaatccccaggacctcagaatgcaactgtatttggagatagggtctttaaagaagtaattaaattaaaatgaggccattaagccctaattcaatgtgactggtgttcttgtaagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 2146 - DNA, 71431 bp, Homo sapiens
cgtcatcagatcaagtcgactcgctcctctccttccaggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagttagtatttttgtcaccttattttctccaccagtctcgtgaggtctttgcaagagtcacaggattttcctcttccgacttagtcatggggggagggaaaataataaacattttaatacagaaattcttagcggtagaatggaagtggcttggtagtaagtgcatagcacgttcctgaccctaaagcctgtgcagtgggcactccgctttttaactcgagtcctagacactgttcccaggactttgttcccggtgctgtttgtggggagggggatgttttcagggatactgccagaacaacgtgaattgcttctgtttataatattgtcattgcaagatattcctgaccatccttccagtttggtagaactaattcattagatatataagtagagattagttgtgcagtcctagtaattgaggagaaacaactgcccacagcagtcccaggttgactcagcaattctttagtaatcacatgagctgaggccttatccctcctctctctccccactccattcccatcctatcttcatctcttgcagtcacaaggttagtcatggcccttcctgaactctgcctgtcttgtgtactggtggaaatcattttcctaagaaaccctagattcctggagctgcagtagtgggaggtgggaaggaaaggaaaggaaattagtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttaggtgagtcttcatattttagcatcaaatttttttttccattttgataatatacggagaagtagagagatagattccagaagctgctattatacaatttctagttagttatttctggggttttagcatttttcttgttattcttgttgctagtgtgtaccttggagggctactacatagcttcttaaatacacagaagtgtgactagtttttaaaaatgggaacttgatccacatttcatttataatgaaatatgacacttaagagtggcatattcattgtatctccttggccaaagtgaatcaaagccatgcagattaacttccaaatagcaattttgtgagtgcaaatacaacacataatcttttcattcctcgctgtctctttgtattgttaagtagtcttatttcactttcagaggccagacatgtgttttgtgcctgttcttttttatgtttcaggacttagcttgtaggccagtttgcccaaaatagaagacaatcctggatattctgtgctttcatagtactttgtatattcattctgttattataattgttacaatgatatgtttggaaattaatgttcccactaaactgaaatcctttacaactggaggtcaaggcaggcggatcactggaacccacgagtttgagaccaacctgggcaagatggtgaaaccccatctctgcccaaaatacaaaaattagcctggtatggtggagtgcgcctgtagtcctagctacttgggaggactgcttgagcctgagaggttgaggctgcagtgagccatgattgggctactgcactctagcctgggtgacagagtgagatcctgtctaaaaaatttaaaaaatagaaaaatcctttataactggaccttattcttagcatctagcaccacatggctaatagaatgaattaacaaattggctttgtcagtagaagcagatctatttactaggaaatttaaaatgcctagggagtctcttttatgtttatttcctgcttttattccaaattttttgataagcaaagcaacttttaagtaacccaacttgcttttattatggaatgtactcacaaactttcattatttttaaaattaaaaactatatgtgacaccttaagcaagacatagtcagaggactttttttttgattctctttgaaaaatcataatttatgcaccagggtcttacatgcagatatatactgctgaatgtgtgctcacccagtcatagcaaccatcatttttggtgatgctaaagtgttattttgtgaagttcctgatgtcagtttaatgacatttgtacttttacctctcaattttatttattaacaagtattaactggaccacagagagaaaatttcttcaatgactggggcagttcactggggatagctgtatagaagcttgtcctgctggtgtcttcctaaaaatgaataggaaattatctaagttttttctttcacactgttggtgagaggacctcaatcattacattgtttgcacatttttcaaattgcatcattagaggtgtgttaactacattattttaatttagtttggtttggagagtgtgtgcgtttaatagatgctagaaaatacagcctaaataaatcttaagtacaccttaataagatgaaggtatgataaggaggtcaatatcactggaagtagagggaggaagggaaaaagagaagacaatgagattgcataagtaaaacttctgtttagacttaaaataagaagaaaaccagtcataaaaaggaaatattacaagattatttaatggctgattcagcagtcagcagacaagactgcaaaatgaggaagtttgcttgtatttttaaaaaagtttggtttttatttttttttattttaaaatcagtatattttcatttaaataaaattggtaaatacaaaaaagtagaaaagtatcttcttaatttccttaatgaacataattctgctactcagagatagttcctgtgaatatttgactgttaagcaatttgtttttgtaatgagacaccatacaaaagacaaacttttgggaggttttgaccaggtgttcttttatgttttagcttcttgctgctgacagttgctctcctggcttcttactcagtccatcttctgcttagtatgtgtattcagacaggtgagtaaaaatgttatgctgcttcatttaataaaggagtctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattatagaagtgcttttctaagattttccttttgtcattaacaaatattctatgttcatcagtcctggtctttttatctgtctagtctcttttgtctttggattaggtcagctttgatgccaaaatcatgggtttaattcttatatggatgagttcgttttgctttatctggccttgtgatgttcagattttaagaagaaaagtagatacacaaaatagataaaaatggatttcttaattcatttagtgtttctataaaagaatacctgaggctgcataatttataaataaaagaggtttattttgctcatagttctacaggctctgcaagaagcatggcccttcttatgaggggcttttctgctccatctgcatctagtaaggggctcaggctgctttcattcattgtggaaggtgaaggggagctaggatatgcagagatcacatggcaagagaggaagcgagagaggaggggcatgccaggttctttttaacaaccagctctcatgaaactaataaaagtgaaaactcactcattaccccaaggaaggcaccaagccattcatgagggatctggccccagggcccaaacacctcccctttggccctacctccaacactggggatctgatttcaacatgagatttggaggggtctgacaaaccaaactatatcagtgagactattctgtgctgaaacaggtgagtgaagcccagtgatgtttcttaagaattttaagactcttcagaataattctgaagccactgctctagtttgttttcctaaaacctgtccatcatcagaaatactcatagatctttttatacacagagagctctaagcctcagggattctaatttcaaaaatctgaggtgagactcaagaatatgtttttaacaaggcaaaaccagtttaggatccatagtttatagctctaacttgtaccagtgctttggccagccagtgccagatatgtttttaacaagtcctccaagtgattcttatgcaaatctagtttaggattcatagtttatagccacaacttctaacagtgctttggccatccagtgcacgcctttgctctcaaggggcttgggtgaatgtgcagacagatgaaaatactaggaagcagtacaaatattaatcctaaagtaacaggttgttcataaaagcatcctgaatttaggaataatagctttagataaatatatttgtaaatcctgctgaaacttgaattttaattgcatgtattgaaattttgctgaatgtgaaaaaaattttacttaattgtgatactttaacatcttggtagattctttcaattcattctgttaaaagattaatactttagtcaactatgtggcaattatgtctttcaagcttcattttaaaacttcattttagttttaatttaagtaaaatgttttatttcggttatgtgggagtagtattcagtgtgtggagatttctaagtaattttaattttttactccttcggttcacatgtatttaactttaagattctgacactgtgtttgttcttttctgtaactctggggcgtatgaagtgaatatatctgtttctcttcttttttctttttctttgatttctgtagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactggggcaaaaatccctaaagattgcagggtgttgtacacactactatctcagaaatagttggttcgttgccattcttttggaatacttctcatgctctgatactaaacccacagctcccctccactggcttccatgtcactgtcaactggagagagtgagagtcctagaactctgcatacctctggccgaaccacaactccctagtcgttgatccctactactcactggattgtcaccattatttgccttgagaccatttggattatgacattataccatctatctcaatttgtgttagtcatttcaagtatattaggttatctttcatttctcagactcatcccatatggctgtcatctgtttctgacctcgtcttccactgctctctaactcctgaaacccttccactgtgctctctggaactcacagtcaatcatcagcaaaactcacatgtctctaattctcttctgaacatttctgtctgtttcttacactacgagaacctcctctgaggcttccctgtagttctctcaagtggtcagtcttttctctttatgtctctcatactaatttgaagatggtataggtgtcctgtttgtcccacatttctgcttctcaaccatcttcctctccttgaaccccccagcttttaatctcatgaatgtataccatctacggctctccttactattgtcatctatagactcctagaccatttcctgtcatttcatgaaagttttagctaaattttagcttctactcaccttttagttctcttcagtattacccctgttataattctggatgatttcaatatgcatgtagctaatccttctaatgctttcagttcctgaacctcttcttctctaatgatcatattctctacctacactggccacttattttctcctatggtcataccactgatcttgtcattaccaaaatagcatttgttagtatctgcccatctgccaccaccatctcctttgtttctaactcaccctctcaagtacttcaactctgacagttttcacccctaccaagacttctatcaattcattgattctaccacctttgcactgaccccccacactcattcttacttccctctttatccagttgaggttttgtagtatgttatttaatcccttgcctatcccttgaaccatcatatttccctggtaaaattccaaccatagttaaatataactctgcctgcttcacatttgcacccatgcatttgaatcttcctgaggaaaagcacaaccatgcagactgatatcactataattcaacgtctagtgtacctatgatgctatcacacaattctggttcacttctttggttcatcacttcatttagctcattcatctgctatctaggagattgcttttttatatcttctcctgtcaaaccttcgacacttttttctttgatttcacccataactgatattcttcgctttctgtttcactgaaaaaatagaagcaatcataaaagaattttataagctcttgccaccacttatttatctgtgcctatatactctgttccttgggatgaattctttgtgtttatttctaaggcctaccccccaacttgtgctatgatcccacctgctcttgcctacatcactccagccactttctcccttctttcttatttcttggcccttttctaccatttccttcctatcattttacaaatagtctaatttctgtcatcataaaaatctcttttactttgcatcttttgaatatgcctcatgtcttcatgacagcactccttaaaataattgtctaaaccaggccaggtgtggtgtctcatgcccgtaatcctagcacttcgggaggcagacccaggaggatcacttgaagtcaggagtttgagaccagcctgggcaacatggtgaaaccccatctctacaaaaaaaaatacaaaaatttgtgtgaggtgacatgagcctgtagtcctagctactggggcagctgaggcaggagaatcacttgagccagggaggcagaggttgcagtgagctgagatcatgctgttgcacttcagcctgggggacgggagtgaaaccctgtctccaaaaagaaaaagaattatctaaaccagatgtctccagttcctctcctcccactcctatcaggcttttccactgaaactgttgtagcagtgacttccacattgctaaatccaatgatcagttctcagtcagcagcatgtgacagagctgataactccttgctctctgaaagacaagtcacgctttcctagttcttcctgtttcatcaaacactccttttctcttctgttgaattctcttaatctccccatcctctaaacattggtgtacccctgggactattcctctgatctcttttcttttcccttcttttcttttttttttgagacagagtctcactctgtcacccaggctggaatgcaatggtgtgattttggctcactgtaacctccgtcctgcagggttcaagcgattctcctgcctcagccgtctgagtaggtgggattatagatgtgtgccaccacacccagataagttttgtatttttagtagaaacagggttttgccatgttggccaggctggtctcaaacttctggcttcaagtgatccacccaccttgtcctcccaaagtgctgggattacaggtgtgagtgatctcttttcttttacactcattatcgggctcatggtgattctgaaatttatatccctggcctggaactctcccctgaatttcagtctcatctccagctgcctccgtgacatctccacttggatgtctaacagctcagatttgtaaaactccccatctttatactaccaatctacactttctactgttcccatctaagtaaatggtaatgtctttcttctaattgcttaggccaaagatctttaagttattctgtatctcccctttttcccctcatcctgcatgttcagtccatgccatactgttcccttcacttcaaaaaaaattttttttcgagatagtgtcttgctgtgtggcccaggctggaatgtagtggcgtgaacatagctcactgcagcctcgacctcctgcctcagcctcccgggtagctggtaatcacaggcacacatcaccatgcacgtcaccacacctaactaacctcagcctcctgagcagctggtactacaggctatgtgcgtcaccacacctggctcattttttaattttttgcagagatgggctcttaccacgatgcctaggctgttttccaacaccagctcaagcaatcctcctgccttgacctcccagagtgcttgggattacaggcatgagccatcgtgcctggccaaaaaattaataatctgataattttctcatttaattgctaccacccatcttcagttactattaccaccatcaaaagtaatagtttatctttttgtttttacttccactcttacttcctgcagtctattcttaacaaaacaaccataatgatctgttaatgtaagttaggtcatagcattcctttgctcaaaatcctccagttgcttcccagttcaatcaaagtaaaagcaaaaatcattacaaagtccaacacaagtcttctgccctttttatctccttgatttatcttccagtactccctcactggtttcagtcacacttttaatttttatcttatgtaacatatacttatatagcacttagcatcattctaaggactttatgaatatgaatattcatttaatcttcataataatattatgaggtacgtatcaatattatttccattttttgaaatgaggtaactgtggcacagagaggttaaagtaacttgtccaagagaggtgaaagtaacttcccagttaggaagtataggagccaggattcaaacccacacagtctggctctaaaattgtgctcactcttccccagtcgtgctgggtagtctcctgcttccatacctttgtgctttctgtgctcttcttggacgtttcttcccccagtttcccacatgactttgctcactcatcaccttcaaggctttgacaaatcttacctcttctgtgaggtctttttatacaatctcatttaaaattacaaacagcaacggttgatctacagtgtcatcaaggaaggaggatctacctttctgttccattattcttgtgtgtgccttccccatccttgaggtctaggacgacttgtggagtgcagacatcgcatccgtgttctagagagcagaaagagagaaagggatgcctaccagctgaatctcacttaagactccattttcttgttgccagaacttaatatgcccgatggccatactaaattgcatagggacctagaaaatgtagcgtttattaaaggtggcaatgagcccaactaaaagtcagggttctgttactcaggtagaagaagggaagagacaaccagcagtctctaccccaccagggttccatctttatccgtacttgtactttactatctttgaataacattataaacttttatagcttagctaccaaaaataggttgacgactctcatccatgctgccgaaacatatcagctacctctgatattggagatctccatttagatgttccagaggctttgtgagctcaacgtgtttaaaattaaacttatctttcatctttaatggctcaaatgtgctcctcttcctgtaccgtacctccgtgaatggtaccaccagtttatatctccttcacctcgtacattcacccagttataaattaattttgtaaatatttctcggatctgcctaattctccttccttattgctactgtgtagatcacgccataacccctccccaggattacagtagagttaaatcataacaggtatttaagttcatgtcattttaattcatacagttcaaaagtggggaagaaaataactttaaatagtgctgggtaatcctgcctgtattctactcagtgaacatatattcatctggggactgagtgtgaggtgggaaatataataatgttgctccctctgttatattttttttctttaaagataacttttttttttttaagacaaagtctcgctctgttgtccaggatggagtgcagtggcgcgatctagccaaaccgcaacctccgcctcctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagccaagtatcaccagatatttcaggaaaacctttaatgtgaaagatatatactaaaacagccacatacacacacacaagccaataatgagatacctctacacatgtattagaatgacaaaaatctgaaacactgacaataccaaatactggcgaggatgtgggacaacaggaactctcattcattgctggtgggaataagaaatggtacagctactttggaatacagtttggcagttttttaaccaaactaaatataatctcatcataggatccatcagtagtgctccttggtatttacccaaatgagttcaagacatatttctacacaaaaacctccataaagatgttaataacagccttatatttaccaaaatctggaagcaactaaaatgttcctcagaagtgaaagaattttaaaaactgatatatttgtacaatgggatattattcagcactaagtagaaatgaggtgccggagccttggctcacgcctgtaatcccagcactttgggaggccaaggcgggcggatcacctgaggttgggagatcgagaccaacctgaccaacatggggaaaccctgtctctactaaaaatacaaaattacctgggcgtggtgctgcatgcctgtaatcccagctactcaggaggctgaggcaggagaatcgcttgaacccgggagttggaggttgcggtgagctgagatcaagccattgcactccagcctgagcaacaagagcaaaactccgtctcagaaaaaaattagctgggcatgatggcgggcacctgtaatcccagctagttgggaggctgaagcaggagaatcgcttgaaccccggaggcggagactgcagtgagctgagatcatgccattgcactccagcctgggcgacaagagcaaaacctcgtctcaaaaaaaaaaaaaaaaatacccagcatggtggctcacgcctgtactcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattccaagtatgtgacattctggaaaaggcaaaactatgcagaaaataaaaaagatcagtggttgccagagtttagcagagggagcgtgaataggcagagcaccctcacctttaggacagtgaaatgaatctgtatgatactataaagtggacacgtgtcattatatatttgtcaaaacccatagaatgtacagcactaaaagtgaaccctataatgtaaattatggactttgtgtgataatgacatgttaatatagatacattgattgtaacaaatgtaccactctggtgcaggatgttgattgtaggggaagctgtgcatgtgttgggggcaggaggtatatgggaactctgtactttctgttcaactttgttgtgaacctaaaactgctcctaaaattattaaagaaaacacaaggaaagaaacagactcagaggaaaagaggaaacagacaatacaagaccagatgaaaacttaaaaagctacatttaataactttagagaactaaaagaagatcctgcattcttgaaacaaaaataaggaattataaaaagggtatattcagaaaaccaaaagtcctagaagtcaaaattagttcaattgttgggttgggagagttacagaagtttcctgggggtggaaaaaaagagaaagcttgaaaatgggagagaaaagataagaaaattagaagatcagtccaggaagtccaacatgcaaataatagaaattctgcaacaagaaaaaagtaaaagggatggtagaaaattattaacaaaataatacaaaaattgatgtaactgaaggaaattagtttcaagattaaaagttttcctcccggtatccagtataatacttgtaagataattgttacccaagacatactgtgaatgatcagaaatccagttatatagataatattctaaaagcttacagagagaaggaacaaacaacacaaaaaaaattcctgcaaagaatcaagaaccacagtagtgaaagtcttcctaggagcaatactgtaaactagatgactataaaacaatgccttcaaaattcctggggggaaatgattttaatatagaattctataactagccaaactgttgcttaagtgtgaagtttgaacaatgacattttcatatatacaaggtctcaaaaatttttattcacccttacttagtgaacaatagagtataccctttaccaaagttagagagtaacaaagaaacaaggaatcaggcacaggaaagaagtggagggaattcccaggacataactaagcagcagatctaagcaccatctacagattggagttgtgaggttttttgtggttttgggagggggtgtttagatgggatctcactctgctgcccaggctggagtgcagtggtgtaatcttggctcactgcaacctccacctcccaggctcaagtgatcctcccacctcagcctcctgagtagcttcccacctcagcctcctgagtagctgggactacaggtgtgcaccaccacacctggctaatttttgtactttttgtagagatggggtttcaccatgttggtcaggctgatctgaaactcctaagctccagcgatttgcccacctcagcttcccaaagtactgggattatagatgtgagccactgcctggctggagttgttcttttcacaaaggcacagtcctcgctccaggtcatgcctgccctctggattgtgttcaggatggaaactcttttcttattcctctgagtaaagggattgtctttctcatttgtcggtctaactcttaatttgtgttaacagtgcttgagtagattagcagtcaggccgggctgttaaaaaagtcagaataaaatagggattgaaccaaggtagtaataaggtgaataaaagaaagaaacaggttaacaaatggtggggtgcagcagagttccagttgagaggagctgatatctgagtaaatgtggacaataaaggagaagtagatgtctggtgtatctcccaggtttccggcttgagccactggattaatgatagtgtcatcaatgaagataggaacacagtaggaggaggttgttcaaaataaaaatgagttcagttttagacttatatgtaggtggacaaggcttagaactgaagcacaggctagaaattcattcattcaatactcttgtctactaataagaaagagataaataagagccagttacttccctgaaaaagctcatagtctaataggggaaacaaatacataagcaaataatttatatctagtatgataaatttaacagtttaaatatgtataaggcatagtgatatcttagaagagagagtgactttgatatgggcaggaggcagggaaatactgggtagaagagggtggttccccagcaaaggcccccaccccccaagcctggaaacccatggccctaattgggaacaggcatttctgttttcatgtccaaatgttgccttctgcctgccatccccgcatcctgtacccatataaaccccaaattccaggtccacaggcaggagagcagacaaacagaggagcagaagaggagcacagtaaaggagagaagagaaggagtgtttgaacgtcaaggagaggtcggttggggacagctggagaggagattggccatgggacagcagaactccaggggaagatcatcttcccactccatcccctttccagctccccatccatctcactgagagccacctccatcacctaatacaattcccacattcaccatccttcaaatccgtctgtgacctgattcttcctggacacaggaaaagaatctgggtacgaagagggcactgggctggttaatacttaagcaatctgtggaaggcagagctaaaagagcactgtagcatgcccactggggcttcaggagttgcaggcatgtattcctagatgctgctgtggggctggagcccaaaagcgctctccccgccccctacacctgccggtctgcgagctccgcctcctgtaaggggtttgagagtgcagcagccgaacagaacagacaagccacagccctgtcgcaggccctgcccttcgtgggggatcaggggactctcccgtttcaactttcccttagttggagggtgagggtcagtaaatgttcatggacaactaagctgaaaaggaatttgactagcagacaaggcaagagagaatattccagcatgtgcaaggatacaaagccatatactacctattgtattcaaagtaccaaaaatagtttactgttattagtagtacataaagtacaaaggagaaaattaaactggagagttagacaagtctcagatcccaaggaatttgtagtttttgctgaagcagtgagaagccactgaggttgttgaaaaagagtcaaagtagatactggaatccactgttggttgcttccaaaaagaattttggtcctttctagtgcccagaacataatctctttctctggcaaagaaaacgtagtcttctgtcttccttttcctaaagaaggttacaattattttatgaagattgtaattttgagtaatgataatggaataaagaaggagtgaaatggcctttgtgtgctcctcattttttttcttttttaaggcaaaaaggttttaaaaccctctggagcactgattctgaataccttctttttataacattttctaaatgctccctttactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaagccatgaagtttgtgataatttcttacagcagccttaggaaactaatacactacttacataatataatgccataacaatgaaataaagaagacacaaaaagtaaatgttagtgatgtgactttccatttaggaaacaattttttgcaaagttccaaacaaaacaaattatagtcttttctgcatttacatggtaattgtatttctggaaaatttaatatatattcaaaccattaaccaatgtttgtagcatctgccatgtgcttgacacacagagagtatttaataaaagctggatacatgggtgatgaatagatggatgtattaaagctacaaagagagtacataagttccaaaataaacatgcaaggcaaaaattatgtgtagtcaaacgtatctttaaaaattcttgggcaggcccagtggctcacgcctataatcccagcactttgggaggacaaggcaggtggatcacgaggtcaggagttcgtgaccagtagcctgcccaacatggcgaaacccatctctactaaaactacaaaaaattagccgggcgtgatggcgggcgcctgtaatcccagctactcgggagcccgagtcaggagaatcgcttgaacccgagatgcagaggttgcaataagctgagattgccaccactgcattccagcctgggcgacaagagtgaaactccacttccaagggaaaaaaaaaattctttacatagcttatcaaatacagtgttcaatatctacatgacgtactggacactgacacataccatttctcaataaagagctgacagccctctctccccattccctcagcatcgtttgggtatcttatgaaggacatgagttgttttagggatgtaatgaattccattcagcactatgaggtactctcaccgacaatcacagaagaattaaaactgactgaaaggcaatagatatgtttcccatttcaaagctcactgtggacattttcttatggtttggaatggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgacaatatttactttctgttttataattatatttgtttgtttttatccataggttgaagccaaaagttgaaaactattaccatttataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctgggctctttactatgaccagagtttattaattgtcctatttcattgaggaaaaaatgcaaaacagaacactggaatgactagctggaaatattccactatttcatgggaagcaggtttctaaacgattcctgtggaggccaaactcttgctctcgccaaaatattatagcattaaagtgtgccttgatggtacattaaggaagaaattttccccgaatttacttaagatttatagcctttctgctctcacaaaacgtagcattgatttctttaatatcaaaaaaagtttcctaaaataaactgctaatgattgctttcagtcatttgtttacttgaggtcagtcatgccaagtactgtttgtatcaattcttgtaaaagactcaattaattttgtaattgtcataattactgttattcctgttctgtaggaatatgctattaatgtaactggacatcaccacatcttatttttgtatctctcaaaacatctttcataaaactttgatggtaggaaagagctgaaaaaaaatctcctgttagtagaccaagtagtacttcaattactaaacaccagagaaaattaaaattacaccttaaataaaaccaaccagatatttggtagagaaaatggaactgtacaaaaatatggtttttaaaaataaaattctaccacttgtattatattcattatagactattggaaaccgttccctgccaaaaaaagaaagaaaaagaaaaaagtttgtgaccatttgtaattcattttagtctttttatgtatttttttcacctaaaataatatgggcatttaaatattttaaatatagttttaaatggctacatattattctatcaaaaatacctaccataatttatgtaaccactttctcattgttgagcatttaggttagttttgtttttccagttgaaacaataccccctgagtatctttgcatataatgatttctcttgattttagttttaagacaagctcttaggggtcaaatgttttaaatattttaaaggttcattgttcaaattgcatttcaacagtcaataccagtttacactgttttcagcattttaagaaattgcccaaatgacagagcagaattttaaaagtatttccctagtgttgatttggtttatatgctgagatgctgcagattttttgttgttaaaaagtgagtatgtggagatcaaacatttggctgactgtgtacacattttatttagtaaagcctcaatgttaagcaagaagccattactcatattcatgttgtctcaggaatggaaaagtgcttctaatttttgcaacaaaagaagtctgatggcagtgacagaaaggaatgactagctagatatgctgaccggaaagctagaattaggatttgaccattgtagtcagtctccatttaagagcctaatggttttttcttctcaatttggaagtttgctgcatttagagatattcttataaaactaaaaaaaatagacccagggagcaagtttgaggttactaaaatgtatcccattattgtcagagttgcatttcaaactgtcttcattaaactgttagtttgattacattttctcaaacagtaactgttgtgttttaattttttaaattaaaaataagttttaaatttcaggtaattgaaagaccaattctttttggaatctttcagtattatggttttggttcacagcgaaggtatttgcttgctacatttgctaaatatactatctatacttcattttgttgcataaaaataagacatactccggttagcctttttgatgggtattaccttgatgacttgctcactgacagagaaactgatgtaaaataggtcatttgaaaagcaggtgtttgatatatccccatatgtaacactgaaaagccttcttgctctagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccatgatcaagtgggcttcatccctaggatgcaaggctggttcaatatacgcaaatcaataaatgtaatccagcatataaacagaaccaaagacaaaaaccacatgtttatctcaatagatgcagaaaaggcctttgacaaagttcagcccattcatgctaaaaacaataaattaggtattgatgggacgtatctccaaattagaagagctatctatgacaaacccacagccaatatcatactgaatgggcaaaaactggaagcattccctttgaaaactggcacaagacagggatgccctctctcaccactcctattcaacatagtgttggaagttctggccagggcaatcatgcaggagaaggaaataaaggatattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaagtacctaggaatccaacttagaagggatgtgaaggacctcttcaaggagaactacaaaccactgcttaatgaaataaaagaagatacaaagaaatggaagaacattccatgctcatgggtaggaagaatcaatatcatgaaaatcgccatactgcccaaggtaatttatagattcaatgccatccccatcaagctaccaatgactttcttcacagagttggaaaaaactaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacacctatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacattagatctaaaaccataaaaaccctagaagaaaacttaggcattaccattgaggacataggcatgggcaaggacttcgtgtctaaaacatcaaaagcaatggcaacaaaagccaaaattgacaaatgagatctaattaaactaaagagcttcttcacagcaaaagaaactaccatcagagtgaacaggcaacctacaaaatgggagaaaattttcacaacctactcatctgacaaagggctaatatctagaatctacaatgaactcaaacaaatttacaggaaaaaaacaaccccatcaaaaagtgggcgaaggacatgaacagatacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaatagaaacacttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagtggattaagaaaatgtggcacatatacaccatggaatactatgcagccataaaaaatgatgagttcatgtcctttgtagggacatggatgaaattggaaatcatcattctcagcaaactatcccaaggacaaaaaaccaaacaccacatgttcttactcataggtgggaattgaacaatgagaacacatggacgcaggaaggggaacatcacactctgaggactgttgtggggtgggaggaagggagagggatagcattaggagatatacctaatgctaaatgacgagttaatgggtgcagcacaccagcgtggcacatgtatacatatgtatctaaccttcacattgtgcacatgtaccctaaaactttaataataataaaataaaataaaataaaagaacagaccagatgcagtggctcacaccagtaatcccagcactttgtgaggccaaggtaggaggatggcttgagtccaagagtttgagattaacctgggcaacatagtgaaaccctgcctatacaaaaagtaaaaaatgaaaagttagcctgggcctggtgtatttgcatgtgcctgtggtcccagcaactccaggggctgaggcaggaggattgcttgagcccagtagttcaaggctgcagtgagctgtgattgtgccagtgcactctagcttgggttacagagtaagaccctgtctcaaaaaaataagaatgtacatatttaattgtaatatgaaacggatgctgaaaatgaacaccgatataagtgacatatcagagatgctctggagacttggttcatataatatggaacaaaattaccttctcaatgccaaattagaaaatgatatgtacataattttcaggtttaaaatatatataccaaggctttgggatgttaaatataaggaatgttgcccatgtataacattatcaattaagcttaagaatattaaagatttgttgattaaaataattactaatttttgtgatagcttttactttagaatatgtgatttgaaaaaaaagaatgttgacatttcacatagttggaaaaaattctagttcttagttttgtaacttaattttatgttctaaaatatgtctcaaatccacccttgtaaaattattagtcttttattattaaagcataaagtttgctactcataaatcaaattatatatctcaaattcaaagctaaattgcccttgtgcattgtttagcagtatgtaaatacattttagaaaagggctgtatcattcatgaagtttccaaattcgttgatcaattctgataataaagttaaaatttttgttcttaattagtagatctcattattttttcagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaataggtagagaaaaataattgtcttccaccagtaatcaggagttgaacgttactgttagtgctatagtatatatattttttaatttctgaagaactactatacttctaaaattcatattcattttggctccaaacaggaattcttttgtttgtaaatctgttgtttgtgtttttatgttttcgattgacaaatacaaattgtatatatttattatggacaacatgtcattttgaaatatgtaaacattgtagaatggctaaattgacctaattaatatttgcattacttcacatacttaccattttttgttttatttttattctaaaaggatactctatctgtaactggctaaactaacttctgaaagtgagtctggaggaaatatatatagctatacaatggaaagaaaacctgtatttacattccagttaactttggtggagttttttgtttttgttttttcagacagagtttcgctcttgttgcccaggctggagtgaaatggcatgatctcagctcaccacaacctccgcctccctggttcaagcgattctcctgcctcagcctcctaagtagctaggattacaggcatgtgtcaccaggcctggctaattttgtatttttagtagagacagatttctctatgttggtcaggctggtctgggcctcccgacctcaggtgatccacctgcctcggcctcccaacgtgctgggattacagcgttagccaccgcgcccggccctaactttgtttttaaagtacaaaaaggaatgcttaaatcatatactatatagcatcatggcttggaccttagtcacctgaaacttaaacaaaacagaatatgttacttgagggtaaaaggttttgttaatcttccttagtagcaatgtttctgttctagaggattaggatgtttggtgtagccagggatcagtttcctccatctagtttaaacaaagaagaaaatattttttgtatgagaaaattccacaattaatataacataacctataaacataactctaagtatcaacactgacatcactgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcatatctgattaccttgagttccccaggaatctcatcaaagatgataagctaacaagcctacagactgaatttagtcctcaggcacattttatatggctcaaatattttttatttttaactgattaccaactaagcatcattaaagtatgaaaaaatttcatttctgactttctttgaaaaatcagatctggctacattggatccacattctcacatattatcaactggccagagctgagtagcacctgccccattgaagggggaggaattctccaatatcctacagttcttgccaactcccattgtcttatattcagcttaattcacattattgagtttggaacattttgcctatattttcagggtttgagagtaattgggctctagactttattaatctctgggactgggatgctcaaagtctgggatgctgatatagtcagaaaacttatatcatttccttttaggcaatatagcattggcatagcacacccagccggtctttttctacttatttaagcagtgtgataaaaccagcaagaagggaatgagacaccactcccacacttttaatttttatacttgataatcatcgattactagcttttaacacttttaacaatttaaaagtgactgccaagaaaaatttcaaaaacttctttatagtaactttggaactattaaagaaatactttttaatgtgatgattattaattttatgtatttcaaatgactggcagatttctttttagtttctcctcacaacttctgcatctgcttttttagtaatagttactggattttaataaaatactgatccttttatattgtttccccttctatcttctgaatatttctgttcttttacagttggtggtggcaggcaccataataattcagaatattggaggtaagcaattgcaagtgcactgtttatacataaatgtgatggcaataatgtcctttgaattgttatcttactacagatctagctgggaacttctgtagacatagctatcttcagaagcctgtgtgttggcctctttactctttttttttttggatcctttttagcagcacttgtgacagtagcttctaaattcagtttgagctaaaccctgattgcagtcgtgttattaggtctgcaacacacctctaaaacattggctttctgtgattctgaaggtaggatacagtctggaaaagctctcctggtgattttaaaatattttccctctacttttgttctaatcaccctattggcagatactactttagagggattagtgttccgtgggctgtgaacaagcaagtatggacaacagtgtcctcttgtaaccaagaatttaaaatgaccaagtggtttaaaacataaataaatctgagataaataagcattctcacatttatcctgtatcttgttcctattaataaccaattctagaaatgatctcaatattgagaactatgtagaaataaaactactgttaattatagacagttactgagtaaatgtattaaacatttaaatccaaaatatgggtatcatgtgtgtatatgttgtaaagaagttgcgtagtgctgaacaatatcttcgttttcttttatcattgactggagtgctaaataaatgctcttaaaggaaaatacacagaaaagtttgacatgtactttggatcttatacaggattgtatagtcagaggacattttaatcttattttttacatgtaacagtttaattcaaagatgacagttttaataaacttcagctctcataatcaagaggtctgagctatatcactttaagtattgttcaatcaaattccatcgttaataggtttttttggttaaggaaaaattgacattccaccagtgaattgtgctgccattgttttagaatcctgttttaattctttgaattttcatgaaaaaatatgaataaaaagaatgctttcttgcatgccataccaaataattttctcctaacacacactacttcacacttcacagtagaaagtcaagaaaaccagtctcttcatttatgaatttattatagtcattgattttaagatctattttggaataatttatttagcaactaagtattgcttaactgtgcactgataatgtttctgaatatgatgtatatttttatatttttaatccctctttatcctctctgtatagattctaagaactatcacatattgtttaggttagattgaaccattgtttaacagtttatgtagactgttcagttcagcaatttagatccaaatttgtgaccctggcacaaggcccactgttgtattctttgtccctttcaccttgattccttccttgttctctaatcttgtttataactgttattggagatggctatactgtagcacttggctgctactagatttaacttctctgtatgtatgctcctgtaccccactatattgttaagttcctttagctcaaaagtatgcctcatttctctttgtactcccagcacctattacacctgggaattgataaacttgttgagcagaatagagctgaaatgatttgtataatctctttctaagtaccttaaatattctagatatatttatcaagaagagaaaagggaaatgctagaccggcatctagcttcaggtatttgaaagactgaacatgaaatataaaaaagacactagactaattcaagtattgttccagagggcagaactggtgctaatgtatagaaatctacagagaagctgttttgggttttcttattcggagtacccttgtaactaagctgtgtgataatgaggatggcctacatccctttgaaaatgctccttagccctgaaaacattcaaacagagctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatatattggatatttaaaagattatattaagtgtaaatcagattgaatttttacacatcttaagtgcctgtctgcaaataatgtagttcagataacttttttttaaaagaatgtttgttagtataaattatctgacttttgcagtggttgtttacattaaaactgaaaaataatgtaatagattctatttaggtcaagcactctactagatactttaattataacaactcttcaatatagatattatcttcattttatagagaagagatcagtgtgcagtggagataagtagcttgctcacatttatcccataatgaagcttggattcaaaccttgctcagttggcctttattctttctgctatgatatagcaaatgtttgaaaaatgtgaaaagattaaatgttgaagattttctaacttcttggggacaggaactatgtgtttttatttgttttcctaactttacctagtttctgagaagagctcaataagtagtatttgttgaatgaattggacagtttttaaagttctgcttaaaagcctaagattttgcctcaaagagacaattgaatatactatgtaagtgataaaaaaagaaacttgaaagaccatagaatgacttctagtttagaattatataaaaatttaaaagttcaaaatactggggagagttagatctcatttatgtaaaatgggttaacaatatattgaaataggctgggtgtggaggcccacgcctgtaagcctagcactttgggaggccaaagtgggaggattgcctgagctcaggagtttgagaccagcctgggcaacatggtgaaacccagtctctactaaaaatacaaaaaattagccaggcttggggttgtgtgcctgtaagtcccagctactcaggtggctgaggcaggaaaatcgtttaaacccggtagacggaggttgcagtaagccaagatctcgccactgaactccaacctgggcaactgtctcaaaaataataataataataataataataatatatatatatacacacacacacacacacatatatgtaaaatatctattattttcaggttaagaaaatcatatcttaatgtttcttaactctcttattctttgtaacatttaaatacttctcagttttcatgagatacaattcctgtggtgaatccatgaaaaaaattgaaatggaaggcctttaaaagcaaaatgaccatggattgcccttgatcaatatttgtttcatgtgtctttcgccaaagacccagtttatttcccacatttccatattccataaatcaaattaatgtgctcatttatttacatccctagtacttagcacatagtatacatttagtaaataacatttattataggaagaaagaaaggactaagaggggagagggggaaaagctagtgacctggcttagtactccttcaagagcaaaaagagagttgattgaccaggaagagaaagcccagtatatgtaagtgagcatatagtttttaggaaagcgtctactgttagaacttcacagaaaatcgtttttctcccccaagattaatcaggcaccaagtattagtcacaaggctctagtgtggtctgacaaattgattgaaaaaatctactgtctgtaaatctctaaattttataatggaaaaaaatgcaacacactagatttaacactcttattctaaggttatagaaatccttggctttggaaatttgggaaccatatagtaaattactacttaaaagcaattcctgatatcttcccaatactaatgaataacaggctcaacattggctagagccagaggtaaccctctgcagcccatttcctcaggtgctggagtagcatttgttgagagccactgctactgggacccaaagtcagaaaagatgtgtctggaagttttaacatttaatgctgttataggggacaattctggcttagagagtttgaatttggcagcctaactaaagataaaagattaataactgtagtagaaagtaagtataaggtagttttcacatagttcctgtaacagtgttgtattatgtgattcttttcttaaaaactaaggtaagtagttggtttcacattcatttgaactcctgaagtaaaccattcagtaggctagaattatcactagaaatcaaacactacatcccaatcatcttcttagtcaagccagaaaaagtcttattaactcttacaagcacatgataacagtgaagtcaattgatgttatttctggtttcacaacttgcccaattcaaaatgtggaaagatgagtagctcctagggggatgttatattcttattttgctcttataaatatgaaggattactatgaatagcatatgctttccttaattcttcaaagccccagttctttaaaggagattaaaaatttaatcattactacgttttgtgaaaggaaaaccataaacattagtagtcttactgaaacctcctgaaattgctagaatgacccagatgtttcagtctggcacagaatccacacaccttactcttgcagcctttattaacacctcagtttggtaatctatggactcgggtaaccccatttctaaatctcagaaaggtataaataagatcattttcaattgagaattataaaaatctcaaattctcagtatttgaaaaattcacaatattagatgctagaaactacttggatttgctttcttcctgtatattcattcatgcattttatttatttactttttggtaggctagtaaagtactaagagtgtttcagatatactagtttgtattgtctcttgggaaactaggattgggcgcgcagatacatcgccatctgctggtcagtttatctgtggtgaaactgcagctttcttgagacttgtctagaaattctagaaagcactgccttagaataggagaggtacaggaaatttggagagtctttttcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttctggtagactttccttatttgtctttgttttgttggtttactttttcactttgctcctgcactttctcatggcatactagttaatagaacgagtttctcaacccaggcgggctgtttgcaccatcactagcttgggcaagttacttctttgtgcttccttatattctgtgaaataagtaatatgtacctcacaggtttgtgtaaagattaagtgaggaaataacttgtgtagaatactaccaagcatacagtaggcatctaaaaaacaaagatgttagctgttttcatggatctctgcccagagtcccttccctgtttctgtgtttctaacatctctcctctcaacctcccgggcccaattcatttatttcactttataattagatcagcagatattaacaccttgcaacttgctattacctaatcagattttaccccattttagtcactttttaatattactgttgcttctccatgttgtttttaaagagtgctttcaacttctgtgttttcagttgacagatgttttattttttcccagagaagtttctattaaatgagttatattagtttaaaattaagtagaaaagaatacctatttagttaatgtgctaaaactaagtgatttataatggctgaatacctgacatcaaggtatatcttctggcactgattttggctttggtggtttggggccacttaactatatgcatggctcttgtggatgacccagttgcagctattaatttagagtagaacatggtgtgtcttgttttaggaatctatactaggtgtccatgtcacccaaaatcatttgcaaatttttgcttatgattggtctgtaagataagtgcttaaacactttcttatgccatttataaaagacataagacaaaaactgtggcagacagctatttgatctagtaaaccttttagttaaaaacaaaggcaatatgagcattcctatcaatagtatatctttaaaacttttccagttcattttattgagctgattgttcttttgtatgaatttaattaagatatatttcctaacttaatgtgtatttggtaatctttttgtttcttttctgtattatatataatataatgtgttaaagtgctagctagttcttacatgaaagtttacttgtgattaagaaaaaaataattttcatagtgaatagaatggtggtggcctttgttttactggcttaatccgtgtgggttttcccctatagtaagttctgtggttgtatactcttaaaatatatactaacattctctagaaaagaagcaatgttttgcatgttttattatatttgtatcttgtatgtgaggtcttctttgagagagaaacacgtttggtgagttcatatttcttaaaatatacatgattcttcagactggaatctaatgaaatagtactcccatttgaaaaccaaagagttgagggtacaacaaaggataaaagtgatcagatgattagccaggggctaatagaaattctggaaagaatgacagatattatattagaaagaaataggatctcatattcactgaagctttctacagctaaaggtccaaaagaaataatagaaaattactgaaagagatgaatgtctgaaactttagaaatgcatgtggtgttggattaatccaagcaagaaagaaagatgggcagataataaattacattttataggaagtctgctttccttgttttcaaagtattttgtcttttttcttttctgtctctctcacaagatatatttaagtaagtctaggccggtttcagaaaattcagttcacaatttttatctttgcaccatatgtgtagagttctttggaatcggtaaaatattataaaaactccaaatccttgaatggagaaggttagtctaaaccttccttctgttctgtgccaaattgatagcatttttccttacgagaatatgaacaatacagaacacattttcacatacaatcagttgtaataccccataactaaaagattttgcagaaatgtctcagtggattttagtcaacccactgagacatagctgtacttctgctagggaaaaagaaatcgttgtaaactgaaaaaatatgtatatgtatattttcatcacagagaagtgattatttaactgttctaaattttactttgacataaatacatgttattttactaaaaaaaattgagagtgtatgtttttgtgtctatagtattatctatctccatacaaatttacacgcaaagtagcatgtatcctttttttcctcaagttaaatggtcacatagcattgtaatcatgaagttcagctcctttcaaatgatgttgattgagaaatatacattcttcttaaactatttgagccttttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccatacctattaaacttctgtgtctatgtctgttgttgctaaactaacctctaatgccttagacggagtgataacatataagagagtttttgtaaaactttgtacaaaatttcatttaaaagtagcctgtaatcaagactgtttctcttacctagtttgctttggacttgaaatgtaaacaaaagatacttaatgaacttaacaattgttattcttctctacagttacttttctgtgtgtgtgtgtgtgtgtgtgtgtgtgtgtgtgtgtatgtatctttggtatagtgtgttatatgttaatcttccatatgttgtcatagctctaatggacatctcttttcctagatggattattgtttaaatggttaagaatcatagaattctaataggaacactatttattcttttgcagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaattcttttggcttaaagagaatgtatatttagatcacagtaggaaaacaggagttctgttagatcgttctttattccccccttaggaaaaaattaaagttagtacattcttctgaaatgcttatttacaaaataaatgtatttaatatgtactttttgagatttctttttactagtttgtttttctcaggcagcagttttattttgtaagtttaataatttctgttctttagaaaatatccattgagaaacacaattcatttgtctgtgacacacatgtgaaatctaaactaattttactgtgctttactgtgttgcctttattgttaatgaatggtaaagaaaagcactgtatttaaaattggctttattaagatgaattattaaggataagaaatgattaacgataaccagtagccaagacaaggatagagaaattacattttacagtataattatttttatattaagaatttaaagttcaatcctatgaaaaggagaatgcaaagcatgatcttgaaataaatgaggtagtatctgaaagtatttccattgctactgtcaccttccttttgctgattttacagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatggaatctcctttggtactcctttgggcatttttcctcctggcactgcaactgtctgggtctaacattgggtcccagaaggaaacacatttcagacatagagccctgggccttttgccagcttcagaaatttggttgccaggtgttcctcaatgaaagatcttttgaagtttctgttttgattcttactcaagagtgactagaagataaacacgttgagtatcatttttgtattattgatatgtgtactcttttagtacttcctgcataccaggaattgaggggcatgtgcaaatggagagagcaaagcttcaggtccactaaagctgtaaatacttatgcataggttatagtttctggcatatgtatttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaaaaaaaagcaaagaaaaatcatgcataacatctctaacctagtcactgtccttttaattcttttgaatttttcgcaaaagctttcaaaactatagttaataattatatttatatcatcatcattttccattttattcattgtgttttttcttaaagccacgtaacattccattgagtatgctgttctaaatattttcaaatgttgggtatatagagttttcctccagcttctcaatattataataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctagatgacgggttgataggtgcagcataccaccatggcacatgtatacctacgtaacaagcctgcacattctgcacatgttctacggaacttaaataaaataaaaatttacaaaaagtgtatgttcttattatttttaatagtcttttataagtgttttcaagtatataattatttgaaaattctttatatctattgccaaattgctttccagaaaggtaatttatataatttgcattttcaccagctttttacacacctcatcactcctcactaatgttgactattatcttatttttaaatatttattaattcagtagttggaaatggcatctctttgtttttattcatttctaaatgtcaattcattaataagaaaaataggatcccacaagaacattttaatgaaaggaagtaggcttttcctaatagctggttgtaatggttataactctgtgtgtgtgtgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggtaagtctttatagagcacattatttgtttagaaaaaggaaagaagggagggagggaaagagagacaaatattaaggggctttaaaatttcacagtaccacatttttggcagaaggatggtggttgtgtataattttaaacttggccttattttaggttgttcagccttcagccctgcctagttaacctattacttggtttgcagtagtattttgtctgccccactaaaataaaatctttacagcggaacattaaagagcagcctttccttacagtgtaccattagtggtaagccagttccaattctgctgtacagagctacataaatgatctgtgacagatagttggaatgttgttattctgagccctaagccccagataccaaccactataatagaaaacatgcctaagatgtatagctttagttgtacgttaaaatcgctttccttataaattgctttttattttactgttattttacaggctttcttggctacacaagtagtttatcatttttctttatgatgttctttgctcttgtggtaagtttaaaatataatacattgcttatctcctcactaaaattggactcattgtgttagtcttttttacttttaactgttttgtgttgggaagggtatctcattttatttcactgtgttattaaaagcacttttgttccattaaattatttccttcattgtatctattttgaagaggcttagctagaacagcatttcaaattcagcatttcttgtggttaactagagaggagagcgtgccaattctgttaaaatcctagatggagtgtaattctttgtgtaggtgtgtaaatttattcctgtaccatactgtatgaagaatcagtctggttctaatctgtaaaatctgtttgagactagtcatcttaattttgaaactttattccattaataaaaaaacagagcttctggtactacattgaggagatctagtaagaactgggttgactgaattctattttgtctggtttattcagcatagataaattctcataaaaacactactacaaatatttttcttcacatgtgggatatattccttattttttaattagctcatttttattatataaaaatatcagatggtaaatttaacttattttgatattataaaataatataaagataagaatttaaatttatttccttctaattcttctaaaacatcttaacattctaaagatagtacctttgtgtgaaattttttaagtcttttttctttgtatagcagtttattccataatcagtatctaaatgtcaaaccttaagtagaaataaacatttttaactttccaagaatatacatgtccaaatgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttttttttttttttttgtatttttagtagagatggtgtttcaccatgttagccaggcaagtcttgaactcctgacctcaagtgatccacccacctcggcctcccaaagtgctgggattacaggcgtgagccaccgtgcccagccaccatatttattttagattctctgaatgttatcttttaaaatacatagtggttaggaaaaggaaacgtatatatattaacccagaattttggaaggataccagtttttcatttattattcttgtcaatatgtgtttgtaaatatgtatagcatttatatcatattttttaaaaatcagttcaggaactattattttcttatattctttgaataatataaactaaaacctatattttatctgttctcccagatctgtattttcattaaaaaaatttaacctaaatttttgccccctctaaaatattttgcaattttaaaaataaattatatctgtctcagaatgataccatcaagatggatttacctttttttggtaaatttactttttttttggtgtattttagagcacaagcggattaccattcgttctaaaagttctatcttaagtacagattagtattctaagcaacgttttaatacgtcggtaatccagttagacaacttttttttttaagagacagaatctcactctctccagtcacccagactggagtgcagtggcatgatcatagctcactgcagactcaaactgccgggcttaggtgattcttctgcctcagcttcctgaatcactagaactacagctgcataccaccacgcctggataatttttttttttttttttttgagatggagtctcactctgtcacccaggctggagtgcagtggcgccatctcggctcactgcaagctccgcctcccaggttcacagcattctcttgcctcagcctcacgagtagctggaaccataggcacccgccaccacgcctggctaattttttgtatttttagtagagacagggtttgaccgtgttagccaggatggtctcgatctccagacctcatgatccgcccgcctgggcctcccaaagtgctgggattacaggtgtgagccaccgcgcctggccagataaatttttttttaaatgttggtagagacagagtcccattatgttgcccaggctagccttgaactcctatgttcaagtgatcctcccaccttggcctcccaaagtgctgagattataggcgtgagccactgcactggcctgaaatagagaattatttaaatggtttttagtcagaagctttgcttctactgaacactatgttaggcattttaggatgtggaaatttaacctggacactagtcttaaggatctgtcaatctagtaggggagataaatttcttttcaaacatggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgattctgtttacttttttaggtaataattaaaaaatggtccatcccttgtcctctgacattaaattatgtagagaaaggtttccaggtaatagcttatattttcttttcagtttcttcctttttattttaactaaaaagaaaagaaagactaatgattcttttctgattgatgaaaaagtaatggctatattgcattttagaactttgttttgaaatactttcatttgaaagcctagtaataataaattcatcatttttattgatatattctgaaatttaatggctgttggtttctctttttcccctcaatgctcttaaacagatttcaaatgttacagatgattgtaagccaaagctctttcatttctccaaagaggtgtgtaagttattaacagatacttttagttgatttttcacatttcaagttttaagaggtttgtgtaacagggtctcttaggtctttgtacctgtgactaattaattttcatgaaagtgctaagtataggattgcctaccagaagactactattatttaacacagggtggcctattatgaaacagccacctttttttttttttttttttttttcctggtatgcctttgaatggagcctgttttaaatgggcctctgcctgaaagaacagatttaccgaatgtctggtctggccaataaggtcctctgtgtataccaacttcctgttgccctctgcacttgtaaagctaaatagccaattatatcaaaaactcttcccctgtgagtagaaccttggtctgtagctaaacagcctcatcattggactagggattgagcactgccaatatatcttctggccgacattccaaagttgaaattcatgatgccaggagtagagactaggagaccaagtccctttgccttccctaaaagccataggatactggaaatgcctgtaagagcccctgagcatcagcagaggagacaagaactgtgacatggatggtctctgctttaccactctagaagagctcaaagtcttccctgttgctgcaggcttatttgtctatactttctgactctgctgaaatgctattttgtatagttcccagatgctagaatcccccctgctcatgtaaaactctattagtgtagaatgttagcttggttactccaccatgcagaattttcctttttatctctagtttttaaatgagaaatatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcagagtgcttatgccttaccaaccatggctttttcatttctctgccatacctcaatattgcccatatactgtgaacttcaaaggtactgtagaatcctggaatattttaaatatattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttatacagacttgaactcaataagacttttctgtgtcaataagatactgtaacagggtctcttgggatccaaaaatattttgtatagtggaatagctatatatttcttttattaaaattgctacctggcacaaacactattatatttagggatcttcagcaataagaaaaagtccaaaaaaactgacctccttcttctccctatggataaatagaactatctggaagaaacctcagatggcttgccaatatccaggctggctgagaaattgttagatgaatcaccattaggtgcttagaaactgtattaaattgtagctgtattagattgaaagggatgtggaggaaggatggaagctaatacatttattgagctaacatttaagacagtgtcaggtattttatatatactccctaacttaatccttataacaattctgcaagctcagtgtaggttcatttaggttgagtaattagaccagatacttgaagccagttaatagtggaattgggatttgaatctagttttgtctctctccaaagccaatgcctttattactgtgttgtctactcagaaattgtgctatagaagccagatttcctttattccaagtttttgttaaggtgatcttttagaaaaatatgactcacttaagctctaggcatctatctatgtatgtatctatgtataatctatctatctaacattgctgcttgaacacaaaggctaaaggttttcatcatgtagatggcatgtttcctagacagggatttgtctaatatcaagtaaaaccattatgttgtctctgatttaatctcttctccactaatgcaaattcttcagagtatgcaaattttatataatagagaaatacacatctaagaaaatcacatggtaggtaggtatatgattgattaataggtaggtgggtaggcagatagatgggtggatgaatagatgatagattagatagatagatagatagatacatacatacatacatacatacatacatacatacatacatacatacatacataaatagaataaatgatacaaaagtagtaagttcttctccaaagacagaagaggcagatattgatttgctcttggattgtgaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgctttagttcagatcataatacactgttctttgtaagtcattattgcatttctgtggcctaccaggttgaggccacatctcatgcagaactgtattactaggtctgaaatgcatttccagccctatcacccacacactgtttcatccactgtagtacttactagaccacttattttctcagatgcacattccctttgctttgtttgtgctgctccttgcttctagagaatctcttcccccacatctttgaacatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgtaagtactcttaaagggttttgttgcctagtatagacgcttcctaatagggaaacactaattctttgcagaatagaatgtttgaatcacatctagtcttgtatatcttattcacttgtcaagtaattgatcaaagacttcatacttgcatatggccccgtaaaagcataaaaataacagtgagccactaagctaatttgtgctttttgagatttagtttagatttacgttctcccacagcattgtttccaatttagaaactatagttcttctaaagttttgggtttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaa

SEQ ID NO: 2147 - DNA, 102621 bp, Homo sapiens
cgtcatcagatcaagtcgactcgctcctctccttccaggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagttagtatttttgtcaccttattttctccaccagtctcgtgaggtctttgcaagagtcacaggattttcctcttccgacttagtcatggggggagggaaaataataaacattttaatacagaaattcttagcggtagaatggaagtggcttggtagtaagtgcatagcacgttcctgaccctaaagcctgtgcagtgggcactccgctttttaactcgagtcctagacactgttcccaggactttgttcccggtgctgtttgtggggagggggatgttttcagggatactgccagaacaacgtgaattgcttctgtttataatattgtcattgcaagatattcctgaccatccttccagtttggtagaactaattcattagatatataagtagagattagttgtgcagtcctagtaattgaggagaaacaactgcccacagcagtcccaggttgactcagcaattctttagtaatcacatgagctgaggccttatccctcctctctctccccactccattcccatcctatcttcatctcttgcagtcacaaggttagtcatggcccttcctgaactctgcctgtcttgtgtactggtggaaatcattttcctaagaaaccctagattcctggagctgcagtagtgggaggtgggaaggaaaggaaaggaaattagtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttaggtgagtcttcatattttagcatcaaatttttttttccattttgataatatacggagaagtagagagatagattccagaagctgctattatacaatttctagttagttatttctggggttttagcatttttcttgttattcttgttgctagtgtgtaccttggagggctactacatagcttcttaaatacacagaagtgtgactagtttttaaaaatgggaacttgatccacatttcatttataatgaaatatgacacttaagagtggcatattcattgtatctccttggccaaagtgaatcaaagccatgcagattaacttccaaatagcaattttgtgagtgcaaatacaacacataatcttttcattcctcgctgtctctttgtattgttaagtagtcttatttcactttcagaggccagacatgtgttttgtgcctgttcttttttatgtttcaggacttagcttgtaggccagtttgcccaaaatagaagacaatcctggatattctgtgctttcatagtactttgtatattcattctgttattataattgttacaatgatatgtttggaaattaatgttcccactaaactgaaatcctttacaactggaggtcaaggcaggcggatcactggaacccacgagtttgagaccaacctgggcaagatggtgaaaccccatctctgcccaaaatacaaaaattagcctggtatggtggagtgcgcctgtagtcctagctacttgggaggactgcttgagcctgagaggttgaggctgcagtgagccatgattgggctactgcactctagcctgggtgacagagtgagatcctgtctaaaaaatttaaaaaatagaaaaatcctttataactggaccttattcttagcatctagcaccacatggctaatagaatgaattaacaaattggctttgtcagtagaagcagatctatttactaggaaatttaaaatgcctagggagtctcttttatgtttatttcctgcttttattccaaattttttgataagcaaagcaacttttaagtaacccaacttgcttttattatggaatgtactcacaaactttcattatttttaaaattaaaaactatatgtgacaccttaagcaagacatagtcagaggactttttttttgattctctttgaaaaatcataatttatgcaccagggtcttacatgcagatatatactgctgaatgtgtgctcacccagtcatagcaaccatcatttttggtgatgctaaagtgttattttgtgaagttcctgatgtcagtttaatgacatttgtacttttacctctcaattttatttattaacaagtattaactggaccacagagagaaaatttcttcaatgactggggcagttcactggggatagctgtatagaagcttgtcctgctggtgtcttcctaaaaatgaataggaaattatctaagttttttctttcacactgttggtgagaggacctcaatcattacattgtttgcacatttttcaaattgcatcattagaggtgtgttaactacattattttaatttagtttggtttggagagtgtgtgcgtttaatagatgctagaaaatacagcctaaataaatcttaagtacaccttaataagatgaaggtatgataaggaggtcaatatcactggaagtagagggaggaagggaaaaagagaagacaatgagattgcataagtaaaacttctgtttagacttaaaataagaagaaaaccagtcataaaaaggaaatattacaagattatttaatggctgattcagcagtcagcagacaagactgcaaaatgaggaagtttgcttgtatttttaaaaaagtttggtttttatttttttttattttaaaatcagtatattttcatttaaataaaattggtaaatacaaaaaagtagaaaagtatcttcttaatttccttaatgaacataattctgctactcagagatagttcctgtgaatatttgactgttaagcaatttgtttttgtaatgagacaccatacaaaagacaaacttttgggaggttttgaccaggtgttcttttatgttttagcttcttgctgctgacagttgctctcctggcttcttactcagtccatcttctgcttagtatgtgtattcagacaggtgagtaaaaatgttatgctgcttcatttaataaaggagtctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattatagaagtgcttttctaagattttccttttgtcattaacaaatattctatgttcatcagtcctggtctttttatctgtctagtctcttttgtctttggattaggtcagctttgatgccaaaatcatgggtttaattcttatatggatgagttcgttttgctttatctggccttgtgatgttcagattttaagaagaaaagtagatacacaaaatagataaaaatggatttcttaattcatttagtgtttctataaaagaatacctgaggctgcataatttataaataaaagaggtttattttgctcatagttctacaggctctgcaagaagcatggcccttcttatgaggggcttttctgctccatctgcatctagtaaggggctcaggctgctttcattcattgtggaaggtgaaggggagctaggatatgcagagatcacatggcaagagaggaagcgagagaggaggggcatgccaggttctttttaacaaccagctctcatgaaactaataaaagtgaaaactcactcattaccccaaggaaggcaccaagccattcatgagggatctggccccagggcccaaacacctcccctttggccctacctccaacactggggatctgatttcaacatgagatttggaggggtctgacaaaccaaactatatcagtgagactattctgtgctgaaacaggtgagtgaagcccagtgatgtttcttaagaattttaagactcttcagaataattctgaagccactgctctagtttgttttcctaaaacctgtccatcatcagaaatactcatagatctttttatacacagagagctctaagcctcagggattctaatttcaaaaatctgaggtgagactcaagaatatgtttttaacaaggcaaaaccagtttaggatccatagtttatagctctaacttgtaccagtgctttggccagccagtgccagatatgtttttaacaagtcctccaagtgattcttatgcaaatctagtttaggattcatagtttatagccacaacttctaacagtgctttggccatccagtgcacgcctttgctctcaaggggcttgggtgaatgtgcagacagatgaaaatactaggaagcagtacaaatattaatcctaaagtaacaggttgttcataaaagcatcctgaatttaggaataatagctttagataaatatatttgtaaatcctgctgaaacttgaattttaattgcatgtattgaaattttgctgaatgtgaaaaaaattttacttaattgtgatactttaacatcttggtagattctttcaattcattctgttaaaagattaatactttagtcaactatgtggcaattatgtctttcaagcttcattttaaaacttcattttagttttaatttaagtaaaatgttttatttcggttatgtgggagtagtattcagtgtgtggagatttctaagtaattttaattttttactccttcggttcacatgtatttaactttaagattctgacactgtgtttgttcttttctgtaactctggggcgtatgaagtgaatatatctgtttctcttcttttttctttttctttgatttctgtagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactggggcaaaaatccctaaagattgcagggtgttgtacacactactatctcagaaatagttggttcgttgccattcttttggaatacttctcatgctctgatactaaacccacagctcccctccactggcttccatgtcactgtcaactggagagagtgagagtcctagaactctgcatacctctggccgaaccacaactccctagtcgttgatccctactactcactggattgtcaccattatttgccttgagaccatttggattatgacattataccatctatctcaatttgtgttagtcatttcaagtatattaggttatctttcatttctcagactcatcccatatggctgtcatctgtttctgacctcgtcttccactgctctctaactcctgaaacccttccactgtgctctctggaactcacagtcaatcatcagcaaaactcacatgtctctaattctcttctgaacatttctgtctgtttcttacactacgagaacctcctctgaggcttccctgtagttctctcaagtggtcagtcttttctctttatgtctctcatactaatttgaagatggtataggtgtcctgtttgtcccacatttctgcttctcaaccatcttcctctccttgaaccccccagcttttaatctcatgaatgtataccatctacggctctccttactattgtcatctatagactcctagaccatttcctgtcatttcatgaaagttttagctaaattttagcttctactcaccttttagttctcttcagtattacccctgttataattctggatgatttcaatatgcatgtagctaatccttctaatgctttcagttcctgaacctcttcttctctaatgatcatattctctacctacactggccacttattttctcctatggtcataccactgatcttgtcattaccaaaatagcatttgttagtatctgcccatctgccaccaccatctcctttgtttctaactcaccctctcaagtacttcaactctgacagttttcacccctaccaagacttctatcaattcattgattctaccacctttgcactgaccccccacactcattcttacttccctctttatccagttgaggttttgtagtatgttatttaatcccttgcctatcccttgaaccatcatatttccctggtaaaattccaaccatagttaaatataactctgcctgcttcacatttgcacccatgcatttgaatcttcctgaggaaaagcacaaccatgcagactgatatcactataattcaacgtctagtgtacctatgatgctatcacacaattctggttcacttctttggttcatcacttcatttagctcattcatctgctatctaggagattgcttttttatatcttctcctgtcaaaccttcgacacttttttctttgatttcacccataactgatattcttcgctttctgtttcactgaaaaaatagaagcaatcataaaagaattttataagctcttgccaccacttatttatctgtgcctatatactctgttccttgggatgaattctttgtgtttatttctaaggcctaccccccaacttgtgctatgatcccacctgctcttgcctacatcactccagccactttctcccttctttcttatttcttggcccttttctaccatttccttcctatcattttacaaatagtctaatttctgtcatcataaaaatctcttttactttgcatcttttgaatatgcctcatgtcttcatgacagcactccttaaaataattgtctaaaccaggccaggtgtggtgtctcatgcccgtaatcctagcacttcgggaggcagacccaggaggatcacttgaagtcaggagtttgagaccagcctgggcaacatggtgaaaccccatctctacaaaaaaaaatacaaaaatttgtgtgaggtgacatgagcctgtagtcctagctactggggcagctgaggcaggagaatcacttgagccagggaggcagaggttgcagtgagctgagatcatgctgttgcacttcagcctgggggacgggagtgaaaccctgtctccaaaaagaaaaagaattatctaaaccagatgtctccagttcctctcctcccactcctatcaggcttttccactgaaactgttgtagcagtgacttccacattgctaaatccaatgatcagttctcagtcagcagcatgtgacagagctgataactccttgctctctgaaagacaagtcacgctttcctagttcttcctgtttcatcaaacactccttttctcttctgttgaattctcttaatctccccatcctctaaacattggtgtacccctgggactattcctctgatctcttttcttttcccttcttttcttttttttttgagacagagtctcactctgtcacccaggctggaatgcaatggtgtgattttggctcactgtaacctccgtcctgcagggttcaagcgattctcctgcctcagccgtctgagtaggtgggattatagatgtgtgccaccacacccagataagttttgtatttttagtagaaacagggttttgccatgttggccaggctggtctcaaacttctggcttcaagtgatccacccaccttgtcctcccaaagtgctgggattacaggtgtgagtgatctcttttcttttacactcattatcgggctcatggtgattctgaaatttatatccctggcctggaactctcccctgaatttcagtctcatctccagctgcctccgtgacatctccacttggatgtctaacagctcagatttgtaaaactccccatctttatactaccaatctacactttctactgttcccatctaagtaaatggtaatgtctttcttctaattgcttaggccaaagatctttaagttattctgtatctcccctttttcccctcatcctgcatgttcagtccatgccatactgttcccttcacttcaaaaaaaattttttttcgagatagtgtcttgctgtgtggcccaggctggaatgtagtggcgtgaacatagctcactgcagcctcgacctcctgcctcagcctcccgggtagctggtaatcacaggcacacatcaccatgcacgtcaccacacctaactaacctcagcctcctgagcagctggtactacaggctatgtgcgtcaccacacctggctcattttttaattttttgcagagatgggctcttaccacgatgcctaggctgttttccaacaccagctcaagcaatcctcctgccttgacctcccagagtgcttgggattacaggcatgagccatcgtgcctggccaaaaaattaataatctgataattttctcatttaattgctaccacccatcttcagttactattaccaccatcaaaagtaatagtttatctttttgtttttacttccactcttacttcctgcagtctattcttaacaaaacaaccataatgatctgttaatgtaagttaggtcatagcattcctttgctcaaaatcctccagttgcttcccagttcaatcaaagtaaaagcaaaaatcattacaaagtccaacacaagtcttctgccctttttatctccttgatttatcttccagtactccctcactggtttcagtcacacttttaatttttatcttatgtaacatatacttatatagcacttagcatcattctaaggactttatgaatatgaatattcatttaatcttcataataatattatgaggtacgtatcaatattatttccattttttgaaatgaggtaactgtggcacagagaggttaaagtaacttgtccaagagaggtgaaagtaacttcccagttaggaagtataggagccaggattcaaacccacacagtctggctctaaaattgtgctcactcttccccagtcgtgctgggtagtctcctgcttccatacctttgtgctttctgtgctcttcttggacgtttcttcccccagtttcccacatgactttgctcactcatcaccttcaaggctttgacaaatcttacctcttctgtgaggtctttttatacaatctcatttaaaattacaaacagcaacggttgatctacagtgtcatcaaggaaggaggatctacctttctgttccattattcttgtgtgtgccttccccatccttgaggtctaggacgacttgtggagtgcagacatcgcatccgtgttctagagagcagaaagagagaaagggatgcctaccagctgaatctcacttaagactccattttcttgttgccagaacttaatatgcccgatggccatactaaattgcatagggacctagaaaatgtagcgtttattaaaggtggcaatgagcccaactaaaagtcagggttctgttactcaggtagaagaagggaagagacaaccagcagtctctaccccaccagggttccatctttatccgtacttgtactttactatctttgaataacattataaacttttatagcttagctaccaaaaataggttgacgactctcatccatgctgccgaaacatatcagctacctctgatattggagatctccatttagatgttccagaggctttgtgagctcaacgtgtttaaaattaaacttatctttcatctttaatggctcaaatgtgctcctcttcctgtaccgtacctccgtgaatggtaccaccagtttatatctccttcacctcgtacattcacccagttataaattaattttgtaaatatttctcggatctgcctaattctccttccttattgctactgtgtagatcacgccataacccctccccaggattacagtagagttaaatcataacaggtatttaagttcatgtcattttaattcatacagttcaaaagtggggaagaaaataactttaaatagtgctgggtaatcctgcctgtattctactcagtgaacatatattcatctggggactgagtgtgaggtgggaaatataataatgttgctccctctgttatattttttttctttaaagataacttttttttttttaagacaaagtctcgctctgttgtccaggatggagtgcagtggcgcgatctagccaaaccgcaacctccgcctcctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagccaagtatcaccagatatttcaggaaaacctttaatgtgaaagatatatactaaaacagccacatacacacacacaagccaataatgagatacctctacacatgtattagaatgacaaaaatctgaaacactgacaataccaaatactggcgaggatgtgggacaacaggaactctcattcattgctggtgggaataagaaatggtacagctactttggaatacagtttggcagttttttaaccaaactaaatataatctcatcataggatccatcagtagtgctccttggtatttacccaaatgagttcaagacatatttctacacaaaaacctccataaagatgttaataacagccttatatttaccaaaatctggaagcaactaaaatgttcctcagaagtgaaagaattttaaaaactgatatatttgtacaatgggatattattcagcactaagtagaaatgaggtgccggagccttggctcacgcctgtaatcccagcactttgggaggccaaggcgggcggatcacctgaggttgggagatcgagaccaacctgaccaacatggggaaaccctgtctctactaaaaatacaaaattacctgggcgtggtgctgcatgcctgtaatcccagctactcaggaggctgaggcaggagaatcgcttgaacccgggagttggaggttgcggtgagctgagatcaagccattgcactccagcctgagcaacaagagcaaaactccgtctcagaaaaaaattagctgggcatgatggcgggcacctgtaatcccagctagttgggaggctgaagcaggagaatcgcttgaaccccggaggcggagactgcagtgagctgagatcatgccattgcactccagcctgggcgacaagagcaaaacctcgtctcaaaaaaaaaaaaaaaaatacccagcatggtggctcacgcctgtactcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattccaagtatgtgacattctggaaaaggcaaaactatgcagaaaataaaaaagatcagtggttgccagagtttagcagagggagcgtgaataggcagagcaccctcacctttaggacagtgaaatgaatctgtatgatactataaagtggacacgtgtcattatatatttgtcaaaacccatagaatgtacagcactaaaagtgaaccctataatgtaaattatggactttgtgtgataatgacatgttaatatagatacattgattgtaacaaatgtaccactctggtgcaggatgttgattgtaggggaagctgtgcatgtgttgggggcaggaggtatatgggaactctgtactttctgttcaactttgttgtgaacctaaaactgctcctaaaattattaaagaaaacacaaggaaagaaacagactcagaggaaaagaggaaacagacaatacaagaccagatgaaaacttaaaaagctacatttaataactttagagaactaaaagaagatcctgcattcttgaaacaaaaataaggaattataaaaagggtatattcagaaaaccaaaagtcctagaagtcaaaattagttcaattgttgggttgggagagttacagaagtttcctgggggtggaaaaaaagagaaagcttgaaaatgggagagaaaagataagaaaattagaagatcagtccaggaagtccaacatgcaaataatagaaattctgcaacaagaaaaaagtaaaagggatggtagaaaattattaacaaaataatacaaaaattgatgtaactgaaggaaattagtttcaagattaaaagttttcctcccggtatccagtataatacttgtaagataattgttacccaagacatactgtgaatgatcagaaatccagttatatagataatattctaaaagcttacagagagaaggaacaaacaacacaaaaaaaattcctgcaaagaatcaagaaccacagtagtgaaagtcttcctaggagcaatactgtaaactagatgactataaaacaatgccttcaaaattcctggggggaaatgattttaatatagaattctataactagccaaactgttgcttaagtgtgaagtttgaacaatgacattttcatatatacaaggtctcaaaaatttttattcacccttacttagtgaacaatagagtataccctttaccaaagttagagagtaacaaagaaacaaggaatcaggcacaggaaagaagtggagggaattcccaggacataactaagcagcagatctaagcaccatctacagattggagttgtgaggttttttgtggttttgggagggggtgtttagatgggatctcactctgctgcccaggctggagtgcagtggtgtaatcttggctcactgcaacctccacctcccaggctcaagtgatcctcccacctcagcctcctgagtagcttcccacctcagcctcctgagtagctgggactacaggtgtgcaccaccacacctggctaatttttgtactttttgtagagatggggtttcaccatgttggtcaggctgatctgaaactcctaagctccagcgatttgcccacctcagcttcccaaagtactgggattatagatgtgagccactgcctggctggagttgttcttttcacaaaggcacagtcctcgctccaggtcatgcctgccctctggattgtgttcaggatggaaactcttttcttattcctctgagtaaagggattgtctttctcatttgtcggtctaactcttaatttgtgttaacagtgcttgagtagattagcagtcaggccgggctgttaaaaaagtcagaataaaatagggattgaaccaaggtagtaataaggtgaataaaagaaagaaacaggttaacaaatggtggggtgcagcagagttccagttgagaggagctgatatctgagtaaatgtggacaataaaggagaagtagatgtctggtgtatctcccaggtttccggcttgagccactggattaatgatagtgtcatcaatgaagataggaacacagtaggaggaggttgttcaaaataaaaatgagttcagttttagacttatatgtaggtggacaaggcttagaactgaagcacaggctagaaattcattcattcaatactcttgtctactaataagaaagagataaataagagccagttacttccctgaaaaagctcatagtctaataggggaaacaaatacataagcaaataatttatatctagtatgataaatttaacagtttaaatatgtataaggcatagtgatatcttagaagagagagtgactttgatatgggcaggaggcagggaaatactgggtagaagagggtggttccccagcaaaggcccccaccccccaagcctggaaacccatggccctaattgggaacaggcatttctgttttcatgtccaaatgttgccttctgcctgccatccccgcatcctgtacccatataaaccccaaattccaggtccacaggcaggagagcagacaaacagaggagcagaagaggagcacagtaaaggagagaagagaaggagtgtttgaacgtcaaggagaggtcggttggggacagctggagaggagattggccatgggacagcagaactccaggggaagatcatcttcccactccatcccctttccagctccccatccatctcactgagagccacctccatcacctaatacaattcccacattcaccatccttcaaatccgtctgtgacctgattcttcctggacacaggaaaagaatctgggtacgaagagggcactgggctggttaatacttaagcaatctgtggaaggcagagctaaaagagcactgtagcatgcccactggggcttcaggagttgcaggcatgtattcctagatgctgctgtggggctggagcccaaaagcgctctccccgccccctacacctgccggtctgcgagctccgcctcctgtaaggggtttgagagtgcagcagccgaacagaacagacaagccacagccctgtcgcaggccctgcccttcgtgggggatcaggggactctcccgtttcaactttcccttagttggagggtgagggtcagtaaatgttcatggacaactaagctgaaaaggaatttgactagcagacaaggcaagagagaatattccagcatgtgcaaggatacaaagccatatactacctattgtattcaaagtaccaaaaatagtttactgttattagtagtacataaagtacaaaggagaaaattaaactggagagttagacaagtctcagatcccaaggaatttgtagtttttgctgaagcagtgagaagccactgaggttgttgaaaaagagtcaaagtagatactggaatccactgttggttgcttccaaaaagaattttggtcctttctagtgcccagaacataatctctttctctggcaaagaaaacgtagtcttctgtcttccttttcctaaagaaggttacaattattttatgaagattgtaattttgagtaatgataatggaataaagaaggagtgaaatggcctttgtgtgctcctcattttttttcttttttaaggcaaaaaggttttaaaaccctctggagcactgattctgaataccttctttttataacattttctaaatgctccctttactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaagccatgaagtttgtgataatttcttacagcagccttaggaaactaatacactacttacataatataatgccataacaatgaaataaagaagacacaaaaagtaaatgttagtgatgtgactttccatttaggaaacaattttttgcaaagttccaaacaaaacaaattatagtcttttctgcatttacatggtaattgtatttctggaaaatttaatatatattcaaaccattaaccaatgtttgtagcatctgccatgtgcttgacacacagagagtatttaataaaagctggatacatgggtgatgaatagatggatgtattaaagctacaaagagagtacataagttccaaaataaacatgcaaggcaaaaattatgtgtagtcaaacgtatctttaaaaattcttgggcaggcccagtggctcacgcctataatcccagcactttgggaggacaaggcaggtggatcacgaggtcaggagttcgtgaccagtagcctgcccaacatggcgaaacccatctctactaaaactacaaaaaattagccgggcgtgatggcgggcgcctgtaatcccagctactcgggagcccgagtcaggagaatcgcttgaacccgagatgcagaggttgcaataagctgagattgccaccactgcattccagcctgggcgacaagagtgaaactccacttccaagggaaaaaaaaaattctttacatagcttatcaaatacagtgttcaatatctacatgacgtactggacactgacacataccatttctcaataaagagctgacagccctctctccccattccctcagcatcgtttgggtatcttatgaaggacatgagttgttttagggatgtaatgaattccattcagcactatgaggtactctcaccgacaatcacagaagaattaaaactgactgaaaggcaatagatatgtttcccatttcaaagctcactgtggacattttcttatggtttggaatggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgacaatatttactttctgttttataattatatttgtttgtttttatccataggttgaagccaaaagttgaaaactattaccatttataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctgggctctttactatgaccagagtttattaattgtcctatttcattgaggaaaaaatgcaaaacagaacactggaatgactagctggaaatattccactatttcatgggaagcaggtttctaaacgattcctgtggaggccaaactcttgctctcgccaaaatattatagcattaaagtgtgccttgatggtacattaaggaagaaattttccccgaatttacttaagatttatagcctttctgctctcacaaaacgtagcattgatttctttaatatcaaaaaaagtttcctaaaataaactgctaatgattgctttcagtcatttgtttacttgaggtcagtcatgccaagtactgtttgtatcaattcttgtaaaagactcaattaattttgtaattgtcataattactgttattcctgttctgtaggaatatgctattaatgtaactggacatcaccacatcttatttttgtatctctcaaaacatctttcataaaactttgatggtaggaaagagctgaaaaaaaatctcctgttagtagaccaagtagtacttcaattactaaacaccagagaaaattaaaattacaccttaaataaaaccaaccagatatttggtagagaaaatggaactgtacaaaaatatggtttttaaaaataaaattctaccacttgtattatattcattatagactattggaaaccgttccctgccaaaaaaagaaagaaaaagaaaaaagtttgtgaccatttgtaattcattttagtctttttatgtatttttttcacctaaaataatatgggcatttaaatattttaaatatagttttaaatggctacatattattctatcaaaaatacctaccataatttatgtaaccactttctcattgttgagcatttaggttagttttgtttttccagttgaaacaataccccctgagtatctttgcatataatgatttctcttgattttagttttaagacaagctcttaggggtcaaatgttttaaatattttaaaggttcattgttcaaattgcatttcaacagtcaataccagtttacactgttttcagcattttaagaaattgcccaaatgacagagcagaattttaaaagtatttccctagtgttgatttggtttatatgctgagatgctgcagattttttgttgttaaaaagtgagtatgtggagatcaaacatttggctgactgtgtacacattttatttagtaaagcctcaatgttaagcaagaagccattactcatattcatgttgtctcaggaatggaaaagtgcttctaatttttgcaacaaaagaagtctgatggcagtgacagaaaggaatgactagctagatatgctgaccggaaagctagaattaggatttgaccattgtagtcagtctccatttaagagcctaatggttttttcttctcaatttggaagtttgctgcatttagagatattcttataaaactaaaaaaaatagacccagggagcaagtttgaggttactaaaatgtatcccattattgtcagagttgcatttcaaactgtcttcattaaactgttagtttgattacattttctcaaacagtaactgttgtgttttaattttttaaattaaaaataagttttaaatttcaggtaattgaaagaccaattctttttggaatctttcagtattatggttttggttcacagcgaaggtatttgcttgctacatttgctaaatatactatctatacttcattttgttgcataaaaataagacatactccggttagcctttttgatgggtattaccttgatgacttgctcactgacagagaaactgatgtaaaataggtcatttgaaaagcaggtgtttgatatatccccatatgtaacactgaaaagccttcttgctctagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccatgatcaagtgggcttcatccctaggatgcaaggctggttcaatatacgcaaatcaataaatgtaatccagcatataaacagaaccaaagacaaaaaccacatgtttatctcaatagatgcagaaaaggcctttgacaaagttcagcccattcatgctaaaaacaataaattaggtattgatgggacgtatctccaaattagaagagctatctatgacaaacccacagccaatatcatactgaatgggcaaaaactggaagcattccctttgaaaactggcacaagacagggatgccctctctcaccactcctattcaacatagtgttggaagttctggccagggcaatcatgcaggagaaggaaataaaggatattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaagtacctaggaatccaacttagaagggatgtgaaggacctcttcaaggagaactacaaaccactgcttaatgaaataaaagaagatacaaagaaatggaagaacattccatgctcatgggtaggaagaatcaatatcatgaaaatcgccatactgcccaaggtaatttatagattcaatgccatccccatcaagctaccaatgactttcttcacagagttggaaaaaactaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacacctatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacattagatctaaaaccataaaaaccctagaagaaaacttaggcattaccattgaggacataggcatgggcaaggacttcgtgtctaaaacatcaaaagcaatggcaacaaaagccaaaattgacaaatgagatctaattaaactaaagagcttcttcacagcaaaagaaactaccatcagagtgaacaggcaacctacaaaatgggagaaaattttcacaacctactcatctgacaaagggctaatatctagaatctacaatgaactcaaacaaatttacaggaaaaaaacaaccccatcaaaaagtgggcgaaggacatgaacagatacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaatagaaacacttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagtggattaagaaaatgtggcacatatacaccatggaatactatgcagccataaaaaatgatgagttcatgtcctttgtagggacatggatgaaattggaaatcatcattctcagcaaactatcccaaggacaaaaaaccaaacaccacatgttcttactcataggtgggaattgaacaatgagaacacatggacgcaggaaggggaacatcacactctgaggactgttgtggggtgggaggaagggagagggatagcattaggagatatacctaatgctaaatgacgagttaatgggtgcagcacaccagcgtggcacatgtatacatatgtatctaaccttcacattgtgcacatgtaccctaaaactttaataataataaaataaaataaaataaaagaacagaccagatgcagtggctcacaccagtaatcccagcactttgtgaggccaaggtaggaggatggcttgagtccaagagtttgagattaacctgggcaacatagtgaaaccctgcctatacaaaaagtaaaaaatgaaaagttagcctgggcctggtgtatttgcatgtgcctgtggtcccagcaactccaggggctgaggcaggaggattgcttgagcccagtagttcaaggctgcagtgagctgtgattgtgccagtgcactctagcttgggttacagagtaagaccctgtctcaaaaaaataagaatgtacatatttaattgtaatatgaaacggatgctgaaaatgaacaccgatataagtgacatatcagagatgctctggagacttggttcatataatatggaacaaaattaccttctcaatgccaaattagaaaatgatatgtacataattttcaggtttaaaatatatataccaaggctttgggatgttaaatataaggaatgttgcccatgtataacattatcaattaagcttaagaatattaaagatttgttgattaaaataattactaatttttgtgatagcttttactttagaatatgtgatttgaaaaaaaagaatgttgacatttcacatagttggaaaaaattctagttcttagttttgtaacttaattttatgttctaaaatatgtctcaaatccacccttgtaaaattattagtcttttattattaaagcataaagtttgctactcataaatcaaattatatatctcaaattcaaagctaaattgcccttgtgcattgtttagcagtatgtaaatacattttagaaaagggctgtatcattcatgaagtttccaaattcgttgatcaattctgataataaagttaaaatttttgttcttaattagtagatctcattattttttcagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaataggtagagaaaaataattgtcttccaccagtaatcaggagttgaacgttactgttagtgctatagtatatatattttttaatttctgaagaactactatacttctaaaattcatattcattttggctccaaacaggaattcttttgtttgtaaatctgttgtttgtgtttttatgttttcgattgacaaatacaaattgtatatatttattatggacaacatgtcattttgaaatatgtaaacattgtagaatggctaaattgacctaattaatatttgcattacttcacatacttaccattttttgttttatttttattctaaaaggatactctatctgtaactggctaaactaacttctgaaagtgagtctggaggaaatatatatagctatacaatggaaagaaaacctgtatttacattccagttaactttggtggagttttttgtttttgttttttcagacagagtttcgctcttgttgcccaggctggagtgaaatggcatgatctcagctcaccacaacctccgcctccctggttcaagcgattctcctgcctcagcctcctaagtagctaggattacaggcatgtgtcaccaggcctggctaattttgtatttttagtagagacagatttctctatgttggtcaggctggtctgggcctcccgacctcaggtgatccacctgcctcggcctcccaacgtgctgggattacagcgttagccaccgcgcccggccctaactttgtttttaaagtacaaaaaggaatgcttaaatcatatactatatagcatcatggcttggaccttagtcacctgaaacttaaacaaaacagaatatgttacttgagggtaaaaggttttgttaatcttccttagtagcaatgtttctgttctagaggattaggatgtttggtgtagccagggatcagtttcctccatctagtttaaacaaagaagaaaatattttttgtatgagaaaattccacaattaatataacataacctataaacataactctaagtatcaacactgacatcactgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcatatctgattaccttgagttccccaggaatctcatcaaagatgataagctaacaagcctacagactgaatttagtcctcaggcacattttatatggctcaaatattttttatttttaactgattaccaactaagcatcattaaagtatgaaaaaatttcatttctgactttctttgaaaaatcagatctggctacattggatccacattctcacatattatcaactggccagagctgagtagcacctgccccattgaagggggaggaattctccaatatcctacagttcttgccaactcccattgtcttatattcagcttaattcacattattgagtttggaacattttgcctatattttcagggtttgagagtaattgggctctagactttattaatctctgggactgggatgctcaaagtctgggatgctgatatagtcagaaaacttatatcatttccttttaggcaatatagcattggcatagcacacccagccggtctttttctacttatttaagcagtgtgataaaaccagcaagaagggaatgagacaccactcccacacttttaatttttatacttgataatcatcgattactagcttttaacacttttaacaatttaaaagtgactgccaagaaaaatttcaaaaacttctttatagtaactttggaactattaaagaaatactttttaatgtgatgattattaattttatgtatttcaaatgactggcagatttctttttagtttctcctcacaacttctgcatctgcttttttagtaatagttactggattttaataaaatactgatccttttatattgtttccccttctatcttctgaatatttctgttcttttacagttggtggtggcaggcaccataataattcagaatattggaggtaagcaattgcaagtgcactgtttatacataaatgtgatggcaataatgtcctttgaattgttatcttactacagatctagctgggaacttctgtagacatagctatcttcagaagcctgtgtgttggcctctttactctttttttttttggatcctttttagcagcacttgtgacagtagcttctaaattcagtttgagctaaaccctgattgcagtcgtgttattaggtctgcaacacacctctaaaacattggctttctgtgattctgaaggtaggatacagtctggaaaagctctcctggtgattttaaaatattttccctctacttttgttctaatcaccctattggcagatactactttagagggattagtgttccgtgggctgtgaacaagcaagtatggacaacagtgtcctcttgtaaccaagaatttaaaatgaccaagtggtttaaaacataaataaatctgagataaataagcattctcacatttatcctgtatcttgttcctattaataaccaattctagaaatgatctcaatattgagaactatgtagaaataaaactactgttaattatagacagttactgagtaaatgtattaaacatttaaatccaaaatatgggtatcatgtgtgtatatgttgtaaagaagttgcgtagtgctgaacaatatcttcgttttcttttatcattgactggagtgctaaataaatgctcttaaaggaaaatacacagaaaagtttgacatgtactttggatcttatacaggattgtatagtcagaggacattttaatcttattttttacatgtaacagtttaattcaaagatgacagttttaataaacttcagctctcataatcaagaggtctgagctatatcactttaagtattgttcaatcaaattccatcgttaataggtttttttggttaaggaaaaattgacattccaccagtgaattgtgctgccattgttttagaatcctgttttaattctttgaattttcatgaaaaaatatgaataaaaagaatgctttcttgcatgccataccaaataattttctcctaacacacactacttcacacttcacagtagaaagtcaagaaaaccagtctcttcatttatgaatttattatagtcattgattttaagatctattttggaataatttatttagcaactaagtattgcttaactgtgcactgataatgtttctgaatatgatgtatatttttatatttttaatccctctttatcctctctgtatagattctaagaactatcacatattgtttaggttagattgaaccattgtttaacagtttatgtagactgttcagttcagcaatttagatccaaatttgtgaccctggcacaaggcccactgttgtattctttgtccctttcaccttgattccttccttgttctctaatcttgtttataactgttattggagatggctatactgtagcacttggctgctactagatttaacttctctgtatgtatgctcctgtaccccactatattgttaagttcctttagctcaaaagtatgcctcatttctctttgtactcccagcacctattacacctgggaattgataaacttgttgagcagaatagagctgaaatgatttgtataatctctttctaagtaccttaaatattctagatatatttatcaagaagagaaaagggaaatgctagaccggcatctagcttcaggtatttgaaagactgaacatgaaatataaaaaagacactagactaattcaagtattgttccagagggcagaactggtgctaatgtatagaaatctacagagaagctgttttgggttttcttattcggagtacccttgtaactaagctgtgtgataatgaggatggcctacatccctttgaaaatgctccttagccctgaaaacattcaaacagagctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatatattggatatttaaaagattatattaagtgtaaatcagattgaatttttacacatcttaagtgcctgtctgcaaataatgtagttcagataacttttttttaaaagaatgtttgttagtataaattatctgacttttgcagtggttgtttacattaaaactgaaaaataatgtaatagattctatttaggtcaagcactctactagatactttaattataacaactcttcaatatagatattatcttcattttatagagaagagatcagtgtgcagtggagataagtagcttgctcacatttatcccataatgaagcttggattcaaaccttgctcagttggcctttattctttctgctatgatatagcaaatgtttgaaaaatgtgaaaagattaaatgttgaagattttctaacttcttggggacaggaactatgtgtttttatttgttttcctaactttacctagtttctgagaagagctcaataagtagtatttgttgaatgaattggacagtttttaaagttctgcttaaaagcctaagattttgcctcaaagagacaattgaatatactatgtaagtgataaaaaaagaaacttgaaagaccatagaatgacttctagtttagaattatataaaaatttaaaagttcaaaatactggggagagttagatctcatttatgtaaaatgggttaacaatatattgaaataggctgggtgtggaggcccacgcctgtaagcctagcactttgggaggccaaagtgggaggattgcctgagctcaggagtttgagaccagcctgggcaacatggtgaaacccagtctctactaaaaatacaaaaaattagccaggcttggggttgtgtgcctgtaagtcccagctactcaggtggctgaggcaggaaaatcgtttaaacccggtagacggaggttgcagtaagccaagatctcgccactgaactccaacctgggcaactgtctcaaaaataataataataataataataataatatatatatatacacacacacacacacacatatatgtaaaatatctattattttcaggttaagaaaatcatatcttaatgtttcttaactctcttattctttgtaacatttaaatacttctcagttttcatgagatacaattcctgtggtgaatccatgaaaaaaattgaaatggaaggcctttaaaagcaaaatgaccatggattgcccttgatcaatatttgtttcatgtgtctttcgccaaagacccagtttatttcccacatttccatattccataaatcaaattaatgtgctcatttatttacatccctagtacttagcacatagtatacatttagtaaataacatttattataggaagaaagaaaggactaagaggggagagggggaaaagctagtgacctggcttagtactccttcaagagcaaaaagagagttgattgaccaggaagagaaagcccagtatatgtaagtgagcatatagtttttaggaaagcgtctactgttagaacttcacagaaaatcgtttttctcccccaagattaatcaggcaccaagtattagtcacaaggctctagtgtggtctgacaaattgattgaaaaaatctactgtctgtaaatctctaaattttataatggaaaaaaatgcaacacactagatttaacactcttattctaaggttatagaaatccttggctttggaaatttgggaaccatatagtaaattactacttaaaagcaattcctgatatcttcccaatactaatgaataacaggctcaacattggctagagccagaggtaaccctctgcagcccatttcctcaggtgctggagtagcatttgttgagagccactgctactgggacccaaagtcagaaaagatgtgtctggaagttttaacatttaatgctgttataggggacaattctggcttagagagtttgaatttggcagcctaactaaagataaaagattaataactgtagtagaaagtaagtataaggtagttttcacatagttcctgtaacagtgttgtattatgtgattcttttcttaaaaactaaggtaagtagttggtttcacattcatttgaactcctgaagtaaaccattcagtaggctagaattatcactagaaatcaaacactacatcccaatcatcttcttagtcaagccagaaaaagtcttattaactcttacaagcacatgataacagtgaagtcaattgatgttatttctggtttcacaacttgcccaattcaaaatgtggaaagatgagtagctcctagggggatgttatattcttattttgctcttataaatatgaaggattactatgaatagcatatgctttccttaattcttcaaagccccagttctttaaaggagattaaaaatttaatcattactacgttttgtgaaaggaaaaccataaacattagtagtcttactgaaacctcctgaaattgctagaatgacccagatgtttcagtctggcacagaatccacacaccttactcttgcagcctttattaacacctcagtttggtaatctatggactcgggtaaccccatttctaaatctcagaaaggtataaataagatcattttcaattgagaattataaaaatctcaaattctcagtatttgaaaaattcacaatattagatgctagaaactacttggatttgctttcttcctgtatattcattcatgcattttatttatttactttttggtaggctagtaaagtactaagagtgtttcagatatactagtttgtattgtctcttgggaaactaggattgggcgcgcagatacatcgccatctgctggtcagtttatctgtggtgaaactgcagctttcttgagacttgtctagaaattctagaaagcactgccttagaataggagaggtacaggaaatttggagagtctttttcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttctggtagactttccttatttgtctttgttttgttggtttactttttcactttgctcctgcactttctcatggcatactagttaatagaacgagtttctcaacccaggcgggctgtttgcaccatcactagcttgggcaagttacttctttgtgcttccttatattctgtgaaataagtaatatgtacctcacaggtttgtgtaaagattaagtgaggaaataacttgtgtagaatactaccaagcatacagtaggcatctaaaaaacaaagatgttagctgttttcatggatctctgcccagagtcccttccctgtttctgtgtttctaacatctctcctctcaacctcccgggcccaattcatttatttcactttataattagatcagcagatattaacaccttgcaacttgctattacctaatcagattttaccccattttagtcactttttaatattactgttgcttctccatgttgtttttaaagagtgctttcaacttctgtgttttcagttgacagatgttttattttttcccagagaagtttctattaaatgagttatattagtttaaaattaagtagaaaagaatacctatttagttaatgtgctaaaactaagtgatttataatggctgaatacctgacatcaaggtatatcttctggcactgattttggctttggtggtttggggccacttaactatatgcatggctcttgtggatgacccagttgcagctattaatttagagtagaacatggtgtgtcttgttttaggaatctatactaggtgtccatgtcacccaaaatcatttgcaaatttttgcttatgattggtctgtaagataagtgcttaaacactttcttatgccatttataaaagacataagacaaaaactgtggcagacagctatttgatctagtaaaccttttagttaaaaacaaaggcaatatgagcattcctatcaatagtatatctttaaaacttttccagttcattttattgagctgattgttcttttgtatgaatttaattaagatatatttcctaacttaatgtgtatttggtaatctttttgtttcttttctgtattatatataatataatgtgttaaagtgctagctagttcttacatgaaagtttacttgtgattaagaaaaaaataattttcatagtgaatagaatggtggtggcctttgttttactggcttaatccgtgtgggttttcccctatagtaagttctgtggttgtatactcttaaaatatatactaacattctctagaaaagaagcaatgttttgcatgttttattatatttgtatcttgtatgtgaggtcttctttgagagagaaacacgtttggtgagttcatatttcttaaaatatacatgattcttcagactggaatctaatgaaatagtactcccatttgaaaaccaaagagttgagggtacaacaaaggataaaagtgatcagatgattagccaggggctaatagaaattctggaaagaatgacagatattatattagaaagaaataggatctcatattcactgaagctttctacagctaaaggtccaaaagaaataatagaaaattactgaaagagatgaatgtctgaaactttagaaatgcatgtggtgttggattaatccaagcaagaaagaaagatgggcagataataaattacattttataggaagtctgctttccttgttttcaaagtattttgtcttttttcttttctgtctctctcacaagatatatttaagtaagtctaggccggtttcagaaaattcagttcacaatttttatctttgcaccatatgtgtagagttctttggaatcggtaaaatattataaaaactccaaatccttgaatggagaaggttagtctaaaccttccttctgttctgtgccaaattgatagcatttttccttacgagaatatgaacaatacagaacacattttcacatacaatcagttgtaataccccataactaaaagattttgcagaaatgtctcagtggattttagtcaacccactgagacatagctgtacttctgctagggaaaaagaaatcgttgtaaactgaaaaaatatgtatatgtatattttcatcacagagaagtgattatttaactgttctaaattttactttgacataaatacatgttattttactaaaaaaaattgagagtgtatgtttttgtgtctatagtattatctatctccatacaaatttacacgcaaagtagcatgtatcctttttttcctcaagttaaatggtcacatagcattgtaatcatgaagttcagctcctttcaaatgatgttgattgagaaatatacattcttcttaaactatttgagccttttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccatacctattaaacttctgtgtctatgtctgttgttgctaaactaacctctaatgccttagacggagtgataacatataagagagtttttgtaaaactttgtacaaaatttcatttaaaagtagcctgtaatcaagactgtttctcttacctagtttgctttggacttgaaatgtaaacaaaagatacttaatgaacttaacaattgttattcttctctacagttacttttctgtgtgtgtgtgtgtgtgtgtgtgtgtgtgtgtgtgtatgtatctttggtatagtgtgttatatgttaatcttccatatgttgtcatagctctaatggacatctcttttcctagatggattattgtttaaatggttaagaatcatagaattctaataggaacactatttattcttttgcagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaattcttttggcttaaagagaatgtatatttagatcacagtaggaaaacaggagttctgttagatcgttctttattccccccttaggaaaaaattaaagttagtacattcttctgaaatgcttatttacaaaataaatgtatttaatatgtactttttgagatttctttttactagtttgtttttctcaggcagcagttttattttgtaagtttaataatttctgttctttagaaaatatccattgagaaacacaattcatttgtctgtgacacacatgtgaaatctaaactaattttactgtgctttactgtgttgcctttattgttaatgaatggtaaagaaaagcactgtatttaaaattggctttattaagatgaattattaaggataagaaatgattaacgataaccagtagccaagacaaggatagagaaattacattttacagtataattatttttatattaagaatttaaagttcaatcctatgaaaaggagaatgcaaagcatgatcttgaaataaatgaggtagtatctgaaagtatttccattgctactgtcaccttccttttgctgattttacagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatggaatctcctttggtactcctttgggcatttttcctcctggcactgcaactgtctgggtctaacattgggtcccagaaggaaacacatttcagacatagagccctgggccttttgccagcttcagaaatttggttgccaggtgttcctcaatgaaagatcttttgaagtttctgttttgattcttactcaagagtgactagaagataaacacgttgagtatcatttttgtattattgatatgtgtactcttttagtacttcctgcataccaggaattgaggggcatgtgcaaatggagagagcaaagcttcaggtccactaaagctgtaaatacttatgcataggttatagtttctggcatatgtatttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaaaaaaaagcaaagaaaaatcatgcataacatctctaacctagtcactgtccttttaattcttttgaatttttcgcaaaagctttcaaaactatagttaataattatatttatatcatcatcattttccattttattcattgtgttttttcttaaagccacgtaacattccattgagtatgctgttctaaatattttcaaatgttgggtatatagagttttcctccagcttctcaatattataataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctagatgacgggttgataggtgcagcataccaccatggcacatgtatacctacgtaacaagcctgcacattctgcacatgttctacggaacttaaataaaataaaaatttacaaaaagtgtatgttcttattatttttaatagtcttttataagtgttttcaagtatataattatttgaaaattctttatatctattgccaaattgctttccagaaaggtaatttatataatttgcattttcaccagctttttacacacctcatcactcctcactaatgttgactattatcttatttttaaatatttattaattcagtagttggaaatggcatctctttgtttttattcatttctaaatgtcaattcattaataagaaaaataggatcccacaagaacattttaatgaaaggaagtaggcttttcctaatagctggttgtaatggttataactctgtgtgtgtgtgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggtaagtctttatagagcacattatttgtttagaaaaaggaaagaagggagggagggaaagagagacaaatattaaggggctttaaaatttcacagtaccacatttttggcagaaggatggtggttgtgtataattttaaacttggccttattttaggttgttcagccttcagccctgcctagttaacctattacttggtttgcagtagtattttgtctgccccactaaaataaaatctttacagcggaacattaaagagcagcctttccttacagtgtaccattagtggtaagccagttccaattctgctgtacagagctacataaatgatctgtgacagatagttggaatgttgttattctgagccctaagccccagataccaaccactataatagaaaacatgcctaagatgtatagctttagttgtacgttaaaatcgctttccttataaattgctttttattttactgttattttacaggctttcttggctacacaagtagtttatcatttttctttatgatgttctttgctcttgtggtaagtttaaaatataatacattgcttatctcctcactaaaattggactcattgtgttagtcttttttacttttaactgttttgtgttgggaagggtatctcattttatttcactgtgttattaaaagcacttttgttccattaaattatttccttcattgtatctattttgaagaggcttagctagaacagcatttcaaattcagcatttcttgtggttaactagagaggagagcgtgccaattctgttaaaatcctagatggagtgtaattctttgtgtaggtgtgtaaatttattcctgtaccatactgtatgaagaatcagtctggttctaatctgtaaaatctgtttgagactagtcatcttaattttgaaactttattccattaataaaaaaacagagcttctggtactacattgaggagatctagtaagaactgggttgactgaattctattttgtctggtttattcagcatagataaattctcataaaaacactactacaaatatttttcttcacatgtgggatatattccttattttttaattagctcatttttattatataaaaatatcagatggtaaatttaacttattttgatattataaaataatataaagataagaatttaaatttatttccttctaattcttctaaaacatcttaacattctaaagatagtacctttgtgtgaaattttttaagtcttttttctttgtatagcagtttattccataatcagtatctaaatgtcaaaccttaagtagaaataaacatttttaactttccaagaatatacatgtccaaatgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttttttttttttttttgtatttttagtagagatggtgtttcaccatgttagccaggcaagtcttgaactcctgacctcaagtgatccacccacctcggcctcccaaagtgctgggattacaggcgtgagccaccgtgcccagccaccatatttattttagattctctgaatgttatcttttaaaatacatagtggttaggaaaaggaaacgtatatatattaacccagaattttggaaggataccagtttttcatttattattcttgtcaatatgtgtttgtaaatatgtatagcatttatatcatattttttaaaaatcagttcaggaactattattttcttatattctttgaataatataaactaaaacctatattttatctgttctcccagatctgtattttcattaaaaaaatttaacctaaatttttgccccctctaaaatattttgcaattttaaaaataaattatatctgtctcagaatgataccatcaagatggatttacctttttttggtaaatttactttttttttggtgtattttagagcacaagcggattaccattcgttctaaaagttctatcttaagtacagattagtattctaagcaacgttttaatacgtcggtaatccagttagacaacttttttttttaagagacagaatctcactctctccagtcacccagactggagtgcagtggcatgatcatagctcactgcagactcaaactgccgggcttaggtgattcttctgcctcagcttcctgaatcactagaactacagctgcataccaccacgcctggataatttttttttttttttttttgagatggagtctcactctgtcacccaggctggagtgcagtggcgccatctcggctcactgcaagctccgcctcccaggttcacagcattctcttgcctcagcctcacgagtagctggaaccataggcacccgccaccacgcctggctaattttttgtatttttagtagagacagggtttgaccgtgttagccaggatggtctcgatctccagacctcatgatccgcccgcctgggcctcccaaagtgctgggattacaggtgtgagccaccgcgcctggccagataaatttttttttaaatgttggtagagacagagtcccattatgttgcccaggctagccttgaactcctatgttcaagtgatcctcccaccttggcctcccaaagtgctgagattataggcgtgagccactgcactggcctgaaatagagaattatttaaatggtttttagtcagaagctttgcttctactgaacactatgttaggcattttaggatgtggaaatttaacctggacactagtcttaaggatctgtcaatctagtaggggagataaatttcttttcaaacatggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgattctgtttacttttttaggtaataattaaaaaatggtccatcccttgtcctctgacattaaattatgtagagaaaggtttccaggtaatagcttatattttcttttcagtttcttcctttttattttaactaaaaagaaaagaaagactaatgattcttttctgattgatgaaaaagtaatggctatattgcattttagaactttgttttgaaatactttcatttgaaagcctagtaataataaattcatcatttttattgatatattctgaaatttaatggctgttggtttctctttttcccctcaatgctcttaaacagatttcaaatgttacagatgattgtaagccaaagctctttcatttctccaaagaggtgtgtaagttattaacagatacttttagttgatttttcacatttcaagttttaagaggtttgtgtaacagggtctcttaggtctttgtacctgtgactaattaattttcatgaaagtgctaagtataggattgcctaccagaagactactattatttaacacagggtggcctattatgaaacagccacctttttttttttttttttttttttcctggtatgcctttgaatggagcctgttttaaatgggcctctgcctgaaagaacagatttaccgaatgtctggtctggccaataaggtcctctgtgtataccaacttcctgttgccctctgcacttgtaaagctaaatagccaattatatcaaaaactcttcccctgtgagtagaaccttggtctgtagctaaacagcctcatcattggactagggattgagcactgccaatatatcttctggccgacattccaaagttgaaattcatgatgccaggagtagagactaggagaccaagtccctttgccttccctaaaagccataggatactggaaatgcctgtaagagcccctgagcatcagcagaggagacaagaactgtgacatggatggtctctgctttaccactctagaagagctcaaagtcttccctgttgctgcaggcttatttgtctatactttctgactctgctgaaatgctattttgtatagttcccagatgctagaatcccccctgctcatgtaaaactctattagtgtagaatgttagcttggttactccaccatgcagaattttcctttttatctctagtttttaaatgagaaatatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcagagtgcttatgccttaccaaccatggctttttcatttctctgccatacctcaatattgcccatatactgtgaacttcaaaggtactgtagaatcctggaatattttaaatatattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttatacagacttgaactcaataagacttttctgtgtcaataagatactgtaacagggtctcttgggatccaaaaatattttgtatagtggaatagctatatatttcttttattaaaattgctacctggcacaaacactattatatttagggatcttcagcaataagaaaaagtccaaaaaaactgacctccttcttctccctatggataaatagaactatctggaagaaacctcagatggcttgccaatatccaggctggctgagaaattgttagatgaatcaccattaggtgcttagaaactgtattaaattgtagctgtattagattgaaagggatgtggaggaaggatggaagctaatacatttattgagctaacatttaagacagtgtcaggtattttatatatactccctaacttaatccttataacaattctgcaagctcagtgtaggttcatttaggttgagtaattagaccagatacttgaagccagttaatagtggaattgggatttgaatctagttttgtctctctccaaagccaatgcctttattactgtgttgtctactcagaaattgtgctatagaagccagatttcctttattccaagtttttgttaaggtgatcttttagaaaaatatgactcacttaagctctaggcatctatctatgtatgtatctatgtataatctatctatctaacattgctgcttgaacacaaaggctaaaggttttcatcatgtagatggcatgtttcctagacagggatttgtctaatatcaagtaaaaccattatgttgtctctgatttaatctcttctccactaatgcaaattcttcagagtatgcaaattttatataatagagaaatacacatctaagaaaatcacatggtaggtaggtatatgattgattaataggtaggtgggtaggcagatagatgggtggatgaatagatgatagattagatagatagatagatagatacatacatacatacatacatacatacatacatacatacatacatacatacataaatagaataaatgatacaaaagtagtaagttcttctccaaagacagaagaggcagatattgatttgctcttggattgtgaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgctttagttcagatcataatacactgttctttgtaagtcattattgcatttctgtggcctaccaggttgaggccacatctcatgcagaactgtattactaggtctgaaatgcatttccagccctatcacccacacactgtttcatccactgtagtacttactagaccacttattttctcagatgcacattccctttgctttgtttgtgctgctccttgcttctagagaatctcttcccccacatctttgaacatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgtaagtactcttaaagggttttgttgcctagtatagacgcttcctaatagggaaacactaattctttgcagaatagaatgtttgaatcacatctagtcttgtatatcttattcacttgtcaagtaattgatcaaagacttcatacttgcatatggccccgtaaaagcataaaaataacagtgagccactaagctaatttgtgctttttgagatttagtttagatttacgttctcccacagcattgtttccaatttagaaactatagttcttctaaagttttgggtttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaatatattgggttgatcttttgttttttaaattaatatttttatggtagttttatgtttgcagaaatactgaacagaaagtacagagttcacatataccgttttaccccaacatacagtttcccctattattaactcttgcgttcatgtggtacatttgttacatttgatgagccaatattaactattattattaactaaagttcatagtttaccttaggtttcattcttggcagccactagcaaccactgatttttttttaacttttattttaggttcaagggtacatgtgaaagcttgttacataggtaaactcgtgtcacgggaatttgttatacagattatttcatctcccaggtattaaacccagtactcattagttacgttttctgctcctctccctcctcccaccctctacccaccagccccagttgtttttttctttgtgttcataagttcttactatttagctctcacgtagaaatgaagacatgcaatatatggttttcttttcctgtgtgtgtttgctaaggataaaagcctccacctccatccatgttcctgcaaaagacatgatcttattttttatggctgcatagtattccatgatatatatataccatattttctttatccagtctgtcattgatgggtatatagggtgattccatgtcttggctatagtgaatagtgctacagtgaacagtgctacagtgaacatttacgtgcatgtgtctttatggtggaataatttatgttccttggggtatatattcagtaatgggattgctgggatgaatggtagttttgcttttagctctttgaggaatcaccatagtgcttccacgattgttgaactaatttacactcccaccaaaagtgtataaatgttcccttttgtccacaacctcaccagtatgttattttttgactttttattaatagccattctgactgatgggagatgataatctccttgtggttttgatttgcatttctctaatgatcagtgctactgagctttcttatgtgcttgttggcagcatgtatgtatgtcttcttttgagaagtgtctgttcatgtcctttgcccactttttaatggggtggtttttctcttgtaaatttgttcaagttcctcatagatgccggatattagacctttgttggatgtatagtttgcacatattttctcctgttctgtaggctgtttggttttttttgctgtgcagaagctcttaagtttaattagatctcatttgtcagttaatttttgcttttgttgcaattgcttggtgcctttgtcatgaaatctttgcccattcctatgtctgggatggtattgcctaggttgtcttccagggtttttaaagttttgggttttacatttaagtctttaatccatcttgagttgatttttatatatggtataaggaaagggtacagcttcaatcttctgcatatggctagccagtcattccagcatcatttattgaatagtgagtcttttccccattgcttgtttctttcagctttgttgaagatcagatggtcataggtgtgtggccttatttctgggttctctatactgttccattggtctatgtgcctgtttttataccactgtcatgcagttttagttcctgtagtcctgtagtatagtttgaagtgggttcatgtgatgcctccagctttgttctttttgcttaggattgccctggctattcaggcccttttttggttccatatgaattttaaaatagttttatctagttctgtgaagaatgtcattggtagttttataggaatagcattgaatctgtaaattgctttagccaatatggccattttaatgataacgattcttcctatccatgagcatggaatgttttttcatttgtttgtgtcttctctgatttatttaagcagtgttttataattctcattgtagaaatctttcacctccctggttagctgtattcctaggtattttattctttttgtggcaattgtgaatgggattgtctgatttggctctcagtttggttattggtggtgtataggaatgctagtaatttttgtacattgattttatatcctgaaactttgctgaagttatcagctcaaggagcttttgggtggagaccattctagatatagaatcatgtcatctgcaaacagagatagtttgacttcctctcttcctatttggatgtcctttctttctttctcttgcctgactgctctggctaggatttccaatactatgttgaataggagtggtgagagagggtatcctcgtcttaacgccagttttcaagggaaatgcttccaggttttatctattcagtataatgttggccatgagtttgtcatggatgcctcttattattttgaggtatgttcctacaatacctagtttgttgagagtttttaacatgaagcagtgttgaattttttttttttttaagtctttttctttttttttttctttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtatctgttcatgtccttcgcccactttttgatggggttgtttgtttttttcttgtaaatttgtttgagttcattgtagattctggatattagccctttgtcagatgagtaggttgcaaaaattttctcccattttataggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccaagagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggaggttttgggctgagacgatggggttttctagataaacaatcatgtcgtctgcaaacagggacaatttgacttcctcttttcctaattgaataccctttatttccttctcctgcctgactgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttatttatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtaggattcagctgtgaatccatctggtcctggactctttttggttggtaaactattgattattgccacaatttcagagcttgttattggtctattcagagattcaacttcttcctggtttagtcttgggagagtgtatgtgtcgaggaatgtatccatttcttctagattttctagtttatttgcgtagaggtgtttgtagtattctctcatggtagtttgtatttctgtgggatcggtggtgatatcccctttatcattttttattgtgtctatttgattcttctctctttttttctttattagtcttgctagcggtctatcaattttgttgatactttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcgtttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgttgggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgacctgcttcggctcgcgcacggtgcgcgcacacactggcctgcgcccactgtctggcactccctagtgagaagaacccggtacctcagatggaaatgcagaaatcacccgtcttctgcgtcgctcacgctgggagctgtagaccggagctgttcctattcggccatcttggctcctcccccaagtgttgaattttatcagaagccttttctgcacctattgagatgatcatgtggtttttgtctttagttctgtttatgtgatgaatcacatttattgatttgcatatgttgaaccaaccttgcatcccgtataagtgtacttgatcatggtggattaacttttaatgtgttgctggattcagtttgcaagtattttgttgaggatttttgcatcaatgttcatcaaagatattgacctgaagttttctttttttattgtgtctctgtcatgttttagtatcaaggtgatgctggcctcatagaatgagttaagaggagtccctcctcctcaatttttttggagtagtttctgtaggaatagtacctgctcgtctttgtacatttccactgatcattttactgtctccatagttttgtcttttccaaaatgtcatatagttgcaatcctatagtatgtagccttttcagactgccttatttcgtttagaaatatgcaattaagtttcttctatgtctttttgtggcttaatagctcctttctttgtagcactgaatagtattccattgtatggatgtaccacagtttgtttatccattcacctgttgaaagatctcttggttgcttccaagtctttgcaattacaaataaagctgctctaagcattcgtgtgcaggtttttttgttttgttttgttttgttttgttttgagacagagtcttactctgtcacctaggctggagtgcaatggtgtgatctcggctcactgtagcctccatctcccaggttctagcaattctcatgcctcagcctccccagtagctgggattacaggcacccaccactacgcctggctaattttttctatttttagtagagatggggttttaccatgttggccaggctggtcttgtactcctgacctcaggtgatccatccgcctcgacctcccaaagtgctgggcatgagccacgatgcccagcccctgtgtaggtttttatgtagacataatttgcagcttatttgagtaaataccatggagcacagttcctacactgtatggtaagaatgtatttagttttatgagaaattgccaaactaccttccaaaatggctgtaacattttatattccagagagcagtaaattagagtttctgttgtcttacatcctcaccagcatttggtggtgtcagtgttttagattttcaccattctaattggcatgtagtggtatctcgttgttttagtttgcagttccctaatatgatattgagcatcttttcatatgcatatttgccatctgtttattttctttggtaaagtatctgtttagctcaactctcttttgccttttttttttttaaatactgggtcttgctatgttgccccgactggatttaaattcctgggctcaagtgatcccagtgcctcagcatactgagtagctgggactgcaggcacataccaccatttgttaattgttttctcattgttgacttttaagcattctttttagattttatatttctggggttttgttttgtttttttgagacagagtctcacttccgtcacccaggctggagtgcagtggtataatctcggctcactgcaacctctacctcctgggttcaagcaattctagtgcctcagcctcctgcatagctggaattacaggcgcacgccaccacacccagctaatttttgtatttttagtagatagggtttcgccatgttggccaggctggtcgcaaactcctgacctcaagtgatctgcccgcctcagcctcccaaagtgctgagattacaggcatgagctaccatgcccagccaatttctgttctttatatgtgttttgcaaagatttttttttccccattttgtggcttgctgttttattctcttaacagtgtctttcaaagagcagaagtgtttaaatgttcttaaatatattgggtcaatcttttgtttgtttgttttaagaaatcagtgtattaaatttatatacaaaattgattcttagctatgttttaattttgttagcatcagtcactaataacaaaactgagattgttctacttggtagaatttagagggattttgccctccctctaaatcctatctaaaaacttttataactttcctcttctgttcattatgagatagacctgtgatgactgcctgtgtacttcaaagtcctttctctgagttttcttagttggtcactaaaacaggcaacattctacttggcagagacaaaatgttgatcatttctataatattttgtttggaggttataaatcattgcagcttctcattgacatggcttatttcaggttaggaaccagaacctagggctctcctcccatgaaattctactaaagccagggtgtatcagtaaaaatgtaatcctaccccagtacacatgtaaagtagagaattgcatgcaaagtgccggttttcatatatggaaatacactcttttgcaggtgcacctttgcttctcacttaggaaataagccgaaaaattgacaactgagcttctcttttgagaagatcaagatatttagcaactggagaacagtgtagtgtaatggtaaaagaccaagctcttgggttagaaagacttggattcaagtctcagtgtaaggcacactacgtaacctctataagcctccatgttcacatctgtaaaatggagttaatgcctattatacagggtcatattgatagaattaaatgctctgtataaattaggtgcagaccaaaacagactcttttgatagattaaatgtttatcccctttgtccattcccttatctggaccaatgaaatgagtttgctttccactaaggacatggaaacataccttgaatttcttcatcttgcatgagaattattttcagaatctttctctagccttcactcacaggggaactggccccaggtgcacgttttgagtgctttcccacagtttacctcagctgtactctcctactaataatgccttcctgaaactaggcacttagaatggtcccaggccacagccagacatggcctcccatgtggcttcaggtcagccagagccagtcaatccgatatcctactactcgtaccctcttcttctgtttatgacattatggatccaaatacagataggtgtgcagctacttaaataagtctaactccagtaataccaaaataaccctaaatctgcaacagatgcaaggatgccccctgggggcaattgttaagtgtgatgacagctgggcatcaattaatacatttgtcacctgctcatgagataggatcatgggaggtttggcaaagggacagtctgttgaacactgcacaaaacttagtagcaagaaaaattatttgtgcaggtattcatttttattttactttaatgttctgccttatctagttgcctgttttgagtcacaactttctctgtgcatttagatgaggttaataagatggctggtgagagcagtgcccccttcagccaagattaccaaaaaaaaccttgttcaaatgcccctcagaatttttcctgggaaatatgggccttctcattatgggcttaatgttcataatttattaggtaataactatttaaaataaaactaagtaaagcagaaaatatatacttttctaacatttggagacttgtttgctaaattaaaagacgaagtgccaagactataaattactttcgtatgttgagggtgaatgtttaaattgtacttttttatttttaacagaatgtttactcatgagcttagcatttaaatggttaaaacaaggctttgaagttaacactccattaagatgaatgggggtaattcacacctctgcttgtgctatattatttcagtctggttgcagagaaaacaagacagcagtaggttgatttactgtgtgaaggccctttaaacacccaaggtctggaaatctttggggtgtgtgtgtgtgtgtgtatgcttttccatctagaagcaggatctgaaattcaatacaatctaggtatagaatcgaggtcttgaaaatactaaagattctctgctatccagcaattccatatctggcatttgacgggtagcacgttactggatcaacccaacctctctggctttgtttgctactgtactgtagtgtttcttcctaccacagcattttttaaacttcagcttagtatactggtaaatccatcagtggaaaagcagaaacgaattatccattttccggtgaactttgtatgtgccttcagatgggttatgagctaagcattggtcttcatgtgctcctttttaaaacattttcatctttgcaaaatctcctgttctatatttacctacatataaagcatctacctttaagaactttacaattttttctcatatccctggggtagtgaagtaagcagagatcagttgaaaaagagacatttctttctcaatgtgtcctttaaaccagttctatattgtatttgaaatgtgtattccacccattggtggaagtgctacagccatttgaccctgaaatgattcattttagggcctgggaataaggttatcttaacacaaatgaaatggcaaacactgtataagatgttaatgagtttggaagatctatctttaaggtaaacagatttttctcttctctcttctctgtcctgcatgtttgcaggctcaggttactgggtaatctgtgggtagctaggtgtggagagtacttccactctggctggctgtagtgctgacactgccaatacagtatatacagagagaaaatagatgctagaaacagagggactcaaactgaattaattttaacctgtttttctttttggcatgttaacagctctctgtggctgtgttagaattagccctatgttaaacatactttacttcctgcaaatttttctgcctagattttaggtgtcataatttttgaccttagaacatttcagaatctttttattgtactgagaaatttgttttttaaaaaactcaaatacacaatttattcttctgataatcttcctgtattttttccataaggaggtaggaaaagtaggaaacaaaattttgatggaggatgaataaagatattgtggacatggtttctttattgcaatcagaatcctttctgtttgtcacccttcctaaacaatctgataaatgtgtttattatcacagtaatctgttgtcctgctttgccaagctgtcagtcaggacaagcaattataaggaacaggaagactcatcttggctgatggccaggtgggcaggtgggaataagaggtttattcacctgtggtacaaagtaaatgggtagaaaggaaaattgagttgccagggagaaaaaaaaaacacaaaaacagatggatgaaaagacattgtaatatgggatgctataaagaaaaagacttgcagagaaatgtttctcacttgtttgagtgtacagtcatcccttgggggattggttccaggatctccctcatatatcaaaatccatgcacattcaagtcctgctgcagaaccacatatacaaaatatcaaccctgtgtaaacatgcgcagattttgcatcctgaaaatactatattttttatccgtatttgattgaaaaaagtcaactgttagtgaacccgtgcagttgaaacccatgttgttcaagagtcaactgtgtatatattttatctagtgttcatcagtggacagatacacaacacaagcaaaagggctggctaattcattcagcaaattcttagcacatattatgtcctagaagttgagctagtcccaaggtcatgaaactatgtaagacatacatacatcttgcttgaaaaaagttcagatacaacttttatttttctgactgaacattttcagaccaacttgataagtgaaattgcttaaatgaaaaattatacatgtatttttaatatatacatatgtttttaaaaaaagattttggagtcaaaattacctgtgttcgaatcccagcttctgtctctttctatatctttctaattttggacaagttactattctctgaacttgctgaagactcaatatttgactgggttttctctcaaccagaggaaactctccttcaagtgagattacatatttgggaaaaactcgagtaagccgttaagcattgaatatacgtacacttttattactttactgtccctcaaatcacataacttccaaccatgttgtctcttctgccgtctctgcttcagacatttagtcagcagcctgactagaaaacggtattctagaaatatcctgaccaatgcatttattttcactactgatgtatttttccccggaaaaagtaattcttgtagtttcatagtaaatattatccacatattttgactttacatcagcatttttagcaatgacattacacttttggcttataaagtatgtggtcagaaaagctgcaggccttttttaggtaaattaccctggtttctagaaccctgtacttgtgctgttgatttacattttttaaatatgagggaatatacatgcacacacacacacatatatatatatacacatatgtataggtacacatatacatacatacatatgtatctgttatctatgtgttaaatttcatcctgttagcttcagtgcaccacttaagcagttgagatcttttttttgaatcttgattctagtgcatcagtcaccattcccgcttttgtgacattcttcatcatacttacattttttcatcccattcacagataaaaatgttaaatgagacaagactaaccagagggccctgcagcccaccgctatcagtatttctcttgagttgttattaatctatactttggatgaagttgttaatattcctgtagtgtcatctaacctgcatttcctcacttcccttggaagtgacccccaaatcagtgggtacagcctaaactcctatctgttttctgtatttctagttgcttcagaacatttctgcttgggggctccacaatcacttcaaacttaacatgtccaaatccattcctcactacagttttctcatatctgtcagcagcccctgttttcatccaacatcccaactggctttcttgcttccattcctgctacctacagtccactttcatactgcaaagtagttgtttaaaaattcaaatcagattatattgctaccctgattaatttcctccaagggctttccatctcacttagaatgaaatccatgccatggcctacaaggctcaattttgtctgtacctacttatttctctgatgtcaatgtatctttcattctccagccacactggcctttctgcccctggaacacaccaagcttgttccctcacacttactgttttccctacttagagcataattttcaaagacctttgcaagccgggcttcttatttaagcctcgggtcaactgtcaccccctcagagaggtctgccctgcctgtcttatggtcatgaccgtcttatggcccccaacacatggtagtgcttttaactttaccctgttatacaggtcactgctggaaatcttgtttatgtgttgtctgtgtccactagactgaaagtttcataagaactgggacataactgtcttatttataaccaaatcctcagagcttaggacagtgcctggtactttggagtggcttaatatttgttgaatgaatgcataaaggaatctaacagactgtgtccttctactctttacctctaatctgtcacaatgtcagttcttctttgaaatgcctcctagatttgcttttatgctgacccagcctcctgccagactcctatctaaatctcagccttcatctctttgtgcctgaagtattgcagtgattatcacttcaggctgttctttggcatcacttgggcaactttgcaaaaattaccacatgcaggttccaccccaaccagttaaatccaaatctctgagggttacgacccaggcatcgataaacttcttagagcttcccagatgactccaatgcacaactactggattgccatatctacctgctagcagatgtatgtcttccagcccattttgcctgttactgttctctggtctccttggaatcctgctttcatagtattactctcttgctcaagaacctataatggctcactactacccccattaatcccagataatggctcactgctacccccattaatcccagataatggctcgctactacccccattaatcccagattcccttgcctcatccactaagctatatttgagccctttcttacgtatgttctacaatacccttaaactgttttttctgtctagcacttgatttgccttttattaccctcttctatattgttactcctctccctactcccacttccaggtacatacccagaatgtgacttattttccacctatccaaatgcttctcattcttcaacacccagctcaaatcccacttctgtaaacactttattctccactctagtctaccccttattatctgtatgattattttggtataccattagtaccttgtaagatttttcgtatttttttcataaactacttttgtaattttgtattcagtttttgagtgggtaatgtgcacatggtacagattttaaatttacaaaaataccctcccatccaattctatccccagcatccagttttcctccttggaagcaaccacttttacaactttctgtgttcttcccagtatattctatgcctctcttagagagagagagagagaatacacaaacacaaggagaatacacggatatacacccgcaaatgttggcatacaacatgaaatcctttgcccctttgacttctctttacttaacattatgactttttttagttgtgctaaaacaaaaaataaacaacacctaacatgaaatctgccctcttaacaaacttgtaagtgtacgatatagtgttgttaattatatgcacattgtatagtagatacctaaaactttttcatccggcatgactaaaactctgtgcctaattgaacagcaactccctatttccctgttcctgcagtccctggcaactgccattttactttttgcttctatgagtttgactgctctcgccatcttgtaccaaggaatcatgtagtattttgtccttttgtgactggcttgtttcacttagcatattgtcctcaagtattatgcatattgcagcacatggaagaattttcttcattctttaaggctgaataatattccattgtatgtgtataccacaatttctttatccatgaatctgccaatagacatttaggttgttttcacctcttggctattgtggataatgcagcaacaaacatgggagtgcaaatatctcttccaagattctgttttcaatcattttgtttaaatatccagaagtgagattgctgtatcatatggtagttctattttaaattttttgaagaatctctatactggtttccttaatggttgcactattttatgtttctatcagcagtgcacgagggttccaatttctccatatccttgccagcatttgttttttgttattttgataatgatcatcctaacaggtgtgaggcaatatctcattgtggttttgttttgcatttccctgataagtagtgatgttgagcatcttcatataatgtctggtcgtttgtatgtctttggggaaatttctttcatgtcctttgcccattttaaaatttaatttttttgttactgagttgttgtagttccttctatattttgtatattaaccccttatcagatatgcggtttgcaaatattttctctctccttaagatttttattctgttgattatttcttttgctgtgcagaatctcttctgttggatgttgtcccacttgtctatttttgatttagcattatgttttggagattattttgtatcagtatacacaaaactccctaaatattttaacagctgcatagtattctgttaatgcatagaccataatttaattagctagtttcctatcaatgcatattgagggattttttattttcaaatgttgcaattttatataatgcttcaaatgttatctttgtatacatatgtcatttagcacatatattaatatatctgtagtatatatttctatccatttaactggaattctgggtcaaagggcatgtgcatttttaattttggtaggtattactacattgaccttcattaaagattttattggctgggcacagtggctcatgcctgtaatcacagtactttgggaggctgaggtgagtggatcactcgagcccagaaattcaagaccagcctgggcaacatggcaaatccctctctctacaaaaaatacaaaaattagccaggtgtggtggcgtgtggccatagtccgagctacttgcgaggctgaggtgggaggattacatgatcccagggaggttgaggctgcagtgagttgtgattgctctactgcactgtagcctgggtgacagagtaaaatcctgtctcaaaaaaaaaaaaaggaaaaaagaagatatactgatttatattcacaacaactatgtaggaattaccctttcaattttgtgttgttatttagcttttcacatttaaatactttacctctctgactccgttgtaattaacccaaagacaggaactatgacattacatattagcatctctcacagtagttggtgctcagtaaatatttgttaaatcttgtgtatttagggagttttcccatgagtggcgtttctgatgagtcccatgtgagaattgtcccctttgcatgtttgctgtttccaggaaagggtgtgattgtgtgtgatattcttaggcgagatgcttagtctattttgtgttgctggagcctgggaaatccaatatcaaggtaccaacacgtttggtgtctggtgagggccttgtctccactcccaagatggcctttgaatgttccaccctctggaggggaggaatactgttcctcaaatgacacataagtgaaaagagaaagcccgcttccaaaggcacttttattttattttatttttattatttttatttttaatctttgtgagtacatagtaggtgtatatatttatggagtacatgacatgtttcgatacagacatgcaatgtgaaacagtcacaccatggagaatggggtatccatcccctcaagcatttatcctttgtgttacaaacaatccaattatacttagttatttttaaatgtgcgattaagtaattattgactatagtcatcctgttatgctatcaaatagtaggtcttactcatattttctatttttttgtgctcatttaccattttcaccctgcccctactaccccacaacccttgtcagcctctggtaaccatccttctgctctgtatgtccatgaattcaactgttttgatttttagatcccacagataagtgagaacatttgatgtttgtctttctgtgtctggtttatttcacttaacataatggtctccagttccatccatgttgttgcaaatgaaaagatctcattgtttttatggctgaatagcactccattgtgtatatgttccacattttctttattcattcatctgttgatggacacttaggttacttccaaatcttggctattatgaacagtactgcaacaaacatgggagtgcagatagctcttcagtatacctattttctttcttttgggtatacactcagcagtgggattgctggaccatatggtagctctatttttagttttttgaggaacctccaaactgttctctacagtggttgtactaatttacatcccccccaacagtgcataaaggtcccctttccccttttctccacatcctctccggcatttattattatctgtattttttataaaagccatttttattggggtgagatgatatggcaattttgatttgcatttctctgatgatcagtgatgttgagcaccttttcatatgtctgttagccatttgtttgtcctcttttgagaaatgtctattcaaatattttgcccattttttgattggattattatattttttccaatggagttgtttgagttcctcatatattctgattcttaatcccacttcagatgggtagtttgcagatattttcttctgaaagcacttttattatgatattaaacctactgaggaaggtggagccctcatggcctaatcacctcttaaaggctccatctcccaataccattacattggcaattaaatttcaacgtgagttttggggggaacaaacatttaacccatagcagacaccattcatttatatttttcttccaggatcctgtattatcattaactcagaaaggccaactaatccttggatctattatcaaatttggtttgtttgaataattaagtataaattagctaaatggaaaggctctcctctgtaagttctttaccatctttttatgatgaaaaattttaaacatgaatgcaagttgaaataatatgcccatatacctaccactgaaacttagcatttggtcgtatttattttgtgactcacatataaattatatttatatgtaaatatacagttaactttagaacaacatgggttttctaactgtgtgggtccacttatatggggatttttttctgcctctgccaccccgagaaggcaagaccaacccctcccctgccttcttctcagcctcctcaacatgaagacaatgagaatgaagacctttatgatgatccagtttcacttaatagtaaatatgttttctctttcttatgattttcttaatgacatttttgtttctctagcttactttattgtaagaaaatagtatataatacaaataacatacaaaatgtgtgttaatcaactgttattggtagggcttacagtcaacagtaggctattagcagttaagttttggtgggagagtcaaaaattgtacacagattttcaactgtgtggtgggtgggcacctctgacccccacattgttcaaaggtcaactgtaaatacatttatatttgctgaataatttgcaaagtaagttactgacattccatgaagcagtaagtaaagttgaaaattattttttgtaaaagtcaccatctaccttagctcaggctactataacaaaataccatagattggatggcttaacagaaatttatttctcatagctctggaagctgggaagtccaagaacatggtgctggctagaattattttggtcctggtgagggcctcttcctggcttgcaaatggctgccttcttgtgtcctcacatggtggagaaagagtgatctctgttcctcttcctataaagccactaatcccattatgagggtctcaccctcatcacttaatctaaccctgattatctcccaaagaccccatcttgaaatacttgtgggttagggcctcaatatgaattgaggggttggaggagacacaattctgtccacagaactttctgtgaacaagcctattattccctccctccctccctccctccctccctcccttccttccttccttctctttcttttctttctttcttctttcacaaatgttgtccctttctccaaaaggataagaagctgcttgatgcagctgtcaccagaacttctcttagtaagggaaatatccttaatgtctttttttttttggtggtggtggggaatatcttgataagtcatttaggtatgaacggtgaattcttatacagtggcacagcaatgtgagtttactaaatgcctgtgaattgtatactttaaagagggtcattttatgttatgtgaatttcacctcaatcaaaaaaaatgtgaccctatgaaaatggttggcaagaggagaggaagtgagagagatagctaaaccactctgcataaaagagaaaatgtgaatttgggaactggagaaaagcaaagggaaagaggcagagagtgctaacccagtggtgggagtctagaggaaaagtggctgacgggcattttaagaacagaagcgtttaatattcagttttaatttgcctgtctctgtctcctgaaactaataaagtcagtagacacaaaaataccttgtgtgaacagaattgtgcatgtaaacccttctttagactcacatgggacagaacacatacagccttatgctatccaggtgatccagaaacctcaaaaagtgaaattcaaaggcagagatggccaagaaaaaatgtaagccacttgcttcctcccagagtccgtgggcacatcaggagggttgtgggacgatcctcatatgagggatgtgattgaaccaacttttcctaattctcaaagtgtattgaactttccttgacatctcattggcaatatattgtcatttcattgctttaagggctcattatttactagtcatcaattgtacctgtaggggaatgcctctttttagagacaagagaccagacctccacagaggtagatcttggagattggagcagttctagaatttctaacatttccccttacggtcatcttgctaggttctctgtaacaaagcctggtagttcagaaatcaggctccaagaacgtgccatagatcaacctgtttgtgtgtgtgtgtgtgtgtgtgtgtgtgtgtgtgtgtgtgtgtgtgtgtgtgtgtatgtatttgggatcagagccactcaacttcctttttttttgaaacggagtttcactttttttgcccagactggagtgcaatgctgtgatctcggctcactgtaacctccacctcccaggttcaagcaattctcctgcctcagcctcccaagtagctgggattacaggcatgagccaccacacccagctaattttgtatttttagtagagacgaggtttctccatgttcatcaggctggtcttgaactcccgacctcaggtgatctgcccgtcttggcctcccaaagtgctgggattgcaggcatgagccaccacacccggccttcaactcaacttctacttagatggtggcagtaggaatcagagggagtggggcccctagggaagagcactcccatggaaaaagagtagaaacaaattttataattccctggttttcttacccagttctccaacctgctaaaatctgaaaaagtttcatactttaaatgaatggaagatcattagtctcataaaataatatgacactactgagctggcacttcggtgtatagaccaggttctatgccaagcacattctcatgtaatctgaggtaagcacagttatattccccatttaatagattagaaattaaagtttagagagactgtaaggttaaatgacttgttcaaggttatacatccttaagatgccatcctaagaatagaaactgaagtttgactataaaggctgtgtgcttaattaccatgtaaataaagtgtatccaactgttggagtttttttctacaaaaaggttctgctcatagcagatacatagtcaatattgactgtgttgaaggctgctttattcatttaaaatgtggcacctaaatctgttctgttacatcagccagacagtattttggccggccttgtgtcctcttgagtcatggttcattgccacagcactgttgtttctcctttgttaagtatttcagaggaaattctggacaaaggaaaggtatatgggtcttcaagtagagcagggatgtgttccagtagttgtcaactagactgagaaaacttggatgtcttacgaaacaatgtcagaaatccatttctgtgttctgtgactttctacaaacacaatttttaaaaatccaaatatagcttagaccatcagtagtctaattcagtgtttcccagatttgagatttcttttggaactttagaacgtcaaaatgaatcttgggacattgataagattgcagactttttattttataaattgattaaggatattaaacttgccactttcaatataaaaaattaaggaaggttataacctttgtgaaaaacttgctacatagttatttatctcatcaaagaccagtgaaaactttctcatagaccaacacttggaaactatcagtctaaataaccagtctatattcaaaaattcagtaaagatttcttcacttctaatgctcattgacttcagttatcttataggtggaaagaagtagatacaaaaacagatcttgattacaaaattcgttgatgacctagttgactctttccccagtcattactaatcctaacctttgggagcgaaaaatatctaaataagttctggtttacaaatttgcaaaatttttgtcaacacttcagaattcagaaaaaaacacaggacatttttactatataacttcctaagtttatatgatatatcaaaagtcagtaaggattataccataataatatttacatttcacagggaagcaaaatacttggagcctctccttgtctttgtctaaagatttgtcattcatttgcattcaaataaattctttgctttcattcatccagaatggttctcaatttattagctcatgagactacataaatagacttgtattcatacattttaatttcagtgtaaaatggctttcctcaatttttttttctactcaactctcccaaaagatgtctaatcactcccacactcagttacttaaacatttcataatgttgttacttctatagtaaaacaaaaagtaatttgcttttaataaatcagagagccctactgtagcaatctagaactttattctggcgagagcaaattctcaaattatatttccagcctcatttgtgaatagctgattttccctgtcacaaagcattgttaggtaggtacagtatttttctttagttggtaaactactggaacttacaatccaatggaggtgacctctatacaatacctgggacggtaataccctgaagcgcagggtgtggctattgcatgtgccacatgcacatgaggccatctgtgcgtgcttgttgaaagaatgacatatcttggtgagtaatatgaacattaaaagctctgctggataagctcatagaggtggggttcactgccttctgggtgagtggggaagactttgtgaagaaagcaacaactgaagtaaaattgaaggataaccaaagtagaaatgagaatgaaaggaagatactcctgtttggaaagaaaatactaacaatatgtacaggaaaatacaaggtatactttggagatgacaagtaaaaattttgccaggagcacagatgtaatagcaatttgagaagtaaagctgaagggtaggatcctgatgtagagaatgctggacccaggctgagcttggactttacatcaagtagaagtggtagagaaagattaattgcctctctgcattggactagtgccatcgtcttccaaaagctaaaaagaagcactttaggccttcaagggctagttatctaaaaaccacacttgatttgttcttaagtctcagctcctgggcatatgaggaactttttctggagttttggaaaattcctcatgccctcagatcctattaagacctctggcatctttttttttttaattatttaatttatttatttttattttttattttatttatttatttatttatttattttgagacagggtctcattctgtcgcacaggttggcgtgcagtggtgtgatctcagctcattgcaacctctgcctcccggactcaagcaatcctcccacctcagcctccagagtagctgagactacaggtatgcgccaccatgcccagctaatttttgtactttttgtagagacagggtttcaccatgttgcccaggctagtctcgaactcctgagctcaagcaatccgcccactttggcctcccaaaattctgggattacaggcgtgagccaccgagccaggtcaagacctctggcatcttaagagacttcctatgagttcctgcctccaaacttttttttttttttttttttttgagacagagtctcgctctgtcgcccaggctggagtgcagtggcgggtattggcttactgcaacctctgcctcccgggttcaagcgattctcctgcctccacctcctgagtagctgggattacaggcacacactactacacctagctaatttttctatttttattagaggcggggtttcaccatgttggtcaggctggtctcgaacttctgacctctggtgatctacccacctcagcctcccagagtgctgggattacaggtgtgagccactgtgcccggcctcctgcctccaaacttttgcacaaaccattcatgttgtttttctctttcccctccaaagcgtttcttctccctcaaaacctgtttccacactcaacctcctctagaaggacttacctgactatgacttaatgtaactgctccattactcaggaaacctatgctcaacatcttgatgctacatttaatttctctaaatgataaaatatacaaattcttgtatatttgtatgtctaaccaccctgcgacagcctttaggaaaggttccacatctgccaactcctttgtatcctccatccagaacctgcctcccatccctactttacccatccacctcagagacttcatggtacagtgcagtatacttggtgagtgttgatggtttaagagtgtgccctgaacaacgaaggatttctttgaggctgaaatcctgtgggatccatggaatgggagtttcacctgtctttggcttctgctcctttccccagcatgtgtagagcttctagaacagtccccagcaagagaggatcacttggtacacctctttcttatcctcactgtctccagtctctgctgtaggcctgctagtgatgatcaggatacaggttttaacatggccaagctgttaataacctgagattgggcaccatgaacaataagcattaaaaggcaataacaacaacaacaacataacctgttaattttatgcaggcttaattttttaaagaactatttcttcctaacttgcttttactcttcttcatctactttctcatacctatgactgacaatgataaggacacccacccactatacacacctaattccatccctccaaatttgatttcgtgttctctagagctggcgtgttatgtgacctattgtggggagaggctcagctgagggactctgtgatgccaaatggacaaaggcacacttttttctccaggtcccagcctggtgaaagtcatagcacctgagaatttggagctgactctctcctttggaaattgtgccttccaaaaatatatcttacactgcctgtacctgcatgcaataggttttggttcttaccaactgcagcttcagtctgaacttgagttctaccctcatggatgcaaatcaaaacagctcagaatcaagtctgggaagcaagtcgaagtggtttgatttgcatggggagcttttgtctctgcatgaaggcagccaaattccctaggctccccagccctccggaaatatgctttacaggacccgggggcccaggcccagtcgggtgggtgtgatttgaatgttctctgctacagctgctgcaccgggccctggtcactgctgttggtttcgctccattttactgcctcagaatccccctgtgcatgttagtggttaatacagcagccaggagacgccagacagctctcggcacctggttcaaatttaaggctcatttacacatgatgtcacacacgcattgtcagcgcgagggaggtcaggatggttcattttgggaaggttcacattgttgagtctttacaacactcactgctattaatgctttaaccatctgacttggatttcggttttctggcatgaggtaatcccaggcactagatttatatgctgaatgggaagccagcaatggtggctaatcatgctggtttgcagatctgcacctctggagccttgggatggaattagagggccacatggcaagtagcaaatcataggcgttttgagcaggagaggaattagccagacctggaagcaggggccatagatggggtgttgtctgagccaggaagtttgattgaagaatggaaaccaaggtaaattggacaaggatctgggcccagagaccacaggaattattctactttgaccagtgctttgggtcattgcttgaactgtccttttgctcatcactcatagaaatcccagacccatcttcccaggtccagcgtaagtctttcatgttccatgaagcctttcctgaccacccatcccacagcaggggctgaggtggttagatcaccagaggtcagaagttcgagaccagcctgaccaacatggtgaaaccccatctctaataaaaatacaaaaattagctaggcgtagtagtgtgtgcctgtaatcccagctactcaggaggtggaggcaggagaatcgcttgaacccgggaggcagaggttgcagtaagccaatacccgccactgcactccagcctgggcgacagagcgagactctgtctcaaaaaaaaatttctctcctgaatccctaagtacttttgttactgagtacttaatttgtgcgactagctcattttaccctcacaattccaaagggaaggctttattatttctcttttacagatgacaagacaggttcagagaggttaaataatgtatccagtgtcaaacttttaaaagtcaggatggaatcctgattccaagcttaggttctgaaccactggggtaggctgtgtagtactacattttctgtggaacgtggtatcggtaacatgggagagacaggctgtgcctcaggaagatgccacatgggagtgcacagcagtgctgtagtgcctcgtgtttatgtgtagtcccaggtgcctggctgtaaacaactgcagggcagtgaccatcacctctgcttttctgcatccccacacttcctaacacagtgtcccccaaagtgtgcatcaatggatggatgaatattagcacccccgcaccaccctcacctaaaacatactgaaaagtttgagatctttggataaccaccccatcccctgctgttgtcttctgtcatacggctgaaatcgtaaaactggtctgcctgtcacagctccagtgagcctacttactcactggaaattcagagaatgtctttagtcctgttgactgctttgattttgttttttaacttgtaccaagacctgttgccatgatgggtctctgcaaatgggctttcttgttccatgagtctctgttttagtcaagtgaagggcacactccttttcattggccacctcttacttttcctccaagaggagtactcactcccagaaccctttgctgggctctcatgccgagcttaggtgccccttcagtgtgcttctgcagcactcattaccccgtagtagcattgtagtttaattcctgtttgcttgactgaagcagagactcacctgcagacgcctgtaggtgccttccacgttgctcagatgaacagtagagaagggtcaggcctgccctaggtttctacccctctcctcaaggccctttctagtcaccacgccacatcctgctcatgactgcagggatcatgcctctgggcctctgtccatgcagctgcctctgcctgcactccaggacaggggccttctctgctgtccactggagccctgtggaagggactcctgaccctagccttagggaagtcatctctaaaggctgttttattacagtgtttcctcagaatgaccctatagacacagtgttttctcagtgtcctctcacctttgaacatatccgggaataattgaaaaaaccaggcaatcaaatgtgcctctcataaatcaccatcacttcagagcagaacttaagagtttggtttgcaagccacaccaaatagtttgagcttggccctctaccatttcctcctgctctgagcccagaggttcacctagtggactgtagcaatggattcccttgcccctggcttcctgttgggttcagccagagagcagcaccagtgggagcctacagagggaggaaagtgaggtcaaggtgtctgctgcctcctccctgcctgccaggccactgtgggtagactacacctcaggtggccctccccatgtgtagccatgcttgccaggttctgggttctggaaacctccacctcctcttgccccttcagtcatagggtggtagcccccttcattgctattagctgttatgcactcaattgtgttccaaccccaaattcgtaggttgaggccccaatccccaggacctcagaatgcaactgtatttggagatagggtctttaaagaagtaattaaattaaaatgaggccattaagccctaattcaatgtgactggtgttcttgtaagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 2148 - DNA, 244043 bp, Homo sapiens
attagaccattaccattttatttgtattaagaattatttaaaataagtataatatatatatttcactgagcctaagttgagcaggctaaaagttgatacattgagtatgtagctacaactgtaacaaaactgacatatgttcttgaactttcatacaatcgtgaccacaattcagttgctggatttcacactctccttaggtttatacaaactgaaggacaggagatgaatagtatagaaattgctacaactttttgaatttcaactatgtttacacacagaaaagatacaaaaatacatgtataaaattgcaggtagtatctatttggaatgctgaggcagtccaggttgctggtggaggttagtagggaatcctagttgtttaaaaggcaaaatggatgcctgactaattaaattaagtatatatgaagatttgtgttttaaagttttttagtggggaaaaatactttttaccactaattgcttcagaaattgagttgcgtaaagtggcctagagctaaaaatcatttctaaaattttaattaccaatgagaagaaaccagatattaaacatcttttgaggaaaattacaaaatgttttactccatgcaaagtcttactgtgctctaaaatatgctctttatgactttgttggtatggatgaacgcaagaaaactgaaaaataaatttaattaaacgagggatgcaaattaattttctttttaaaaaattgcatctctcatctaaattctcttttgcaaagtttaatatccagttctttgccacataagtaaaacaaaatattgcccataaatatagatgtagttgttgcagtctcaatcagccaactcatatatcctgaacaaacccagctatgaggacagttctatagagactcttctataaaattatgatcttgatatacatccagaatggggggtccaataatgtcaagtgttaatattgatatctaaagaactttgcattcaatatgtcttgctacctaaatggatgacactggtcttttattgctgtcttttatcagttctcagaattatgcaaacattagaagggggtaatagtaaatactttaaacatgtaaattatcttggcttttaataaatcaaatgacgagttactgggttcagcacaccaacatggcacatgtatacatatgtaactaacctgcacgttgtgctcgtgtaccctaaaattcgaagtgtaataaaaaagaattgtggggtataaaaaaagaaaaagaaaagcaagtctccaatgttaacactgaaatttaccactatgcactgagcttgagaaacaaaaactggtagagataattaatcagcctaaatatctatgtctttttttgtgataggataaaagagaccattccataacctgttactgtagcacctgattttaaatctcgccagagtcgataattttgtgctgcagtcatggttaggcctggcaaaaggacaaagtctgctttgtttgcttttgtaaagtctttcattgaacttgaaataagagaaaaatgaaggtgaaaaaataaattgaaaaaaattagtccaaaacaaacatgcaaatttgcagtgcacgattgagcatttctgtccatgaaaagtgcttctgtacagctctctgcaggcagctcttcacagtcaagaaggccattttcttttagtgtagctggcaaaagtctctgatcatccttataattagtttaggagaaaggtctggatgtaaatctgtcttttaatccattcgacgaaatatgacacattactataaacgccaggccccaggactttggaaaagcagacggagccccatgaagttaatccaaataatgtccaccgtcctccaggcttctcacaaacaagaggcccaccgctgtcaccctgcaataagtaacgatgggagttaggaactggcatttcagggcagtaatgtgtgtccatgctatcctgaggatactataaagctaaacccagattaaccaacttggaaagtttcaacaaagctttccttgtcagcctgtggaggagttgtgctttccactgtaaaaacagaactttcaaataaacatcttaaactctgatcattaaaagggtggagtggcttgggaagaaattatatttttcccccaggaaattacctttttcaggcattttctgcacttataaaaatatgtcataaagtttttaaaaagtatcagaactaattacctcaaaattgacctcattctaatttaagcttgacttatgactgtggaaagtacccaaaatggaataaagatcccccccacacacagtactgcaaacatattctaaaatatctattttcaagattcttgctttgtgaatgaatacattaagcataacacaatttggggtcccttactacacttcttaatagttcttaggactttttaatttggcatagttgaatacaaaataagaccacttaaaattataatgaatcattaatagcctgtattttatttcatatatatagggattttcattcatgatatttaaggattccagttgaactatattcagtttttcccccaaatatagttaatgataaaatgctatggcattagagatagcaatacttgctacatctgaaaacaaaggtgtattctgcactgcctcaaaaaagaagagctgatatcatggaaaataaaagagtaaatacgtgaattcattgtggaaggttacaaatactccttgacctacaagactttcaaaattagaagcatatctatggtcttcctacttggtattgttgaagaacataggactaatgtttcctgatcctcttctaaacattttccacatattagctcatttaatctttacaaaatacctaagagtttatattatttattatatctgttttggagatgatgaaacagaagcacaggttaaataacttattcattggcagaggctagatttgaatccaggcagtctggtaacaggattccaactctataactactaggctaccctgcttcttaggaatattagggaatattattgctatgaaagagaaattaggcccggcgtgctagctcacacctgtaatcccagcactttgggaggccgaggcaggcagatgacttgaggtcaggagttccagaccaacttgatcaacatggtgaaaccctgtctctactcaaaatacaaaaattagccaggtgtggttgtggaaacctgtaatcccagctacgctggaggctgaggcaggagaatcccttgaacccaggagttggaggttgcagtgagctgagatcacaccactgcactccagcctgggagacagagtgaaactccatctcaaaaaaaaaaaaaaaagaagaagaaagagattaaaattttgattgtgctgtatgcttttgtgtaagtgatgatctttaaatttgtaactttccaataccctaagccaaaatcataagcatagaacttgcaaggagctgaatttttctgcctaagagcctaattgaatttttttaaagcaaaatttctttgttacatgtatataatgcttagacgaaaaagaaaaatttcctggaaacatttcacaaattattttcacaaatttgttttcacacatttcatatgcatagggtatttcattcttgatctctccttatataaaataaataagatgctcagctattgaagtggaactattatgtcagagggtgattaaaatggaatgtgtttagaatgtcagcacattttcacttccagatcagacatttagtaaaataattatttagcatctactctttgcaaagttctgtgctagtgtataaacaaacgaataaggcactgtttttgtcccagaacagccaaaagtcagcttgggtaacaaggataaccacatgaaagcaaaatctaatggctagaaagaggaggtcaaaggaatgagtgatgacttccaggtggagaggaataaaaaatgccttcctgagatgtgggttttgagttaggcttagtgagtcaggtaggcaccccattaagtgcaaaatgaaaggtgaaaagcaagcaattaaaaatgaaagggagactacagctaaaggcacaactgatctggtctgttcttttggtcctctttgtaatattgggcttgaaaccaacatttatatttggcttcagtattcagtattcaggtttatagattgtcacggagtaactcacgcttcattatgtcctgttgatacaattaaggaaaataatatctgtcatataatagaggtctaagtagaaaaatttgctcctgatatagtaaaaagtaggttttgtttggttttctacctgaagttgtgttagagaatatctggtatgcatttagtatacccagtactaaatgaacttccactgaactcagtatacaccactgaactcccactactaaagaagtcggcaagacctggttcctattaggcatcatgataagaacatgcccatgcctgtgtctgtgggccttcagctctctgtcaaggaatcatctcccttcccctcctttagcaactgccaagagatgatcttgaacatgtgccaagaggtgctagtttttggtaaacctccaaatgacattggagagaggaagaaatgtagttatattaatcattgctgccagactgactggtttcatgtcctcagtctaccaccttcatgctggctgatttggggcaaattacttaacctcctgtattcttgatctgtttagggaaaataaagacactgccatatgggttgattgtgataattaaatgagttattagaaagcgttttgcagagagcccgaaacataataagcactaaattgatagctgttaatattggtgtaattactattcattgaatgtctaagtatgtgccagatatcatatacagatatgtgaaagatatgggcttccaaatacattcacttagttaatcctcatggacagaattagtcccattttactcatgagaaagctatctagagaggttagataacttccccgggttatactggtctcactggcagagatgaattccaacccagatatttcaggcttcaaatcctgtgccccacacccacatcatgctgcctcctacaacactttattttgggcctgggaaatcaaacccagtcctcctgtagagaagggagggattcctttaccaccatccacgtcagcaggatgacttgtggccatgaagcagaaaggagggtggtctcagcgaaatgccaagggagctgtctgcctccctctttcccatgacaactatctaaggaatcaccacagggccattttcaataccctgatttttccattctaaaatggatcatcaaaaatatagtttatttaaattgagttagtacttaagagcactgttgtatcttttcttcattactaaactgtagggagcaatttactcccaattaaaggtgcttcacagcagcatagtataataactgtcttccccagtttttgttacaagcttatttgagcacttgcacttttccctcctttcctgggagccagtccagtataatgttcgatgtgtgtctattaagtaaaaataaaaaggcacctctacactattatgttaatatgttctgcaaactctcatggccatgaatcctgagtatctaaaggttgagttcagtgacatttgaggacatgctggcaatcaagtgagggcccagacaacaccagtgtgatgacccctgagacagaggtagtcctgtctcacaccctggaagttggggtgttgatgtgtggcttcctgccatcaccctaatggctgacaatgtcctttcatgccttccctgcttccccagggcagccaggtggaagccatggttactactagctcctcttagaacctcatttatcctagccactaaaatggttgaatgagatgaacaggaaaaattgtttttctcctgttgctgaacaagggtgatgttccccatatagtagatgagacagtagaaggcaccctgaataaagaggatgggtgtaattgtggggattgcttgtgtaccagctgcaggaaaatgtgctgttaataattaaacatttggcaacaaatgattttcaaaaaatgtttccaaagggccatacgtaataatgagtttataggaatccactgaagttattgttgaactgaatctccttggtaaccagaaagcaacttaccatgcatgaatcaactgtgccagactcatagccagcacatatcatccgagtggtgatggtcttcatgtcaaagtaggactgacaatgttccagagaaataatgcggacctctccctcttgcagcttaaatggcactgaatttttaaaaaataagaatatatatatgatgataaaatgactcaaaagtgaggctagtgaggctagccaaatatgaaatgcaaatataatataaatatttttataccaagagaggcatattctttacttgaaatgccattttaaagacatggctggtttggaatcagaattttctagttagaagcattcatagcaattatccggtgaaactcctttattttattaatgggtaaaccaaggcctagactggttaagtaagttggttcatccttaccatatgctacaaccaaaacaatagctactacaaagaaaagaaaaaaatcaagccagagctctgctggctgccagataggaggctgccagctcggcgtcaactcagcatgatagtcctgctctgctaaagtagagaaaacctgtttaatctaacagggaagggttgtcctattcttgatgaaaagaatatgcctcaatatgtgccccagcagccattacttgatgtaagaacctctaatcctagaggatatgacagagagatatcgaaaagcacaaagccatcccttggtattgacagagagaatatgtgaattccatcttgcttaaaagttcttgaagaatgacaatggatttcttgaagcaagacagcatgaatctttcactgtttagccattctgcaaaattatacacactgttcttcttttaaacagtgatggtgaagcactactgggtaccttattggaagaaagagccatttttaggaaaatcaatgtgatgcagacagtggatgtttcacaggttgtcaaaagaataagaacaatagctaacatttattgggcactagtgggtctcattgcctttaatctttacaatactcctgtgagttaggtagttgctatttttttccattttatagtaagcttgaaagttatacagtcagatcagtcaggtctttctgactgaattcagcagatcttttttttttttttgagacagggtctcattctgtcacccaggcagtggtcacttgcttactgcagcctccaccttggctcaagaaatccttggctcactgcagcctccaccttcaaggctcaagaaatcctcccacctcagcctcccaagtagctgggactacaggcacacacccccatgccaagctaattttttttttgtagagacagagttccaccatgttgcccaggctggtcttgaactcctgggctcaattcatgctatactacatgtgtggagtgtgcgttatgttgcactattgctctgagttcaatatggatattgtaggaggaatataagcagaaacaatatcaagcatagtctgctcttaaattacagaattaatcatagctttgaaaaaaaacagatgcataggagtggtgacagcatgtctaacattgccttcaaaattgttacatgtgagtttttttgaaaaagtcattgacttctgcctattgaatttcctttctgttctgtaattgatgaaatagaaaagaaactcaatgtaagtcaaaccttatctgactaaattttaagaaaaaattccttcaaatatacaatttctaaggccaataacagaatgccaatatacattattattcttgaaagccatggcattatacttgatatggacagagtaggcagcacttacagttttttttttttaagtttcaggtgggtggatcacctgaggtcaggagtttgaaactagcttggccaacatggtgaaaccccgtctcactaaaaatacaaaaaacaaaattagccaggcgtcatggcacatgtctgtaatcccagctactcgggaggctgaggcaggagaatcacttgaacctgggaggtggaggttgcagtgagccgagattgtgccactgcattccagcctgggtgacagagtgagactccgtctcaaaaacaaacaaataaacaaacaaacaattattatttctaaagtaggtcaaactgaatgagagagtccattataggggtttagagtaaatacagagtacacattttaaatttctatgtgttttatatgttaagtcatctacagagccaaactattttaatcaatttaaatagtcaaatagcaaatcaatatactttcttgaaggatttatagtttgtactacagatgttgataagaccaaatcacaacatagaattggaaatatgaccatgcagcttgactgcagagattcccagtgactgtctctatcattgggctatctgcaggcagatagagagagtccaaagcacagttcagtgacaggtctcctcctgccacaaggaagctccaaaacattaatagtaagctcccagagagagattctgaagtgtggagagggatttttgagattgcatctgagcttggccattttaaatgccatggttcattattaatgtctatgatttgcacagcagatgaagtgtgacacatcgctaagtatttaccatttgtggctatatttttgtaagagaaaatgggaaattacggccaaaagctacctagcttttgggtctgggtactgggtctcattctgttacccaggcagtggtgagatcttggctcactgcagcctccaccttccaggctcaagaaatcctcccacctcagcctcccaactgaggaacacaatgtttctcaggctcctgaagatcctggctgatatggtttggctgtgttcccacccaaatctcatcttgaattgtagttcccataatctccacgtgtaatgggagggatctggtgggaggtaattgaaacatggggggcagttaccctcttgatagtgagttctcacgaggtctgatggttttataaggggcttttcccccttttgctcagtacttctccttgctgctgccatgtgaagaaggacatgtttgcttccccttccgccatgattgtaggtttcctgaggcctccccatccctgcagaactgtgaatcaattaaacttctttcctttataaattacccactctcaggtatgtgcttatagcagcatgagaatggactaatacactggcttacttttattgcccatgtggccccagcctgtgatatagcagtacgtgtcaggctctagccactgctccgggttgggcaagcagacaggccggacgtagccagtctcactgatgtcttcactcagctcaacgatgctgatgtcatagtccaccactgctcgactgtagcggggatgcaggatgatggtcttcacaaagcgtgtctgcatgaacactgatggatggtctagattgttgatgccaagcaccactttccaaactgcagcattctctctcctaaaattataattcaagagctattggcatcttaaactctagtttatcatgtgaaattcacatgtaattttaaaacattttatttatgtaaataatggccattttcatgcccacctctcaatgtattcatataagtggcatttatataatagcctgagtgattagcaagtaagtattattgttgcagaaagcatagctcatgattcctgaatggggctagtctttaacataaaacttcttcagttttaaaggcaggcagagttagttacttgcttcacagaatgagcaagataatgaaaagctatgaagaagagagaggagcaagaggaaaagtgaaaaagaagaggaagccaagactaagagattcctccaagaaagagcaagtgacttgaagaaatgccaggggaacctcctacagatttccagctcagggcttaaaaaggtcacccacgacctccaatggtcattcccatactccactgtttttgaatacttgtcaacaatattttagtcgattcccaccttaaaacactttcttcacttggcttccaggtcttgccatgctccaaaatttcttccaatctcatggacctttccctctcagtcttttcttctgggttctcctctttggctctcagtctccatgttgaaatgctctggaatttcactctcagctgtctattctcactccatactcccttgatttcatctagtccaatggttttaaatcccaccatacgctggtgaccccaaatgtatatctccagctctgtcctttccctgagctgcagacttaatgttcaatggtctatttaacactctcagttggatgtttcagccaacatttattgagggcttaccatgtatgccacagtatttaatcattcaggattcagtttacaggaacttaatactataatcaacccaggtgaatcttctctttttcttacacccaacactgaatgcatcagcaagtctttgccaatcctgctttcaaatatatcccacatcttactgtttctccctcctccatggctataatcctaatctaagctactctcaactacatggaccatgcaatggcctcccaaatcatggtccttcttctaatcttagtccctgtagtccattttccttactatcaggatatatattgactatatcctctatattagtcagagcaatatttaaaaaaaattagatcaatccatcttctgctcactattctccaaaagctttgtatcacacttgagacaaatcctagactcccctggcctctgaggccctacaccatatgttcattctcaacccaaggactttcttgctaattttgaacatgccaagagcatcctcaactcaggagctatttcccctgatgttcccccagctctcacatgggtcctaccattactccttctcttcatccaggtctcaactcaagcatcatctgctcagagctgtttccccagccaacctgtctcacccttactctgcccccttcactctacttgacactgctttacttttcttctcatactatccattgatatcaatgacattgatataaccatttgtctattctctgtcttggcccctagaatatagttatcactgtgaaggcagggatttggctggtctttttcactgctttattcacagggcttggtacctggcctacagtaggtcctcaacaagtacctatttaatgatggctcaatgaatgtttttgactctaaccacaaagtcaaggtctgttcttcatcactccctccatcccttccttcactcccagtctctcctccaccagagtggtcaggataaaaaatgtggacatttattggaccacattgttggggcaagggtagagctttaattgtgggcatttccttatactctggtaatgtgagtcagccacactaccactgttcctgcttgggagcttgtgatcaaatcaactaaagtaggttgatttgaccagctagaccaattgtttttcaacccaggctgaacactgaatcctctgggagcctttaaaatagtgattctctgggcgtcacttctaaacagaagctcatggactggggcctgggagtctgtatttttaagagctctctagggaatcttaggcaaaaccccacccacaacccttcttttcttggcacgcctttctttaccatcagcatgccaaagattcgaaaggctgagatttcaagggagttaggaaggaggagccaaggtaggcactcacttggtttttagtattgttggatacttggggcagactctactaacagaccccctctatatagtcatgcatgttgtcctttttccattaaacaaatagtaatttcagggatatcagaggaacggacatcattcagtgaatagagagatagagatatatagcaattttctctatgccaagcattgtgttagggattacaagaataagcaagaaaagcatgattccctgcctatacaaacattgtaattgagtgaaggtagacaattaaataaacaattagattaaaatgcaggtagtactatcacatgaacattacaagataatgttacagaataatttctttttttttcttttcttgagtcagggtcttgctctgtcacccaggttggagtgcagtggcatgatgatagctcactgcagtctcaatctcccaggctcaagcgatccactggcctcagccccccaccaagtagctgagactacagacacacaccaccatatctgactaaatttttttggaattttagtagagataaggttttgctgtgttgcccaagctggtcttgaactcctgagctcaagcaatcctcccgccttgggcctcctaaagtgctaggactgcaggccaccaagcccagcccagaagaattatttttcattacataaagccgtcactagaagaacatgcttttcttatccttccttccttcctaccttctttccctccttcctttcttccctccttccttccttcctttctttttctttccttttttccttctttcttttacttctttcttcctttccttttttccttcttttccttatttcttccttctcttcctcccttctctcctttcttctttctctcgttccttcctttttcactaaacagtaataagtgcattaccatctgagaagttcaatatgtatttgtgattctattgtttcagacacctgaaatcaagcaataatttatttcaaatttctgactacttaatagcttcttgcccttgaatagcgttactaagttttggctgtgaaaaacattcatccacatgcttaaatcataagcagtattttgaataatcgaacattccaaattatttgtaacaaaattgaataacatcaaaattctggacttaattactgtattgagattaatgtaattctaattataaaaaattagtgtcaataaaactgctgaacattaatttgtacccagtagtctcttgttacataagctactggccttatggtatagacaggcagatcacgaggtcaggagaccgagaccatcctggctaacgcggtgaaaccccgtctctactaaaaatacaaaaaattagcccggcatggtggcgggtgcctgtagtcccagctatttgggaggctgaggcaggagaatggcgtgaacccgggaggcagaacttgcagtgagcccagatcgcgccactgcactccagcctgggcgacagagtgagactccatctcaaaaaaaaaaaattccaccaaaagaaaaaaaatgtacacaggaaattcacataattttttgtattcagtgatgacagtgttcttttcttctttttgttatgagtatattgtgaaaaataatgtctcttttgatgtcttccctcctgtcaacccgggtatggcagaaaccaaaaacagaacaagaaaaaacccaacctgttgtttgaaagagtctcctggggtgaaggacatgtacatacgtggtgattgttacatcaagcaagtgctaaaaagaaggagtcaggagtaatggcaaagacagccctgtgtctgggtagaagcaaaaagaaggaggacaatttcaggctacatgaatgccacatgagtttagtatcagttctaaagtacgaattaaccggatgtggtggcgtgcacctatagtcccagctactcaggaggctgaggcaggagaatcacttaaaccctagaggtggaggttgcagtgagccaagatcatgccactgcactccagcctgggctacagggctagactccatctcaaaaaaaagaaaaaaaaaaaaagtaccattggagaaacacatggaaacagactctgatcatatgactattttagtaaaaaccattaaattatggccaggtgcggtggttcacacctgtaataacagcactttgggaggctgaggcaggcgactcacctgaggtcaggagttcaaggccagcctggccagcatggcaaaaccccatttctacaaaaaatacaaaaattagctaggtgtgatggcaggcacctgtaaccccagctactcaggaggctgaggcataagaatcgcttgaacctgggagctggaggctgcagtgagctgagatcggccattgcactccagcctgggtgacaagagcaaaactccatcgccaaagaaaaaaaaagagctaaattaggctaccaagaaaagaaagccaagtatagcagctgaaaatcttcagtttaaagggaattacttgccatttggctgtcaagcctcaaagcagcagcaaggagagctggcacatctgaagtgcaaagaacttcagactgtgagaggaaggaagcaggccaaggtgaagccaggtgagaatccaccaatcccagggaaaacaactgaggaagatgttaaaacaccttattcttctttgtcctcactgtggttagtattttattccttgaaatcacatttagagtctaatttgcttcacgtttacactattgttttaataataaatgtacttcatagacaatattgagcttgtatgatttcaacttacaattcttcaattattaactctagagaaaaacaaaaactcagccacttacatatgtcagacacactatagcatccagaggaatttatacagaattgcaggcacaatgtctctggaggcaaaaatcagtctctttggtttgcaatttgccacactcagctctagtttagacatgaaatttttcactcaattcagctagtcaaatttaaagatttctatctttatcttttcttaggagtgaaaaatttcccttctctcaccctctctgactttgcttagaatatcttatatttaatatttttcctgtttaataaagttaatattataattaacaactatgatagaaatttatctattttacaagacttactccagaaatagcatagctaagtggtgatttggagatcatctgaaggttaccaaatctgcactaaataaagatataccacactatggcatcattgctgttctacaaatcttaggaatctcttacttttaatattgtgctctgtccttggcatttcatttttattatttatttattttttttgagatggagtttcactcttgtcaccccggctgaagtgcaatggcgcaatctcagctcactgcaacctttgcctcagaggttcaagcgattctcctgcctcagcctcctaagtagttgggattacaggcacccgccaccatgcctggctaatttttgtatttttagtagagacagggtttcaccatgttggcctatctggtgttgaactcctgacctcaggtgatccacccacttcagccttccaaagtgctgggattataggtgtgagccaccgcacccggctatccttggtatttttaaaaaattatctgtaacaggcaaggtaaacggattttttttttcttgaactgttattttaagttccgggatacatgtgcagaaagtgcaggtttgttacataggtaaacgtgtgccgtggtggtttgctgcacagatcaacccatcacctaggtattaagcccagcatccattagctattctccgtgatgctcttcctcacccacccctacccccaacaggcctcagtgtgtgttatctcccactatgtgtccatgtgttctcatcattcagctcccacttatcagtgagaacatgtggtatttgattttctgttcctgtgttagtttgctgaggataagccttccagcttcatccatgtccctgcaaatgacatgatctcattccattttatggctgcataggattccatggtgtatatgtaccacattttctttatccagtctatcatcgatgggcatttgggttgattctatgtcattgctattgtgaatagtgctgcagtgaacatatgcatgcatgtatcttcataatagaatgacttatattcctttgggtatatacccagtaatgggattgctgggtcaaatggtatttttgcttctagatctttgagaaattgccacactatcttccacaatggttgaattaatttacactcccaccaatggtgtaaaagcatccctttttcttcacagtcttgccagcatctgttgtttcttggctttttaataattgccattctgactggtgtgaaatggtatctcattgtggttttgatttacatttctgtaatgatcagtgatgttgagctttttctcgtatgtttattggccacatgaatgtcttcttttgagaagtgtctgttcatgtcctttgcccactttttaatggggttttttttttcttgtaaatttaagttccttatagactctagatactaaacctttgtcagataaataaattgcaattatttttctcattctgtaggttgtctattcaatatgatgatagcttcttttgctgtgcagaaactgtttaattagatcccatttgtcaacttttcctttcgttgcaattgctttcaatatttttgtcatgtaatctttccctgtgcctatgtcctgaatggtattccctaggttttcttctagggtttttgtagtttcgggttttacatctaagtctttaatccatcttgagttaatttttgtataaggtgtaaggaaggggtccagtttcaaatttctgcatatggctagccagttctcccagcaccatttattaaataggaaatcttttccccattgcttgtttttgtcatgtttgttgaagatcagatggttgtaggtgtgtggccttatttctgggttctctattctgttccattggtctatgtgtctgttcttgtacagtagtaccatgcagtttttggttactgtagtcttgtagtatagtttgaagttgggtagggtgatgcctctagctttgttctttttgcttaggattgtcttggctatatgggctcttttttggtttcatatgaattttaaaatagttttttctaattctgtgaagaatgtcaatggcagtttaatggaaatagcattgaatctataaattactttgagcagtatggccattttcacaatattgattcttcctatccatgagcatggaatttttttccatttgtttgtgtcctctctgatttccttaaacagcggtttgtagttctccttgaagaggtcttcacttctcttgttagctgtattcttaggtattttattctgtttgtagcaattgtgaatgggagttcattcatgatttggctctgtgcttgcctgttgtggtgtataaaaatgctagcaatttttgcacattgattttgtatcctgagactttgctaaagttgcttatcagtttaagaagcttttgggtcaagacaatggggttttctagatataggatcatgtcatctgcaaacaaagataatttgatttcctctcttcctatttgaatatcctttctttctttctcttggctgattgccctggacaaaacttccaatattgtgttgaataggagtggtaagagagggcatccttgtcttgtgctggtttccaaggggaatgcttccagtttttgcctatgctgcatgatattggctgtgagtttgtcataagtggctgttattatttaagggatgttccttcaatacctagtttattgagagttttttaatatgaagggatgttgaattttatcaaaggccttttgtgtgtctattgagataatcatgtggttttcgcctagttctttttgtattgaaccagcattgcatcctagggatgaagctgacttgatcgtggtagaaaagctttttgatgtgctgctggatttggtttgccagtattttattgaggatttcaacatcaatgtttatcagggatattggcctgaagttttattcttttgttgtgtttctgccacgttttggtatcaggatgatgctagcctcataaaatgagtgagagaggagcacctccttttcaattttttggaatagttttggtagatatggtaccagctcctctttgtacctttggtagatttcagctataaatctggtgaatagactttagaatagagacttcaaagtaaatatatgaagtggctggggtaaattcagtaagtacagactgtgtcacatcacaagccctgcccatcctgagggccattcgcctctcagctccagaaaattgttgtcatgttggaatgctcagtggaatctgaccttccaattgtctaaggaaagccaaagttctggattttatgcaaagtatctgtggttttaaatgctacctaaaaatttaaaaatggatacaacaagcaaactagattggcagcctggatgtctcattagtatacaatctcaatagttttccaagtgtttctacacactttattccaaatgatcctcacaccgactgtgagatgtaaacagggattcattgttccattttagagaagagaaatcagtgactcagaggagatgagcaactcatctaaagtcacagagacagcaagtgatggtaacagactaacttgctggtcctttgaacctgctacaccacatccttacaactaaacttctctgaaacaaagacaagggtccacaggcatcaaaaaggatttaggtactgggcacaggagggaaagcatgtaggatggatggagactcttgtgagtcataaggtgacagatagcaggaagatgtgtgctctttcctgaatgtatccctcaaatatgatagaaagctagccgtcggtgataaaattacaggaaatgaacaattctattatgctaggttccaaaaaatgcaagagaagggtttagtcacatgcatattctagaccttcaagaatcaagtttcagaatgtttcagggggaaaaagctatgataatatgtccagagattcttaaagcagtcatggctcaacaaagttgggagagtttaagtgccaaattctgatactaccatcacaaatagttgcagtatgcaagaaaatgaagaatcagttgaacagtaaatgtgactacataaagatttcagagcaggtgagtgcagtggcttacacctgtaatcccagcactttgggaggctaaagcgggcagatcacgaggtcaggagtacgagaccagactggccaacatagtgaaaccccatgtctactaaaaatgcaaaaattagccgagtgtggtggcacgtgcctgtagtcccagctacttgggaggctgaggcaggagaatcacttgaacctaggaggtggaggtttcagtgagccgagaccgtgccattgcactccagcctgagcaacagagcgagactccgtctcaaaaaaagaaaaaaaactcagagctttgaagtctatcataaaagaaaggcatgaaatcaaagtaattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtacacgtacgtaactaacctgcacaatgtgcacatgtaccctaaaacttaaagtataataaaaaaaaaaaagaaatcaaagtaattgtccaaaagtcttacttattgaatgagcagggctttgtctaaaaagaaacaaagtgggaaaaataaaaatggcttcttggcaaaatgatgtgcaaaatagaacaagaaaagaggaaaattgttgtctgtagcagataatttaaatgtttgtagataagtaagacaaagcagaatgatttgaagcttactttacccccaatttctttttttgttgttgttgttttgagacagagtttcgctcttgttgcccaggctggagtgcaatggcatgatctcagctcactgcaaccacctccacaacctgggttcaagtgattcgcctgcctcagcctccagagtagctgggattacaggagcccaccaccatgcctggctaattttttctattttcagtagagatgcggtttcaccatattttatccaggctggtctcgaactcctgacctcaggtgatccacccacctcagcctcccaaagtgctgggattagaggcgtgagccaccatacttggccctttacctccaatttctatattcaaggagaataatcttcagacaatacccagatgattaatctatgtgatgaaaacatacaggtgcttaatacattggaaatggtgaattgatgtgcggtccaaggcatgggaggagctggtgagatcactgactctctgtagaagagttaacatttctagtttgagacaaattacagccctacatactgaaatgactacagacatgattactaagaaacaccaagaagaggctgacttgtcaactaacaagtatttattgagtggctgctgtatgccatgctgaaagaaataaaaactcaagagtgaggaaggcagatggagttcatgtcttcatagagttttcattccactaaactagatagtaaaaaaaaagtacataaacaaataagattatctcgggcacttagaagtaaaaaaatatatttatggtaatgtaatagaagatttgacggggcaatcactttggctaggttggttagggaaggtctttgagaaagtgacactcaaattgagacttgaacaatgaaaaggaagtagttttatgactctatgaaagtattccaaactgcagaaacagcaaatacaaaagtcctgaggcaggaatgagcttggaggatttcaggagctgaatgaaagctagcatggttagagcccagtgagtgatgggagactagaaggagacacagtcaaagtgctgggactagaccttaataggctccaatgaaaagattttattcttgttataatgggaagccaatgtagggttttaagcaggggagtgacatggtgtgatttacattttagaaagttcactatcttactgtgtggataataggtaataagggaacaagagagtagtcaaaaaaagccaaataggaaactgtttcagtagtcattatggattggtcgtgtccctctaaaatctatatgttgaagttgtaactcctagtatattataactttattaggaaatagggactttatggaggtaatcaagttaaaataacctcatcaggatgggcttgaatccaatatgactaatccacatccagtataatgccggcaggcacacaaggagaacactgtctgaagaggaaggcagacattagggtcctgcttctacaggccaaggaataccaaaaattgccaggaaaccaccgggatctaggcaacaggcattctctctcaacactcagaaggaagaaaccctgccagtaccttgatcctgaacttctagcctccggaactgtatggttcaaatcacccagcttgtgatactttgttatggcagccctaggaaataaatagtccagaagtgagatgatggtggcttggagtaggattatagcattaggatgggagagatgcttggcttccacttttttggaagaagattctacaggatttactgataaagtaaatgtgagaagaattaaggatgactcctaggtttggtatattagcgaaccgatggatgatgccttttactgagatgggggaagtttgtgaagcaacaattatttgctcagtgggagaagtgagaaatcaatagatttgtttaggtcacataaagtaagatgtttattacatgttcaaatgaacatcttatcttcacagttaaatgtattcatgtgaagttggtgggtggtggtgattgggtggaaatctgggctgggctggagatataaatttaaaagttatgaagaaatatttcatatatttgatattcaagtatattcatattaatattcacatactttatattcatattaatattcacataccttatattcatatttttcaaatatgaacaagtatttgttcaaatcaggacaggtatataaaccatgtgatgagatgagtgagtgtagacatacaagaaagccaagaatttggtccctaggaactaaagcattcagtagcctaaaaatgagctgaaaaaagagaaaaagagttagtctctgacatatgaagaaaacaaggagtttttgtgttattttagaagaaaatgaaagtatttcaagaaggatgtagtgataaaatactggagagggttccagtgggttgaaaactgaaaatacatcattggactgcaagatggaagtcattagagattttaacaagcgtcacttctgtaatgatcttgacaagaacgcaaccagagtgggctgaagagaatgtgggacatggagaggtgtagacagtgactgtaggaaactcttttaggaatttttctgtgaacagtggctggaatggagcaacagatgaagagggatatgaattcaaaagaatggggctcaagtttgtgatattaagacatggcatggttgctgaagggagtgatccaacaaaaaaagataaattaatgatgcaaaataaaaatgataactttaggagtaaagtctttgaaaagatgaaaggggatatgcttgttttaaaatgggagcaaagacatgtcctccaccatactcaagggaaagcagtgaatgtggccaaagaggcaggtgatttgttggaattgggggtgagacaaggtgaaagacatgatggcatctattttattcatgaagtataaggtgagatcagtaaaggatgacaaagatttggagacagagaataagctgtcaaatagttgtctattcacaatcagagtagaaaagtgactttactgtggaagtatattgaaagtgtctgattgtgttagatgctcatttggggtttatgatcatatattttatgtgacctcagttagcagacaggtgtatgatattctccaaagtgggtcaggtgttcaggtgcagatgcaacatacatgactagggagtgacaagactgaaagacacaggcaagtaaccacaacaatttaaaacgagagagctccaagtttctgaaagccccccaaaacaatgggattgcacgttaggccacctgctagctatatcctagacccagacattttccagtggagaggagagggtgacggaaaacatttccatagagggcagggcagtggggagtatgacgtaaggtcagagtcacctagggatttttaaatccacacttgctcactccccagtgatgctgagaaacagcaccccatgggaggtatggagctaaaatggaaaatttttcttttagtggacattactattgatgggaatgggccaaatccttagagtagatggaatagaaagacaaattgtgagtgactggcacagttcatacactcctagaagataaagaagtaggcagaaggacacagcatgagctcagtaataaaaagtcaaaccaaacttctcacttccttttctcagtgcattaaaagactgacagagcagggcaggtgggcaagcaagaacaaagattttgttcttgggaataggagagagagatgtttagaaataggtggaagattattgagtaatattaagggtccaactgatgttgaaagtcaggcatggcagtaatctgcattcttcagtaatgctctccctcagtcctgaagagcatagacataggattagaaaatgtgggctgagcgcagtggctcatgcctgtaatcccagtactttgggaggccgaggtgggtggatcacttgaggtcaggagttcgagaccagcctgaccaacatggtgaaatcccgtctctactaaaaatacaaaattagctgagcatggtggcaggcacctgtaatcccagctacttgggaggctgaggcaggagaatggcttgaactcgggaggcagaggttgcagtgagacgagatcatgccacttcactccagcttgggcaacaggagtgaaactccatcaaaaaaaaaaaaggaaaggaaaggaaagggaagggaagggaaaggaagggaaaggaaaggaaaaatgtgatcttgactttggaggcctgcccagtgtgttggaaaaatctagggaggaagaagtctaaggtcctagtgaaaagactgaagtgagaagtgatgaacccagggaacgaggtaagttgagggaaggaaaggaggcgagggctgggcgcagtggctcacgcctgtaatcccagcactttgggaggccgaggagggcggatcacaaggtcaggagatcgagaccatcctggctaacatggtgaaaccccgtctttactaaaaatacaaaaaattagccgggcatggtggtgggcacctgcagtcccagctactcgggaggctgaggcaggagaatggcatgaacccaggaggcggagcttgcagtgagccaagatcgcgcggctgcactctagcttgggcacagagcgagactctgtctcacaaaaaaaaaaaagaaagaaaaagaaaggaggcaagaaggagactctttggactgagatactagggcagaaagtgcagccaccaaccaaaaatcttgttggattgaagagctgctgtgaagggaatcaagacatgggtgacatggcaggagtatgggttgtggtcatatagtgggaggacagtttttcacgtgggtttcctggagaggaatcagatgtttctgaccattactagctgtgtgccagcctaggaagttcattcttaagtctttcagaagtggaagaaagcaggaaaattgcttgctaaattacccatgaaagtcaaaaccattcttccttagaacttttgaaagcgaattgtcactaggacatatggggcttgatctggtcaaccatctcatgattttaaattttcatttgggatttttatctacctcttcatagcagagcaaaacaaacttgtctttttcccataaatataattaaaaaagagacaggctgaggatacccaccaatgggtcactctaggccctatcaaagtatgggatcaggatatgaagtaaatcccattaattgctgtaattgatagctccaaaagggagtatggcatacaattagaagttcccaaaagtttgctactcccctggagatgttataaaatagaatcagggttattagcccacattcaagcaaaagcttgtttaaagtggggcattttctaacttcttctggatagactaggcctctcttcacagttttgttaaatttagtgtttcatgaaacttaccaaggcctttaatattatgtacgtgcctttaattataagcacatatttcttctctattgcaagatttctcctgaactttacagatctgtcagtgaaagaggaaacttggataccacatgtggaaataacaaaagtgggatatgaacctcaattaactagcacataaagagtgctgttccctgaaaaaaactgttggattcatttaggtaatcatcgcttgatgaatgtactcttgctagtgtaaccttcttattaccatggagttacaaattaggtctgcaaaagacatctggaaacatctggccccttctaaagcaataacattccagtgtgttttttgacatactatgcagactcttccaataattctggatcttacacattgaaagctctcaagcgaaggtgctagttagatttttttaatgctttatttcccccaaaatagcaatcaaataactggatatacacatttccattttataatcactatcacactgtaatctaattacttgtttaaaagtgtgtctcctcactagattagccccttagagaacaaaacatgtatccatctgtgtaacttccttatgaaactacaggtatgtgctggaactgtatcctctacaaacaagagtactaataggtgagtagctttctttaagaacatttattgcagtattgttaaaatggcagcaaactggaactaaaccaaatgtccatcaagtggggaataattttaaaacttataataaatctatagatagaatattatttggcttaaaaaaaatgagttagagctgcatcagttgacctggagagatgtccatgatatattgctccatgagaaaagcaactaacaaatggaattatagagtgttattccaaattgtaaaagtaaacaatgacggcttgtgaaaaagataggtgtttatgattgtgggagaatattcataatgcactaacaggggttaccttaaggatgatcaggaattaaggtaaatgagtgtgggagaatagtgctagcaaaatgcaaaaatactcatgccataatgctaagggaaaatgcagaatgcatgattttagcaatagtttttttaaaagaaaagtttacctttcggtgtcttactggttgatgccaggcatagttcttaaagctctacatagactgtttcacttcctgcccgcaccaactctgtgaggtagggattattatttctttaatttcacataacagaaaactgtggtccatagaagttactgagctggccagtggtcacacaataattggctaagctaagacaaaataataacaggcaaataggcaaaaaatgaaattgcatttttttcctagaaactaatcagatcaaatgaaaagtatccatttaattaagtaatagacctgtggattattttttgcctcgaatttttgctattatttaatattacttcatttaaataaagtaaaattactaaaaataaatacaataaaatggctagtatggtggttttcaaaacctgtcctcaagtcctttgatgtgggaggtctgtgtttcttccctttgaattaggtggggcctgtgactgatggctctgggcaaccacataggagaagcaacattttgtgcttttggatgctgagtcaaaaaaggtaatacaacttcttcctggcttcctttttgggaagcttgctttggaggatgccagccaccatgaagtgagtctcatacagagaggaactgaggccccagccaacaggcagcatctactgtcagacttcagatggtgccagcctctccctagctttggaatcttctagctgaggccccagaaatcacagagcagagacaaattacgccaactacactttgtctgaatcttcagtgagcataataaatgtctgagtttttgtttgttgttattgttttgtttatgtttggttttgtttgttttgttttgctacaaattacatagcaacagatagctggaagagattctgcagtgatgttcgtcagtttggggtaggttttcccttagttttattcttctgctctctttaggcatattgtggtggttaattttatgtatcaatttggctgggccacagcacccaaatatttggccaaacattattctatatgtttctgtgaaggtgtttttttttatgagattaatatttaaatcagcggactttgagtaaagccgatgacattccatgatgtggatgggccttacccattcagataaaaatcttttttttttttttatactttaagttttaaggtacatgtgcacattgtgcaggttagttacatatgtatacatgtgccatgctggtgcactgcacccactaactcgtcatctaacattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattctatggtgtgtatgtgctacattttcttaatccagtctatcattgttggacatttgggttggttccaagtccttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttgtgatttgcatttctctgatggccagtgatgatgagcattttttcatgtgttttttgtctgcataaatgtcttcttttgagaagtgtctgttcatgtccttcgcccactttttgatggggttgaatagaacaaggactgacctctccagcaagaaggaattctgccagcagattgaactgcaactcttgcccgatcttcctgcctgccacctacctcatcaggttttggattcaccaagcctccagaatcacataagccaattatgtcaaaacaaacctttgtttgtcatcattgttttgtctgtgttttggtttggtttggtttggatgggctcaagtgatcactcttcctcggagccaatccagttcaattaagttcatttcccattgctacccctctaattttctcaccttgttcagcacacagaagagaaatcttacttctgctatgacaaggctgcctagatttggaaacataaaatggcataacataacctctctctctctctctctctctctctctatatatatatatatatatatacacacacacacacactctctctgaatagcacacatattacacacattatacctttaactctgcttcccaaactactcaccagttgcgcctgcatccaaacctcattgtagtatccaaataaatcacttctgtttaagttattatatatgtgatatatttaagaggtctagaaaagagactaatagtagcatagagtcagtcttctaaacttctttctctctcttaggacaaaaattggaagcaatatgcagccatttccaacaaatgagcagcccacatattagatggcaacatcaaggatagaaaactttaggaagataaaggcctgggaagtagattagctgtggctttcgcctggatgtggcttcatggagttacatatgccactgagaattcccgagtgacaaagtgatcaaatccaggcaaaggaaaaaaggaaaggtgcagcttacccctcgaagcagtgggcaactgtcagaacccacttcttggcaatgaggacacagccacagatatgtccactgggttcactctgcagagaacactgccatggccaccttccagggcgactcgtccgacctccaaggatccttttgttcattcgggcagcagggcggcgcccacagtctaccaaggagcagaagacacagtttgtgagttgatgccaaaccttgctaaatgcttagctctttgctgtcacttacaagcgatcactcttcccctgagccaatccagttcaattaagttcatatcccattgccacacctctaattctctcaccttgtttagtacacagaagagaaattttacttctgctctcacaagactgcctggatttggaaacataaaatggtataacattaagttacatatttcttgttcaattcaaacactttaccagtgaaatacaagacagctccaactgttaccaccagaaatcacattctctgagcatttcctgtgttaccacaggaaagcacattcctcttggtgcaggaattctcaaggcaggagtgtggtcagatattaatcatgttgtaggcaggagtatatggaatatatatacttctttttttagtttatttaatgtcatcataatttaatttcacatttgtgggaaaagaaactattttaacaaaatttcccacatcattttggctggtggaaccaccacaatgcaaattcaaactacagttctcaaggggagatgggagtactttttagagtcagtggtgaggaggcagcatgtcagatttttatgcttatacaaagtggtgtgtgctcaaaacaagttgagaaatactccaagatgagtaaaatatgacttcagaaatttgaagaacagattaagaaatggaatatttagactggaaaggagtcttaccaagactctcaaggttaaatttctgctatatgagaagttgacaagaggaaaagtagcttaaatttgcttcatataactttagacgacatgatcagaactagtaggtgcaatttacaagaattgtgggttcaggaaaagaattttctaaaatctaaattcaactttgaatgcaagaacatggtccctgttaaaggatctttcaatgtgatggcacaagataattcagtttggggtagaaattttaatcactaagttctcttccaaccatgaaacatttacattacaacctcaatgtaaatgaaaaaggacaataaaaatccatattgggactttcaaaaatactatgatgtacttagaatcctagatctatcagattgaaaaaaaaaaatgcaaccctaaatatataatttccacattcctttctgaagatttactgtattttcatttcttgctaaatttatgtaggggcaagtgcaattatttgcatacaataaattatgtaatacaggaaaagctcatttgctttctaccctcccacagtctaaaatcctctcttccttactctctattacattattctaaatttatttgcagcacttaccaaagcctaaaattatttttactaatttataatctttattttcacccccatatagtgtatgttccctgagatgagggccttcatttcccctcattcacttctacatcccctcaaagcctaatactgaacttggcattaaagaaatacttaataattagttgttatttgttagattgaaaacacatagctcttaggaataggaaaagtcatcaaagactattcatccaacttcttagtggaaattgcagttatataagataacacttgtagttagtaaaccaggactagaaccaagtttaccaactcccaatctagaatgcattatttatttatttatttacttgacctgaaaggttttttctggaattacaggtttggggaaacaaatcacttggttaaaagatttaggtcattgttttagaggaagtacttcaattgacaaatattcagaaatttggctgcagagtttgttttatgaggaaaatgtcaagaactttttaagaggaaatggtccatttttagttttcctctttaaaattcttaagaagtagcaacatttatgagcttcagagtcagatatatttatttagagttcagacactatcacttagcatctgtgggctgtgagatttgagcaagttatttaaatattcaagctgtaaaatattggataatcatccatggttcacaaatctattatgaggtttaaacgagtcagtgtatataagattacctagctgtgtgcctataaagtaataagaacttagtaagtgtaaatttcctcaatttatcttcctcctacaccccacccatagacaagggaagcaaccctgtttaagatgcaatgattttttagggtaaacttaagtgtactttcaaggcaacttgattataatttcatttttgtgtctattcctctcttagacattccaagttttcttagttatcattacttcagttccctctgtttactagttctatgtagcatctgcaggaaatgcagacatgagggtttattttgaataagatattaaaagtaatccaagattagaacccaagttcctctctcctcgccatgatagtttctgtaatcgtgaataaaagagaaaaaaaatctatgtctagaaagaagaaataaaagcaaccaatgttgaaatgtaaaggcaatagtaaatctatggaaactctttactgatatgacaaatttggattatcttaagttaaaaaatggaagaaaggcccaatgataaactcttgctctgtaatctgactctacacagctcttatgaatgcattcttacccatttactagaagttcatgtaaagtggtcccattgaggctctcccagttggagtgtaatgtcagccaccgcggctctttctcctgttcctgtatcaatttggtcacagatggttctctgatacaaggcaaatactggataagtattcaaagtacaatgatctttgaacaggcattatcattatttagcactcattccctttcaaaaagaagcactaaatcatgtcaacatttcaagaggagaatttggactgttacaaattgttagagctgttttagtcattctccctgctgacctgtgtttgaactgcatgaggtgttaggattataatgtgtatgatacaaaagttccaacaggtaaaacataagaataactttaggcagagatcaaaagtaaaataaaatgtatctagctaggtttttttcctcctcttttcttgtccattgtaattctgcaatatagcaatataaaataaaataaacaacacataaagagaatcagtggccatttagcatttatttagacagcataaaagttgtaagaattgtaatatttctatgtttgtaggttgttgttgttgttgttgttgttttttttttgatgaagtcttgctctgttgcccaggctggggtacagtggtacaatctcggctcactgcaacgtctgcctcagggttcaagtgcttctcctgcctcagcctcccaagtagctgggatcacaggtacatgcaatcacgcccagctaatttttatatttttagtagagatgaggtttcaccatgttgtccagggtggtcttaaactcctgacctcaagtggtctgcccacctcagcatcccaaactgctaggattacaggcatgaaccatggcacctggcctcatctgattattatttttaaactattgtaatcacataatagaaaatggacaaaaacttcccctaactcatacttttaaaaaggcaaggaagaaccctctaaagggaatacttgatgatagaataagagccaaagattaaaaacacaagagtatttcataatgaatgaattataaacatttgattttaaaacaaatgtcatacatcctagccacaatgaagaagagtggcttaagatataaatttatttagaaatttgaattgactgttagattaccgaagatatcaaaaaaacctcttacaaaaataagaatttttctttttcttggccaaaatgaatccggctctccatcaattccagaagttctgaatgcagaggcaaagtgagatggaaagtataaaagtcagaggccacacatactggtcatggtgtttctcctgataacctgcatcctgagaattcccttctgcgatagaactacctatggacctcctaaatccaggtaaagccaaaagaagataaactttagattttgttatttaatcaggtcattcttaaatcaggtattcatagggcaacaagatacttgcatggggagtgcaattaggagagagtgtgcactgatgctggataggaaaatcattgcaaggaacaccagcctttcaactcaaaaggcccccagctgccctgaggaagggctccacagacatccacaggatgtttttgcatttcattcattagcttccaagaggaaaggcaatctagatggaatttctcagttataagtggaaaatttaagaaattaatcatcaaggataggggagtatcattatgaaaattaggtttccatgaaattcttgaacactggcatgtttctcatgcacaaacataaactttcagcaccagaaatgtcatccaatggcccatttaaaaaagtcagtgaatttgtttggttgtatttctgccatcgtacagaatctgagcatctccataacttcaatttccctttcttttttttccagctttattgaggcattcttaacaaataaaaattgtacatatttaaggggtgtaatgtaatgtttgatatatgtataccttgtgaaatggctaccacaatcaagctaagaagcatatctatcaccacatagttacgtgtgtgtgtgtgtgtgtgtgtgtgtgtgtgtgtgttaagaacactaaggccaagaatcttagcaaatttcaagtatacaatttagcatcgttaactatagtcaccatgttgtacattagatctccggaacttattcattccacattaccaaatctttgtaccctttgaccatctccccattttctccatcccctagtttttggcaactaacattctactctctgcatttacaagttgacttttttagattccacatataaatgagatcatgcagtgtttgtctttctgtgcttggcgtatttcacttaatatgtcctccaagtttatccatgttgtctcaaatggcagaatttccttctaagaatactgagtagtgttctattgtgtaaagaaaatgtagtgtgtgtatgtgtattctttgcataaaatttctattgtataaagaaatatatattctattgtgtaaagaaaatgtggcatcacattttctttatccattcacttatcagcaaacactgaagttgttttcatatcttgggtattatgaagagtgctgcaattaacatgagagtgcagatgtctttttgagataattatttcctttagatatatacccagaagtgggattgatggatcatatggtaggtagttctattttaaattttttgaggaatctccatactgtttttcataagtactgtaccaattaacatttctaccaagaatatatagggtttccccttctccacttctccccaacattttttatgttttctctttttgatgataaccattttaacagatatgaggtgacatttcattgtgattttaatttgcatttccctgatgattagtaatgctgagcaccttttcttatatttgttggccattctatgtcttccttttagaaatgtctgttcaggtccttagtccacttttcaatcaggttatttggctttttgctgttgaattattttagttccttatgtattttggatactaacctcattggatatatggtttttttaaataactttgaaaattataaaagtaatacttgtacacagaaaaatatatcgacaattataaaatgataaagttgttttcttctcctatcatatcaacaattataaaatgaaaaagttgtcttcttcctatcttagatgcatagaaacaaccactgtaaatagtgtttgagtatctttgtcaagctctttctacaattcatgtatacatttccctcctttgctacacacgttgttctgtgtggtcttgatactttcacttagtgacttatcttagaagtctttccaccataacagctaacaggtgttaactgttttctatatgacaagcactaaaagactaacttgttttatttaatcatctcaacaactctgtgacgtagactttataattatttcccattttggagatgaaaaaattgaggtagagaaaacaagtaacatgcccaaggcacaaaacaagcagacggcaaagctggtaatttaatccctatggtctcatgtcagagtacagttcttaaagtgtgaaccctacacagttctcccccattgacagcacaccatgttcttttgatagctgcatagtgtttgttacatggatgttcatacatttacttaactaatctctgcacacataggtttgggggtatgataaaatagcagcagttaatatcgtaaacattcaccttcgcctacatgcaaaagtatgattttggaataaattcctagaaataaaatcattgaatcaaaatttgaatttttgattggtattatgaacttccatttcaaagaataatagtaatatacatgcacatcaagaatatgtgtgcctgtacttctccatttttaaaactatgtaaatcatcttacgtaaaaggtggctggaacttaagagctgctcaaattttgtttgatgattgggattgcttttgacttaaataattgaaaccgttttgtattatatgaaaagacaaaaaagtcctgttgtgtagaaagcaaaagagaaaatttaagcatcaaagtcactgtatcctaactgagtctgtgcaggtaatacagactcaaaatgcttccatagcatctatggattcatacacggagaaggaaattttagcaatgatctaatccagcagctagggcaagagtaccagtggaggcccaattgccatttgtctacatatttagaagttataaatcaagttatcaagctgttaaagaaaatttctctcctcctctcttgacaaacacatctgttaggttcaaatacagaactcttggactcctgagaacagtgggtttcaaactttagcattcatcagaatcacctggaggacctgttacaacacagatttgttggcctcatccccagattttctgattcagttaagtctcagatgggacccaaaatctgtctctctaccaagatcacaggtgatgatgatgatgctggtctgagaccgcactttgaaagcatcactctagaaaagggatgaggctccatgtgagcagaactccttggctaacagagtccttaccccatggggtgagctagaggaggagggccggagggtgcctataaatcagggtttctcaccctaaatgctattgacaagttataccagttaattaattgctatgtagagtgattcctgtgcactgcaggatgttttgtaacatccctggcttctacccactagcaagtaagaccccatcaaccctggatttacaatttaaaaaataatgtctacagacattccaaatgtcccctaggacaggggtccccagccccagggcccctgttaggaaccaggccacacagcaggaggtgagtgcggggcaagccagcaaagcttcatctgtgtttacagctgctcaccatcacaggcattactgcctgagctccgcctcctgtccaattagtggccttagattctcccaggagtgtgaatcctattgtgaactgcgcatgcaagggatctgggttgcgtgcttcttatgggaatcaaatgcctgatgatctgtcactgtctcccatcaccctcagatgggaccatctagttgcaggaaaacaagctcaggtttcccactgattcaacattatggtgagtagtataatgatttcattatatattataatgtaataataatagaaataaagtgcacaataaatgtaacgtgcttgaatcatgccaaaaccattccccccatcccatcccagtctgtggaaaaattgtcttccacaaaaccagtccctggtgccaaaaaggttggggattgctaccctaggggcaaagtcacccctggttgagaaccactgctctaaatcatggagcccagggcaaggcccctctgctctgggcctgaaggcagtgctatacagagaagcaaaaggatttgccttatatttgcttcttgaggaattgtgtagtcataagacacacatacaaatatatcacttttctgatgctgaaatgagagaacagagctcattaggagttctggaacatcctgacattatgagagggattaaatatttcaaggcttaggagaacagccagatccctagacaatttggcctactctcccatcctcaagtcacttcgtttagtaataaatatcccatgcttgaattatgattatgttggggctgcttacttaaaaaacgaaggtcatcacaaattcccccaaaaccagggcttttttcttacctctaacaacaagacagaagtgcaggaattacctagacatgtaacacacttcagttgaaggataaggtttgtcctcttccatctattgatgggggaaaataatctaagcatccagcctcagtccttgacagttcatcttgacatataaatgcctttcacagtggataagataaattttttgcaattctaaatatcctgttccaaacttgaaacatttatactaaacattttgtatctgatttcaaaaatctcttcttgaatcttgtcatattctccctgtttgggtcccacagatttgacatactaataactgaaagttattgtgtcaagtagaaattttaacaggcaggtactaataggtttcaaacaaaacatgaatgaactctgctacagaaacatttctcaggctggatagctcagttcaatgggagtttatacagcaaaactttcatcaatagaaatgcttaaagcagagcataagttctgagcttatttttctagttaactcagtattttaaaaacactttttattgcaatcctaactgacaatagatgatagatagatagatagatagatagatagatagatagatagagatagatagttagatagattttttttttttgagatggagtctcactctgtcgcccaggctggagtgcagtggcgtgatctcagcttactgcaacctccaccttccaggttcaagcaattcttctgcctcagcctcctgggtagctggggactacaggctcatgcgaccacgcccggctaatttttgtactttttggtggaggtggggtttcattatgttgcccaggctggtctcgaactcctgacctcaagtgatccacatgcctcagcctcccagagtgctaggattataggcgtgagccactgcgcccagcctataattttattctttgactatgtgtttgtctatctcagagatggagtgtagtaactgtattaggcaaggatctataggtacaaatgacaaaactatctcaaagcaaaggggggaggttaatggatcataaaattaacttgcagagtatttatatttcataaaataaactaataaacaaaactaaatatttaatccatttccaatataaaaattacaaaattgtaatgtgaactaaaatttaaatttataaaatatgactgttaaatatacattatcattctaatataaattagaaaacaaaattaataaaataaagcaccatttaaaataaacatcttattaaaagtgtaaaaataatcaatcataaacattttgaatgaaaatatcatttgaacatatataaaattcagtcttataaaataaacatgttgtaagaatatttttgagcagaagtgtctacctcttttggaatctatgccagtccagatatttccttctggctattttattttcaaaaatctcatctccttttttcgagaacttgaccttttgggacaacacttttttttgagagacagaaatgcaacattttattgacaatttaattttagtttcaaagaaaatatttcttgtttatcttcacatcttttgtttcatcatgtaaagctagagattatcagtttcaatttcaacatgactttttaaattccagttcttcagaaagactgtgaaccagagtagaatgtatttttctaacacaagtcttgctttgttggctgctcttctcttcttcttgagtataacaggaatataaaaatgctttctaaaaatacgtgcatcacttttcacttcaaagttttaagtcagtatataactatatggatccattacaagataaattaattcaaaattcaaaaaaaattaaacaaatattgaattaactaaaaaatcggcattttaaaaatgcctaaaatagtgctggaatatatgagtatcaaaaagtggaaatgtaattgattactaaagagatgtggatggtcttcaggatgattgatgccagggaaccagtaccctcaaggctcttcagctcgtctccacttccttctgtgttgtggggaggagggcaaaggggatggcagcttgattggcttaaagtaacttttctgcaagccaaaggactggttgcctacagctctaaactcacaggcattcgtctttataaccaaaaaagaaagaagtcatctctcccaggtccaatcaaaataaatcttgggccgggtgtggctcacgcctgtaatcccagcactttgggaggccaaagcaggtggatcacgtgaggtcgggagttcaagaccagcctgatctacatggtgaaaccccatctctactaaaaatacaaaaattagccaggcatggtggtgagtgcctgtaatcccagctactcaggagtctgaggcaggagaatcacttaaacctgggaggtggaggttgcagtgagccaagatcacaccattgcactccagcctgggtgacaaaagcgaaactctgtcttaaataaataaacaaataaaaaccttgttgaagatacaaataaaaatcttgttgaagaaacaagtatcccaaaaccaattactttggcctggcagtaagacactttgattggtccatcttgggataggtacctacccctcaaccaatcccagacccaaaagagaaagtcatgtacaaagaaggttgctcccatttggagcccaaggataaaatgggaagtgaagtaaatatcgagaaggaagggatgtaggtcccaaaggaagggaggaatgcagagaagcaacacaatatgtgcccgctgcatgtgatcttaattgaaatgtgttagttcattgttcttgagagtcaagattctacatgttcttcagtttgtatgttagttttaagaagacataggaaatgtaaaagattaggttgaaattagatttgacatgtttattaatgatacaatgggttaatcagtgagtgttcaagctgatataaagtgagttggagctcagaagaaacattatagtgacactttaaacaagtgacagagccagatagacaagggttaaaactgatgcttagaggttaatgaggtgggacagaaatggagacaacagattggtgttgtatcagatggagtccctctctgaggagctattattttagttagaggaacaaattacaaacatgtaaaaaactattttggatactgataagttgttggaataagacaaaataaccaaatgtgatagagttacatgctgagactgaaagctgcctcaagtaggattgtcaaagaaagcctaagtcacagatgtatgagctgagacatgaatgatgaagccctagagttctgtattctatgcaaaaataacggtgaaggaaagtttgaaatgttttatgcttgaaatgttttaacatcaatattaaggtcaatgtgtctaaagtttagtgggcaagtggagaatactaggatatgtattgggtcagagaggaaggcaggggccaaattatgcagtgtctgacaggtcagagtaagaaatcagattttcagtccaaactgtaaaatagtaagaaaagaagaccaaaggcttttgcatgttggtaatattattgctgtcagtcctgtctttcaggtaaaagccagattgcagtaggttttgaagacaacatgaaaaagacaccttatcagaagttaagtcattactaagggtctcctggcatatctagcttcaaaagcagactgcttccttacaagggcttctaacagaaataatacaagccctctttggtcaactcctgatggattattcaagttataaatcatgttcttatttacccaggatccattcatatcatgtccaagacaatgctgcaaccatggtgatgactgggagtaaattttaggaggaagttaaagtgtaaacccttataccagggattattagggactagtaggtaatataatagatgttgtctttgtggttttgcccagatacagaaatattctttgaaaacaatgtttgaccaacttctattgaccaacactaaaagattagggcataaaatcaaattgcaactaactccataaaagcatttttgccaaaatcatatgacccagacacactgtttcccgattatctaactttagataaagcttgtggagcccagagatataaagagtcacctttcccttagactaactcactcaaataccagatgtttcaactgagcatttggcaaatattagaaggcagtctaaactctgatttgtatcatcaattaaataaatgtccataggttttttgatactgaacatgcaagtagcaaagtcaatatgctgttgacatgatttggctgtatccccacccaaatctcatcttgaattgtaactcccacaattcccacatgtcatgggaggaaactggtaggaggtgattgaattatgggggtgggtcttcctgtgctgttctcatgatagtgaatgagttttaggagatctgacagttttaaaaatgggagtttccctgcacaagctctctcttttctgtgtgctgccatccacgtgagatgtgacttgctccttctcaccttctgccatgattgtgaggcctccacagccatatggaactgtaagtccattaaacctctttttttcttcccagactcaggaatgtctttatcagcagtgtgaaaatggactaatacagtaaattggtaccagcagagtggggtgctgctgtagatacccaaaagtgtggaagcaactttggaagtgggtaacaggcagaatttggaaaagtttggagggctgagaagaagacaggaaaatgtaggaaagtttggaactccctagaaactagttgaattgctttgatcaaaatgctgatagcgatatggacaataaagtccatgctgaggtggtctcagatggaaatgaggaacttgttgggaaccggagcaaaggtgactcttgttatgttttaccaaagagagtggtggtattttgcccctgccctagagatttgtggaactttgaacttgacagatgatttaggatatctggtagaagacatttctaagcagcaaagcattcaagaggtgacttgggtgctgttaaaggcattcattttcataagggaagtagagcataaaagttaggaaaatttgcagcgtgacaatgcaatagaaaagaaaataccattttctgaggagaaattcaagctggctgcagaagtaacgaggagcagaatgttaatccccaagacaatggggaaatgtctccaggacatgtcagaggtcttcatggcagcccctcccatcacaggcccagaggcctaggaggaaaaagtggtttcatgggctgggaccagggtccttgtgctgtgtgcagcctagggacttggtgccctgtgtcccagccatgacagctatgactaaaaggggccaaggtacagctcaggatgttgcttcagagggtggaagccccaagcattggcagcttccacatggtgttgagcctgtgagtgcacagaagtcaggaattgggatttgggaacctctgcctagatttcagaagatgtgtggaaatgcctggatgcctaggcagaagtttgctgcaggggtggggccctcatggagaacctctgctaggcagtgtggaagggaaatgtggagtcagagacccccacaaagaatccctactagggcattgcctagtggagctgtgagaagagggccaccatcctcaagaccccagaatggtagatccactgatagcttgcaccatatgcctggaaaagccgcagacactctatgccagctcatgaaagcagctaggagggaggctgtaccctgcaaagccacaggggcagagctgcccaagacccatgggaacccactttttgcatcagtgtgacccagatgcaagacatggagtcaaaggagatcattttggagttttaagatttgactgccctgctggatttcagacttgcatggggcctgtagcccctttgttttggccaatttctcccatttggaatggctgtatttacccaatgcctgtacccccattgtatctaggaaactaatttgcttttgattttacaggcttataagatggaagggacttgccttgtcttagatgagacgttggactgtggactcttgaggtaatgctgaaatgagttaagactttgggggactactgggaaggaatgattggttttgaaatgtgaggacatgagatttgggaggggccaggggcagaatgatatggtttggctgtgtctccacccaaatctcatcttgaattgtaacttccataattcccacatatcatgggaggaaaccaatgggaggtgattcaattatgggggcaagtctttcctgtactgtcttcatgatagtgaataagtttcacaagatcatatggttttaaaaatgggagtttccccacacaagctctctcttttttgtgtgccaccatacacgtgagatgtgacttgctcctccttgccttccaccatgattgtggggcctccccagctctgtggaactgtaagtccattaaacctctttttcttcccagtctcgggtatgtctttattagcagcataaaaatggactaatacagctgccatgagaatttaggggcttgatttatgcattcttctaatcagagagccatcatacttccaatctgggctgaactcttgagatagcaacagatgaaagcaaaaagttttcaaattcaacaaagaactctaaatcttctcatctagacaagcactgagttgagagcctagcatttgagcagcaacacatgaaaggcataatttgggtctaaaacatcctaagtgcaggtgttttaaatcaactgcctctatcatgaaagcatttcagtagaatccctgcaacccatgaaatttgggagacctgcattcttgataaattccctccaaaatataccccctgaagtagaagaatgatccacttggaattagggtatgctggttccggaccctacatacacactacaatgccgttctctataaatgtttactgaatgaacggatgaatgaatgagtgatacaacaaatttatactatcaagataagattaaagttttatgtttttcttgtataattttaatagaaatgccatgttctatgcaataagtctacaccattctctgatggcaaaatatctggacttttttctaactttgtgttcttggctgtttacctacatgtcttccccactccattataaactctgatgatgttattcacttttgcatcctcgacccaatgcctagtccagtacaaggcccataagcagatactcaaaaataaaaagggaaggggaatgctgaatggaattagttgggagttgctttttaaacttcaagtttttgatgcagaatatgtctgaatgtacaaaggcaggctggcataaactccactccagaagctaagaaggaacaccattcccacttccctccttgtgcagcataggccaatcatggccagacaaacccttctagcaagggctttgatctggaggaaatgactcaaaggtgcagggtgacttagagtttatttgaggcatcggtggcagaatcatgaatttgcagcacagcagctggtctcgagagacagtggtcacatggcagctgcctgagcctgttccctcagcaggaagatagcctcatcttgaccattaccatcattcccggcatagcctggctctccagatttctgtcaattcatgagccactcaagtcaactaaagagtaaacttcaaggcaactaaaaagttcaaaaactactagtactcatttctttggaggacttatcaccacttacccatttttcccattaaatcagtcaaataatggatatgggtttccaaccacacctctatctcagattttcctagtccttctgtgaaataaaataatctaaaataaaaagtatctgcatgtctatttgaattttatatatctaaagatatctaaaatactgaagtttcattttccagctatgttgagaaaatggagcaaatggagtacataattttttaaaaatccactgtgcacacaatagccaaaggtgggaataatccaaatgtctgaatggataaacaaaatgtatatccatttaatggcatattattcagtcacaagcaggaaagaagtactggtacatgctacaagacagatgattgaaaatgtgctaagtaaaagaaaccagatgaaaaggcctcatgttgtatatttccatttatattgaaatatccagaataggccaatttatagaggcagaaagcagattagttgttacctggtccagtgggtacgagaaaatggagagtaactgcctagtgagtacacagtttccttttgggataataaaagtgttctaaaacaaagagtggtgatggttgcacaacattgtgaataaagtaaatgccactgaattatacactttaaagtggttaaatggtgaattttatggatgtgtattttaacacaataaaaatcccaatatgcaaatatttagaagaaacataaagaagcatatttaaaaacaggaacctttctatttacaatagaacagctatgttcagggtggcttgtcaaaaggactttctggttgtaaaatctttgcagtttcaaccttataccaataaggttttatcgagaagaaaaataaaaataaccatattcaaaagatttttcatttatctctgaacacaatcataacctatttcatttagacacaataaggaagttgtgagaatgaagtctaatttaatagatcttggcaaatataatttttccactctcacaaagtttaaaattcctttattatagatgagcattagttattcaattcctaaagatgttggtcttcacatgggagaaatggactcaagatggtgggagctgcatattagtaattctttaaactaggataacaaaaatgtgctgctagttgctatcccataactgcatgactcattattgtaaaattgtttcaagtttgttcaatggatcttaggaaatggcatttactcaattttttatttagtctagaattttagaactcctttgtcttcaatttctctaatttctacatttcccccaaatctcaaatacatcaatggtaaaagaaatacttacacattctaagaccctgaaaattattgctttccacccccaatggaattgaaaaagaaaaacctcacaaaatagcaagtatctaactttcaaaggatccatttcagtatatctgtatcaaagccagagtgaatcttttcattctactaagaagcaaatatactgaactatttcttgatttacatttactgccttacttagagtaaacagaaatgccagcaacttcagcttatttaaaaatgtgtgttgcttaagaagaaattttcaataacctcttggggggaaattacaagatattttcatccagattcctcaaaggaaatgattgtaatgcttttataaataatgaaagcatttcattgcagaagtacttaaaatacaattacttcatttacttttagaggcttcatcaaagtacatttccagcacacactcttcagggcaggtgcctataattaaatatggtcctctcacctgattcatttcccgggttttgaaggactctttgtttgagagcactaactctctgtgcatcctaaggaagatattactgccaagttccacaaagccttctgagaaattcatcagtgctacaaactactgaccttaccctaaacccatctgcttgcaggccagctgactcaatatctcctgccagccatctgcacacacatggtgttctgtggcagctctgtgaaccatcagaaaggaagaggagttcacatttatagagagggtcactagggaaagaaaagacaagggaaaccctaattaaaaacatttcttcccatgaaagcacataactttacatgcctctgcttcattggcatacattcattttcatttattttagttaatcatttgatgtgtacctaccctgtgcaaatcactgccttcagtgtgctagagggctaaaaaaaaaatgaattagaaatgttctctaccctcaaagaaccgtagactctaatgaaagagacaggcagttcttaacttttcttaatgagttagaagacagccagagccaggcctcatcccatgagttaaccaggatttgcataattacaagaagcgagttgtaaatctatttctatcatttccttcaagaaagtatacgagaacgcaagtgcgtgagagggatgcaaatttaggattaatttggtatatgtgttaattcctattatataaaggagaatcctctgtacttaaccagcctcagagcacttaggaaacgctgcacaattgatcacaacacacatgagaatcatgatttggctggatgatgcaaaggactgagaaagagctgagtgaatggaaggagtgatgagtgtgggatgaggaaattaatcaaactcaagatcacaaactgcaacactggaggtgctggtaggagatgtctttaattcctgtctgtgtaaggagctagacagttagaagtcttggacctgaagagtgtagggaaggcagaggggccacttgactattctattctagcaggtagaggtgacaaaagaatggcagactatcattaaatttattgaagttgggttttaatgaagagtttttaaatcctctcccagcaattatatgattacaacattttgaacccaaacgtttttccatacaatatagatatttcaaatagagaagtagcttcgtggggaaattttctgtgagttggaaataacacacatagatcagcactatcagcttttataacagtaaaacaaaatagatgaacttggtcagtaaaatccaggaagtaatttaggatccattcagcttcagtggctgacaggcatgagagagtacaacagatggcagaaacaagtagctcaccacagtcccattcatctgaactgtctgagcagtcggcttcaccatcacaccacaggtcacgtgacacacacgcatggtttgcacattccagctcatcatcttggcaaaatgctggcatggggaacaaaaagtgagaaggaaaacattttagaaataaatgtgattatcactaacatgcatatcttcatgtgccagcaggagcatggaaagaagaaaatatgtgatcactgaggcttccaaacgggcataaaaacagaataacataatttgtaaaatatcatttaatagacatcaatacatacaaagagcatttaaacagaattactatgttcaagtgactcaatgttctggttctaacaatcagactgaataaacagtactcacagccgcagaaataccaaagatcagagaacggggttaaaatctgcatgagcagagcatgagggatgaacagactgaagccgccttagatagaaaacaatctctgtccacagagatgcataataagtttttttttccatctctattattaaatgactctctgagtcatacatagttctcttttgggttttaaaaattatagtaaatctccttgattgcctacttaacaaccatttcctttctccctcctttctttaagggagcccgattttgttcaggcccctacaccagccatccccacttccaaaggaagatcctgattagtttaagctgggcatggcatttttctgtctacagtttttttgtttgtttgtttctgaatacaattagtagtccaggagtaaacatgtgctccgatatcagggccttgacctacggttgtgtgattgtgcttcacaggacagctcctgcccaaactctgctgctgtgccatgtgccctagcctgggacaggaacaacctggagaaaacagcaccttttttttgattggttctccctgcgtggtgcttctttttgcagttcagctgtttgtaggaagtgtcttttctaactacacaaagactcctgacggctagctgtgactccgcccaaagttgacctgagcgaatcccttaatgatatcttggagatatgaacacagttcttcctccttccagctggacatgatcaaggaagcatggtgccccagatgcccttggtaatgtcatattttcaccattgtgggagccagcctgagttgaagctgaactgaaaaaatcacagacaaagtgctaaactgctgcatacagcctcaagagtccacctacttgactctatatgataatataaaacatgtgatatgtatatgataataaaagataaatgtcttcattatttgtcattttgatttgggcttttctgttatttgtaggtaaaacatcttaagagacataattattttctggctctaaaagcaatggccattcacttagaaaatgtagaaaagatagaaaagcacaaaaatttaataattataccacccaaagactataactgtaaacttttaaatatgactttctgatctttttctatgtgtagatatatgtactttcaaaactcaggacaatagtgcacataatactgaatattctgttttactcaactaatgacatataatgaatccaagagaaatttttcttctctaatttaattttaatatttgtatattattttcttttatgattgtagtttatgttccctattattggatatttggaggtattttgattttctcatattataaataatgccagaagaatattatagtgtatatattttacacatatttagttggcttcttagaatatgtctttacaagtggagtttgatcaaaagatgtgaaaatactaaaagatttgtatgcatatttacacacttttagcttgtattcaaaatgagacttaactggtgtttaaaataaaaatgctctgttgacaaattcgcataagcacttacagcagtttttctcgtccatgtaatcagggcagtctgggaacccatcgcagatcactgtgtgcttcaaacattgtttattggatggacattcccaaagatctctctctttacaacctagagacagaagaaaaggttatttgcaatagacgtggaattgaaaataatgataaattcaatcaatgtagaaaaattacgctataaaggcatgatgttggcagggcgcagtggctcatgcctgtaatcccagcactttgggaggctgaggtgggcggatcacaaggaatcacttgaacccgggaggcggaggttgcagtgagccaagatcacaccactgcactatagtctgggcaacagagcgagactttgtctcaaaaaaaaaaaaaaggcataatgtcttttttcttaaaaagttttgacctctgcataccatgaataatataattttgaaagtagaaataaccaataatattcatattgtgatataaattgtacagctctcctaacagaagatcaaaggtgacatatggggccaggcacagtgactcacgcctgtaatcccagcactttgggaggctgaggtgggcagatcacttgagctcaggagttggagaccagcctggccaagatggtgaaaccccatctctactaaaaaatacaaaaaacagcaaggtagtgcgtgcctgtaatcccagctacttgggaggctaaggcaggagaatcatttgaactcaggaggtggaggttgcagtaagccgagattgcacaactgcactccagcctgggtgacagaacaagactctgccttttaaaaccatataattaataactgaatcaggattagaaccctagtcacttttctcatgtattttctattcttttcttttttgagaccaagtctcactctgtcgcccaggctggaatgaagtggcacgttcttggctcaccgcaacctccacctgtctcaaaaaaaaaaaaaaaaaaaaaagtgacataggggacatggagaaaaaaatttaaaagcatacattaacattcatctttaactgttcccttttctttctgagtgaaattgctgtcaatgcataagacttatctataaaataatgttatgcttttaagcaaatatgccaaagtctagtgatctaaatgcatatcaccttaaaatgtaatttcattctacaaatcaggaggccatctgtttttttagcaaaagaggctccttctatgccaaacaaaactagtttaagagccaggtgcaaaagctattactttatggtagtcagagatctaaagttggaaacttcatcaattaataagagaaatgaatataatttgtacaacattaatgtaataacttgaactgtaatttgcctatgaaatagcaagcacttgtgatgtatttaataaatgccattgatgattcatgtgcagtgcatttcatatgcctgctaaagtttgacaagagtctaatatgtttatgtcattccggtcagatccctggccccggccaggccgtgaagtacatgaaggaagagactacatggcaaaaaaaatttgagtaccttccacccccttggctagaacaatggctagcatgtagcaggccctcaacatgtgtgtgttttaagtagaacttcatttcatgtaaggaacaaaatgtctctggctctcaggaaaatataatttattttaaggtcagtgaaatgcaaagcagtgatcaaataagaagtttcttaaacaatgttattgttcatctaacctactacaaataagtcgaataaattatgtagatgattgactcaggtttcttggaatccattatgagaaaaaaaattggttttcaaacttttcattaaaaacaattataaaaataagtgacccaaaatgcttactataagctaaaattagatttagtgtgtttcatcatccaaagatataggaaataaatagtgagagtctttcactggctgataatccgggggggtcttaggcccagggacatccattccaagaactcacagggacattatttagagttttcagctagtagaggatccagacagcatctgaaaagttctgacaataagagtctcttgagatttgagaaagagcctgaagcctgtcctctgtgacccagctcccgccaaatggtacagtctgctcattctaccagagagcaaaagacatcaagaaagaggactcaacactccatgcatggtgctgacccttctccagggctgctcctctgctcacaaaacataccacttgctaatagagaatgaaataaaatagcatgagtttttcctgacgattcccaaggcccattcttcttaagactacaaggaagaacttcgacatttggaatgagatgatgaaataccacagaaatagatcatctgggacagaaggccgcctaaagtgcatcctcacaaataataataataataatgatgataatgagataacatgtattatccactatgtatccacattctagatattagctttaattcttaaaataacactataatgtcagtattatgctcaccattttataagtgaggaaactaacatttagagaaattgaatccctccacatcacagctctacggagaaagatctggatgggatccaggtacaagtcatcagttgcagtcctttgtaagatgcgaacatgaagtatgcgtaaggggtaggagcagtggaagcacagctttagagtcagacaactggatttgaatcctagttccaaatctcactagctgtgtgagcttgggtaagttacttaacttctccaaactttggtttccatacatcttaaatacaaataataatgcctgcttcatagggttgctataaacattaaaggaatactccataagcattcacttttcacctctccatgtcttctcttttctcataaaagtttgcatagcataatacctcctttgtggagttacagtgagcacaaaagaagtaggataaaaagagagagatattagttacatgggagatagtattattttaagaagaaaccactttctttgtaaagtgacattttggtgcaattatgttttaaatgtatattctaaaaggaaaaggatatgattccatcaaaaattaaaaacaggcatggatgggatgggctgtttaatgcacctgtaggttatgaaaccaaataattgttgatgtcagaataataacctctccagcacagagacaatagcaacaaccaataattgaggatacagtgttccaaaaaagtcaccaactcaccccagtttgccagggatttaattgatttgagcacaaagtgtcccttgttccaaaagatccccatcagtcccaggcagatctggttgactggtcacactaagtgtgctaagcattcatctgggttttttgcttactctatctctcattttcacaaaaactctgtgaaacaggctgccctgacagaggcagtacccccccacccccaaatggaataccttgtttctctataaaaacagttgtcattacaaataaagtcagcaaatcacctcaaagcagatgctttttgttctgtaagaatctcttagctatgcagctatagagtaagtaggtccactcatcctcttgagttgagctgcatgaaatttttaaattctcaccctttggagtggagccgctcacaaggaggaaggagacaaggtaatactgcattattgagctgacaaaggctggaacagtctggatccagccatcctggaccagtgtctgccccaggaagtggctgtggatgtgacctataaggagctgtagcagccagagtacaggcctaacaggtgtgaagagccttctacagcatgcaggatcctggacaacaaagccccttccctcaaagcatggctgcaaagggctctgcctctgcacctgctatagcagctggaacagaggacctgcttcccactgtggtctaggcctgattatcagggcagccataccagcacaggccatccagccaccatccagctggaaagtcgcagcagcctacccaattcctgagtcacttcccactcttagcagtgccattgttatggcatgctcttcacatatgggtggcccagtctcccgtgaaagaggcaggatgaaggaatggatgggactttaaactgcatggctctaatcctaaaaagagagaacatccaacccaaaaccaacactatctccaggaaaagacaccatccatctacctgagtttactatgtgagccagagacctcccccagcccatgctttagcctgacagaccagcccactctcttttgccataaacagctgtcagaaacaagactatgctagacaggactccttccctcaagggagatggctggggcagcctttgaaaggaatcgcctcctgattttccaccaccacagcaggtgagttcccagttattagcttctgaggatgaacagggcatgttataagcattccaagctgtgagagataatgtgggtgttctctgcatcttacccagagaagtaaactgactggccaaacgtcacacagcctctaaggctaagtaaggatgtaaattcaagtctaagtctacgcaggacactctgccattccagcctgccttcccaagacaccacagaagacgatgaaacagttaaccaagtatttaaagggaaggagaaaatttcccccttaacatggaaaattaaaccctactgagtgatgagaaatcaatcctgaaaattcctcctgaaagcacatttgtggatatgccaaagctatggacataatgactctcactcttctgctagctacagagcaaagagtggtctcctccccagacaaagagacacaaaagcatagagactggtagtatttggagtgttaagaaagccagttaagcccttctgtgagataactcatagaaatgctatccaagaatccaaaaagaaaacatgccttttggaaactctttgaaatcaagctgtaaaacccgtaaatatcagagtcagatcttctaatacaacctaaggggattctgacttgaagaaatggctcaggttatatttaaaggttttattttatttaagatcaagaggagaccaaagataggtgaagaactgatttttggtcatctgaagataaacagaaagtcacttaatgacactcagacatttgcattgctgtcaatcttttctccatatgatgtataccattttacttagaatagtgatcaattagtaattttgattctgtgttcatgtaataaaggattttattttgacagtcgatataaagcacctgttgtagctatattttcatgtgactgctccactgggagttgctgcttgcttgcatcacagcccaggtaccacctgctcttgtagctgacccaaatcgtggaggtaaagcctagcaagagataacctcagcctcacacactcaaatctatagagtgatagaacagctgaaacatacaatccctttgttgttttccttagctctcctttctttgatgtcattcttgatcatttattttcccatgtctttccctcatgctccactgcatggctatcaatgcttggaaaatgttacgttgaaaataaactcatttatcaagttgctagttttacaggcagctccatctatatcatgtatgctcaattacttaagcatacagtaattgacatcttaagcatccttaagacaatgcagtacttctgtactgacacagtgcagattctgctcagcattcccctgtctcttagacttccttcccatatcggatttgcacaattcatcccaacacttgctgaaaacttttctagtactgacattttcaactcttgtttacattggcaattacacaatcaaagcagcctcaacagcaaaaatctaccacaagagctggagacatttaagaacagtattactgattgctaaattctaatgcatatattttaaaagtgtatttataagttaagtgctttggttatcatgtttctccattacaaaagtgccaaagaaacaagaagtaatttctcacacaatatttatttcataactgagttaaataagtattgttttgagtggaaactcaataaccttgttagaaattctgagggagctgcagattcatgacaatgaatagttaattgtccaattattcagtaaagctcaaacacttaataacacaacggacagaataagtcagaaaggcaagaagcttggggtgaaacccagctttgctggagctggtgcttgcattaccagatggtgtgcctatgcacatacgaaaacagaaagacaaacagcaaggaggcaaatggaaacagatgacttcctattagtcctctgttgagccttcatcaacctgacttccttatttgatttgaagtggtgtgtcctcccaaatcactgaacaagcccattcaaatgcatgcagaagtatcaaaggggaacgaagtatgtaaagttttctattgttagtcactttggaaaacttctcataaattagtactgctggagcaattaattgaactccaaatgtattatttcttacccacttttaactttccttaactagagctctcaatagtgctgtcaattatttttaatttttgatagagattagacaatatattctattattttgatgtgcctttaattgtgtgattaaaatactggtgaaaaccaattacttaactagaaacctgatattttagggtcgtttaaaccctataccaatatgatagtactttaagtttattttttgcagaatatgttctagaactcagaacttttagtcttggtaaagttgttttgttttgtttttaactaagcttttgtatttctcaaatatttagtcccctacaacaaatttaggtctagccaccccaacaaagtatcatgcaacctctttgaaccatctaagataatctattttaaattgcatctcaaataccatgacccatcaaagtcatagttcagtgaacaaatctaatacattctcaataaatcacttatataaggtatattcaatgaattttgatttatttctttacaaaacaaaaaaccacaaacaagcaaacaacagtagcttctaaaaacactgtacattcctccataacaaaattaccccagacattgtaccatcattctgacagctgaagttttccagaagatgcattagtccatatttataggagctgacaggatttcagttgattgcttgtgacatttttgtctagatcagaagggcaatgtttaccacctaaaattcacttaatggagcaacgcaatatttcatacttcaaaggccaaaagaatgaaattatttcaaaagatgtactgccttacgtgcttgtcatgaaagtgtcaattcttcttaaacaggaaaggctaaataatcataaccaaacaattctgtggatagatcttcaatcattttgctttcctcaaaaacactgtttattaaagaccattgtctgacttctattccctaatacattgtggttacaagtacaaagatttgcagggaaatataatgacaactaagtccactcaaattaccattggcatttatggcttttccactggcgattttggaactcaatggcagaaatgtcaagaagagttttatcctttgccgaaagagaaaaaatatgagaggacatgaaaatgaatcccaattagactgggaatgatggagtctgaactctgaatgttggagtatgaactctgccttcatgcatctagatgtctatttagcaacatgggaagcatacgcaaagacactattattctggctttaaaactgataacaatggctttataatttaataataaaaataattctttacatttgtgaggtgcttctccttttaataagtgtttgcaaatatagtagtgcccctccacccttatctgaagtttcagtttccacagtttcagttatccctggttaagcatggtccaaaaatgttggcacaatacaataagatattttgagacagagagagagaaaccgcattctcattacttttctttcagtacattgttataattgatccattttattattgttgttaatctctcattgtgcctaatttataaattaaactctatcataggtacatatgtgtaggaaaaagcatagtactgcatatatggggttccatacaatctatggtttcaggtatccactgggggtcctggaacatatccctacggataagggggaggggtactgtatgtatcagggttatatagaagtgcaatttagaggaaatcaagagtcaggaaaaacacttaaaatatatgccatactgttcaataatttaagaagtaaagacattagcattgaatcctagtcctactatcagtgaatagtttccatttttaacacagtttcttattttattctagttatcactgtacattcaagaaaagtaccattgcacatacataccacagttttcctcatcactgtcatcgtcacagtcggcctggccatcacatcttctggaagccagaacacactgtcctgagcggcacttgaaatgactaggtgagcattctattaaaaacaatattactgttaaagggctgaaaacccagaaacatcagctaatttatgtatttacatgtaggatgttgtcaaggagcttttactgaagataagggtggtctcttgcaaaacgaaatagccattttgctttggcattcttctgcctgccaatcagcatctttctccttcattcttggcctcatccctctagatacgcggtttaacatctatgtattccaatgattaattttctttccaaatgggacaacccaacaattgccagagcctgatatgccttgtgcagtcagtgctcctgactacctagcggctctcaatgtgtcaaaatcattttcacatccccatctttccacctagtccacaattccatttctgtacttaatgatcctatgttgccatggtccccaaatgttttttacttgaaggaaccaaggtttgatgttcacctttgccttcaggatcactagtataaaagcatccatacataatgggctctgtgagtaaagtacagtttaaaaaacacctggagtactaattaaactcatctctgagttcattatttttaattttaaaatgattttttggggggaagatggagcaagatggccaaatagaagcctccactaattgtcctttctgcaggaacaccaacctgaacagcatccacacaaaaaagcaccttcataagaactaaaaatcatataagcaatcatagtacctggttttaaattcagatcactgaaaaaggcactgacaagggtaggaaagacagtcttgaatcaccaacaccacccctcccccattccccagcaagagctgcatagcacagagaatctgtgcacttgtggagtgattgtgggactttgcattggaactcagtgctgtcctatcacagcagaaagcaacaccaggcagagctcagccagtgcccatgcatggagggagcatttagatgaaccccagccaaaggggaatcacccatcccagtggtcagaatttaagttctggcaagccttaccaccacaggctaaagtgttttggggtccttaataaacttgaaaggcagtctagctcacaaggactgcaattcttgggcaagtcctgatgctgtgctgggcttggagacagtggacttgggggcatgcaacctagtgcatgccgcagagtggccaagagagtgcttgtgccaccccttccccaaccccaggcaggcacagctcacagctcagaaagagactcctttcttctgcttgaggacaggagaggggagagtaaagaggattttgtcttgcaacttggatatcagcttagccacagtagaatagggcaccagacagagtcctgtcctaaggcccccattccaggccctagcttccagacatttctagacatatcttcaaccaaaagggaacccactgccttgaagaaaagggcccagccctggcagcattagttaccagctgactaaagagcccttgggccctgaataatcagtagcagtactcaggcagtacttctcatgagccttcggtgagactctgagatgggctggcttcaggtgtaactcagcacattcccagctgtgatggctacagggagaaactcctgcttgagaacaggagagggaagagtaaaagggattttgtcttgcagcttaggtaccaggcttggccacagcggggtagaacatcaagtgaattcttggggtctctaattctaagccctggctcttggatgacatttctggatgtgccctgagtcagaggggagccccctgtcctgaagtgagagtcccaggcctggcagcattcaccacagactgactgaagaacccttgggccttgagtgaacacttgtggtttggtagtacttgtcatagacctggggtggtagtgatcatgaggaaaaaccactagcactcttccattacctctctgtggaaagaggaagagtgagaagaactttgacttgtggcttgggcgccaatactgcagaaattcaaaggatcatcagagtctactatgagcaactatataccaataaattggaaagcctatgagagatgaatatattcttagaaatatacaacctactaagattgaaccataaagaaatccaaaatctgaacagaacaataacaagtaatgctatttaagtaatacttaaaagtctttcagcagaaaaaaaaaaaaaaaagcctggtgcccagtggtttcactgctgaactttgccaaatatttaaagaagaactagtaccaattctgctcaaactactccaaacaatagaggaggaaggaatacatccaaattcattctacaaagccagtattaccctgaaaccaaagctagacaaagacacatcaaaaaaaagaaaactacacaccaatttccttgatgaacattgacataaaagtcctcaagaaaataccagcaaactgaattcaacaacacattaaaaggtcattcatcatgaccatttaggattttttttttttttttttttgagatggagtttctcccttgtcgcccaggctggagtgcaatggcatgatcttggctcactgcagcctccacttcccaggttcgagtgattctcatgcctcagccttccaagtagctgggattacaggcgcctgccaccatgcccagctaatttttatatttttagtagagacaggttttcaccatgttggcaaggctggtcttgaactcccaacctcaggtgatccacccacctcagcctcccaaagtcctggcaagacaggcatgagccaccgctcccggtgaccatttaggatttacaggagtgatgtaacatatgcaaatcaatcaatgtgatacatcataacaacagaatgaaggacaaaaatcatatgatcatttcagttgatgcatttgataaaattcaacatcccttcctgaaaaaaaatccctcaaaaaactgggtaagaaggaacatagctcagcaaaataaaagccatatttcacagacccacagttagtatcaaactaaatggggaaaaactgaaagccttatctccaagatctggaacatgacaaggatacccactctcaccactgttattcaacatagtgatagaagtcctagctgaagcagtcataaaagagaaagaaataaaggccatccaaattggaaatgaagaagtcaaattattcttgattgcaaatgatatgatcttatgtttggaaaaacttaaaaactccgccaaaaagctacagaactgataaacaaattcagtaaagttgcaagatacaaaatcaacatacaaaaattagtagcatttctatatgccaacaacaaaaaatgtgaaagagaaaccaagaaagtaacctcatttacaaaagccacaaataaaataaaatacctggaaattaacttaatcaaagaaatgaaaggtctctgtgatgaaaaccataaaacactgatgaaacaaattaaagaggatataaagaatggaaagataatccatgttcatggattggaagaatcaatattgttaaactttccatattatgtgtattaggccattcttgcactgctataaagaaatacctgataccagccaggcgtggtggctcatgcctgtaatcccagcactttgggaggccaaggtgggtggatcatgaggtcaggagatcaagaccatcctggctaacacagtaaaaccccatctctactaaaaatacaaaaaaaattagccaggcatgatggcgagcacctatagtcccagctactcgggaggctgaggcaggagaatggcgagaacccatgaggtggagcttgcagtgagcggagatcacgccactgcactccagcctgggcgacagagcgaaactccgtctccaaaaaaaaaaaaaaaaaagaaaaagaaatacctgatagtgcataatttataaagaggtttatttggctcatggttctgcaggctttaaaggaggcctagagtctgcttggtttctagggaggcctcacgaagcttacaatcatggcagaaggtgaagggggagcaggcacgtcacatggcaaaagcaggaacaagagagagagagagttggaaggaggcaccatgaccagatctcctgtgaactcagagtgagagatggttcaagccatttatgaaggatctgcccccataatccaaacacctcccaccagaccccacctccaacactaggattacatctcaacatgagatttgggtggggaaaaatatccaaactacctcattctgctctgccccttcccaaatctcatgtctttctcacatttcaaaatacaatatctcttctcagttgctcccccaaagtcttcactaattccagcattaactcaaaagtcccaagtcccaaattcaaagccttatcccaaatccaaataagttccttctacctatgagcctgtaaaatcaaaagaaggtatttacttccaagatacaatggctgtacaggcattgggtaaacattcttatttcaaaagggagaaattggctaaaagaaagaggctacaggccccatgcaagcccaaaacccagcagggcagtcattaaatcttaaagctccaaaataatctccttggactccatatcctgcatacagggcacactggtacaggggtgggctcctaaggccttgggcagctctgcccctgtggctttccagggttcagtccccatggctactttcacaggttgttgagtgccaacagcttttccaggcaaagggtgcaagctgccagtggatctaccattctggagtctggagggcagaagcctacttcccacagctccatgaaacagtgacccattggggactctgtgtgggggctccagccccacgtttcccctctgcactgctctgacagatgttctctgagccatggctaaaggtagagcagcctggatgcagggagcagtgtcctaaggctgcaaagggcagtggggacctgggcctggcccataaaaccattcagtcctcctaggccttagggtctgtgatgggaggggctgcctgggagatctctgaaatgccttcaaggcatttttcccattgtcttagctctttgctcccttttggttatacaaatttctccagcaattcagcctgcttgaattcctctactgaaaaagctttttgtttctttaccacataggtaggctgcaaattttccacacttttatgctctgcttcccttttaactataagttccaacttcaagttatttctttgctcctgtatctgagcacaggctgttagacgcagccaggctatctcttgaacactttgttgcttagaaatttctttcatcagataccctaaattttcactctgaagttccaacttcaacagatccttagggcataaacagaatgcagccaaactcttttctaacacaagatatgggtgaacctttcccccggttcccaattagttccacatttccatctgagatctcatcagcctggccttcactatccatatcactatcggaattttgggtcacaatcacttaaccaatttttaagaagttccaaactttccctcatcttcctgtcttcttctgagctctccaaactcttccaacccctgcctgttacccggttccaaagttgcttccacattttcaggtatctttatagcaatgctgaacatctagtaccaattttctgtgtcaggctgttcttgtgttgctataaagaaatatctgagactgggtaatttataaagaaaagaggtttaattgactcatggttctgcagcctttacaggaaccatggtgaagacatctgctcagcttctatgaaggccccaagaagcttacagtcacagtgaaaagcaaaagggaagtaggcacatcacatggtaaaggagcaagagagagagtaggggaagagatgctacagcacttttaaatgaccagatgtcatgtgaacgcagagcaagagctcacttgtcatcaaggagatgacccaaaccaatcacaagggatctgcccccatgatccaaacacctcccatcaggccccaactccaacactggggattacatctcaacatgagatctgagcagggacaaatatccaaactatatcactatgtaaagcaatctatagattaaatataatcccaatgacattcttcacagaaatgggaaaaaagtcctaaaattcatatggaatcacaaaagactcagaacagccaaagctatcccgagcaaaaagaactagaggaatcacattacctgacttcaaattacactacagagctataatagcaaaaacagaatggtaccagcataaaaacagacacataggctaagggaacagaaaactgagaaaagaactcatacatctacagtgaactcattttcagcaaaggtttcaagaacacacactggggaaaggacagtctcttcagtgaatggtgctgagaaaactggatattcatatgcagaagaatgaaattagacccctatctctcaccacatacaaaaatcaaatcaaaatgaataaagacttaaacctatgacttcaaactatgaaactactagaagaaaacattggggaaactttccagtacactggactgcacaaagatttcttatgtaatatcacaggaacacagacaaccaaagcaaaaatggacaaatgcgattacataaagttaaaaagcttctgcaaagcaaaggaaagtgaagagacaactcacagaatgggagaaaatatttgcaaaatatccatatgataagggattaataaccagaatatataaaatgctcaaacaactctatacaaaaataactaataatctgatttaaaaatggacaaaagagctgaataaacatatctcaaaagaagacatacgaatgacaaacaggtatatgaaaaggtgctcaacatcactgactatcagataaatgcaaatcaaaactacaatgaggtatcatctcacccaaattaaaatgtcttatatccaaaagacagacaataacaaatgctagcaaggatgtggagaaaaggggatcctcacccactattggtgagaatgcaaattggtacaaccactagggagaacaatttagaggcttctcaaaaaactaaaagtagacctaatacatgacccagcaatcccactgctaggtatatacctaaaagaaaggaaaccagtatatagaagagatatctgcactcccatgcttgttgcagcactattcacaatagccaagatttggaagcaacctaagtgtccatcaaaagatgaatggttaaagaaaatgtggtacatatatgcaatggattattattcagccttaaaaaagaatgagatcctgtcgtttgcaacaacaaggataaaagaagacgtcattatgttacctgaaataagccaggcacagaaatacaaacttcttatgttctcacttatttgtgggagctgaaaattaacacaattgaagtcatggtgatagaaagtagaccaatggttgccagtgtctgcgaagggtagtggtgggggaaagcagggttggttaattggtacagaaatatagttagatagaatgaataagatctagtatttgatagcacaacagagtgactacagtcaacaataatttattgtacatttaaagataactaaaggagtataactggattgtttgtaacataaagaaaggataaatgcttggggtgatggatatctcatctacttgatgtgattattatgcactgtatgcctgtatcaaaatattttaggtaccccatacatatatacacctatgtacccacaaaaataaaagaatagaaatagaaaatgacttctttatttttaaaatgaatgcaatatctaacagatgagtgccaaattcttcaatgcaatcaagttcacaaattcactcacctaagcagcctgattggaaactaaatagaaaacaaacaaacaagaagccataaatagaagaaattcaaaaggtagctaacatgttcatccatgttagataccctgctgtaattaattttaaaattaaccttccacatattcatcaggcatcaggcaggtttgattgtctgaattttcctctggaaattgactgcaatctgtgtcttcaggccactgtaggcccacaatcccaagaacagactcacagcgttctttagagtgttcacacaatgccctagatgaacaagaaagacaaaacattagaagcagaaatagctccatctgagacagatgtcataaatttatgtcaagttttaattctgtgtatgtggcatgtattgtgggtgtgtggatataaaagatgcacatatatatgataggtatttgggaaaccaaaatgagtaatatctctgcaaagagtatacattccagcaccacactttcaccaaaagaaactttattgcagaaataggtctaaagatgtttccaggacacagattcccttctctacactgcctttctcattctgtcttctgtctttgaaggagacatattctccaaccttttgttccaaacagggaagtctccaacatcactttggatagtttgccaccaaagtcattgaatctatacaacaccctcatcctcagagatctccccctctgcagaccagccttgtgagccatctcatgtgccaccttagcttgcctaaggcatgcctcccttacttcagcttccatcaatattggtgaaaagcttaggactccttccaaacccacttacgttgagctcgagttggttaaaatgtttggtttttgttttaaagaaatgatatattattgtatcaggtgctttcgtgcgtattatgtcttttgtctccagaatatttttaagttaaagtatcagcgtgcctcacagaagatttctttacttctttttttacttcttatggaaaaaaatatgatttttgtctcaatatattactaagaaattagttacacagttaaaaaaaaaactaaccaaagtaagttcctaggccaatatactcttaatggactcaaataaactcttacttatcaaaagtttcaaattttatacactaattcaactaagttctcatttttaagataaaatgggagacagatcttccagaaaggccagctccagtcttgcccaaaactggtagagaaagtgtaacaatcaaatgaggaaatttcggagaaagttctgtctaggtttaagtctggacaaagctcagcataactcaacactggcttagcccaggaatttgtggtaaagataaagccatggtatttctatattaggtcaggaaagatggaaagttcaatagttgataactgtctgttgaactaactagttttgttgcagatttataaaaaatgtatataactcaattgcaactgctattttaaattagtcatatgatacttatttgtacaaaagactatatagtgcctgactctaccacttccaatttttttctgtaaaatggaaattacaacaatatgcagcaccacaagtccagggggcgctgttcttatcatagtccttgtagtgttcagccataggtagcacctctgatgatacacacttcaaaaggttattttgagtacgctacagcataacaatcctcaagtatttagcccattgtaaggactcgatgttagatttttcagtctcatagctaaaaaattcaatgttaaaattaataaacacacctagcaaaagcaactatgtattgctttatgaacttattagcatattattcaaaaatttcttataaacaaatatcaaaatataaaattcgtagtgatagacactgaaaatgaaagatgtatgggtaaacctgaaaaaaagaaataaatttatctaaaagaaatttaccaaaattttgattgaacaacacttcaggatcatccttggtcttatgcattttaatatggaacttaagccctgaaattataaattacatctggatataaattcacatttatatttatagcagaaaatgctgcttcagggaaatttttatctacatatgaaaagaaagtcaaatgccagaaattgttaagtactattaaaagaaattattcactatcactgaccttgctttgcaaaagtgaagtaagatttaaaacagctttttaacataaaattggtagatgttttattagagatacttttaaaagtacttagcagaaattttcagatatttttctacacaagctaacatttagttttattctctctattggtataatttgttcagttccccaagtcattttgaaattttattatttcctgtcctgtctctatagatgcccttactttgttatccatttggtattcagcatataatttattgttttctcttctgtccactatagtaatagtactgctttttaaaaaaaactctgcgtgacttctgatcccaacatatggtttctgcagttgctactcgcatttaggccagcacatttgtatacctaccccttgagggaaaacagcactgaagagagtagcaactcacttctgagagtcatcctgtatatgcaaaccctctgactacaatgcctaacacatggcgcagcaaagggacagactgccaagaagctattgtgttcctgtgctatcatcatagctattgtccattcagggttcattacaatgaatcagaagcactttacattcatttgatctcaaaacaatacaacccaacaaccattactatccttattctacatgtaaaggaaccgaggctgagagagactcaggattttgtctaagggctacctagaaactagagaagggtcaagattttaacccaaacatggactctggaacaatactcttgacactagaatatcactcatattcaaagtccaagctacgctcttgaaatagcgcatcttatttcattcaaacaggcagagaaatgtcagcaatgtccatcgctgtccaatctgtgagtctggcactatgtattcttatgtcatatctctaacaagtgctgtcagagtgcagcattgtaaacacatcagtgttgccagaaaaagaggcagatatatcccttttatactatcatacttttttaaaaaaatggctttttaatacaacagaatgaaatacctgtgaatttatttgattaaaacacataaactatcatcaaaggacgttcacagctcccttgtttggtacttcgttaatgaattctgactcaaatattcattttacaacttctacttctttgtctcacttgttaaatataaagtatttgataaatgcagagctccttagggaaatttacgttgtccaaactcaactaagtcttcaccccttggttctctctgaggcaaaataagggactggggtagatcccatcatattacctgcaaggagggatatgctcgcctgtattcacatcacattttggtaccaaaatggtgcaagaaaagaacatgaggtatttataacagttggtttgaacaagtgcagggaaaagagaagactcccagctgatggatgcttccttttgagtcctgtggccaaaataatttggataacttgtactgttgtagggcaaattcatgcagagttccaatgtaattggttcacattgacctaacaaagaaacatacacacaaatatttttaaatttcacatataaaaacaacttctttaagttttacaaacttgaagtctattttattctttctttagagtagctaagactagaatgccagtagtatataacattttttatggatattgaaaataagtaagttgattagtgaagtgccctggcaactaagattcatttctgtatatgtagttgctagcactgtgacaacatcttgctttagaaagtccttcctcattttttcccttggctcaacttatctaaagatgactctctttcatcattccttttattgactccaattcatcttcttcttctgatttacttattactactaaaataggatagccccatcatcttcactgtcactaaactaattaatgaatttgatcaaataggcaagtagataacttctgtctatatgttttattgttgattaatgtgtttaaatataaggctacaagatttcagggcaagaggaggctcagatctgttgaatacttctcactaataagacaaaatccaaaccccttagcttgaagtctgaggctattttatacttcaaccctaggctaacttttcagcttcattgcctgtgattatccaatcaacagtatctctgctgtaataaattctattcccttatgacaccagatattttaagaattgtatgactttatgcaccctgtttgctcctctcttacctcctcttttataacatgctcataattatctccccaaaggtggtcatggttctagctgccagggccatacggcacctgctgcctggattaaccctttcccatcttccccaacaagctaactcctctgtggtctggaagactcagcacaaatacctcttccaggaaaccttcctggccaaccactcttcccattactacttccagaatgagtcttttgtgagtgcaatagcgtcttaggcacatacccaccatatgttcattgcattctgccatattctttatttacttacttgcctcccctacacaatcctgagatttttgtgaaatgagactttatctcttgatcttgaagtctacacctagcacagtgccagaatgaagggaggaaaatgtatcagggactatcctaggcaatgtaaatgtaagagtaatgagaaatattgtctctgccactgaggaactccacaatctcgataggaaaaaggatgcacgcgctggtagctgtagtagaatgtgaacagggtaggatagagtttgcatgaactgaacatttgtgtatctccattcatacgctgaaactctaacctgcaatgtgatagtatttggaggtggggcctttgggaggtgatgaggtttcaatgaggtctagatgagggtggcatttatatgggattaaagtccttataagaaggagaagagactaaagctctcgctctctcagccatgtgaggaaacgcaagagggcaactgtctgcaaaccaggaagcagcctgttaccagagaccaagtctgccagcatcctgatcctgcacttccagccttcagaactgtgagaaataaatgtttgtcatttaagccacccaatccatggcattttattgtagcagcttgaacatactaagacagacatattgaacaaaatgctagagtccaaagggaaaaggtagtgcaagagtgaactgggaagccctctgatatggtctggctgtgtcccacccaaatctcatcttgaattgtagctcccataatccccacttgttgtgggagggagccagtgggagatcactgataatggggcagttttccccatactgttctcatggtagtgaataagtctcacaaaatctgatgattttataaggggtttcacctttcacttggctctcattcttctcttgtctgccaccatgtgagacgtgccttttaccttccaccatgattgtgaggcctccccagtcatgtggaactgtaagtccattaaacctctttcttttgtaaattgcccagtctcaggtatgtctttatcagcagcgtgaaaacagactaacactccttccaatgataaatgtggtttgggcagctttgggggaatacagcagagaggctcccagctccctctctctgtttgcagtagatatgccacattccctgtgtggagaggcaggcaagcaagtgtcctggtaaaattcgcccaggcagaccaaagactccatgccttattgagagtgattattcaaattaaatttaattatttgactaagaagtggtatccatgcaaatagatttgcaataaggactgggctgaaatattaaaacatctccaggactacttcttaattgaaagaatccgaggatatcacagatattatatttataaggaggctgatgttggcctgattaaaaaaaaatgatgcatgaagtgcaatatgactctcagtttgctgaagaagacacaacactgaaaggctggcataatcttgaggatgagtcagagtggagagaagactagacggaagaggtttggggttggtcggttcagtttatcctttcctgtgatttgtgaaggaggggttggacattatggactaaatgtttgtgttcccccaaaattcatatgttgaaatcctaacctccaatgtggtggtattaggaggtggaggctttgggaggtgattgagttataagggtacagcccccaagaatgggattagtgcccttataaaagggaccacacagatctctctcgctctcttttcacagtgtgagaatacagtgaaaagtcagccatctgcagcccagagagggtcctcaccagaacctgaccatgatggcaacctcatctcagatttccagcttccagaactgtgagaaataaatgtatgttgtttataagcaataatgatttgttatagcagtctgaactaagacaagaagtaacatttaaatattttgttacaagatttaaaaatgcatgtttttcataacaataaaaacactacaaagatgcagaaagaaaaagttcaacatctctccactcccctttctgttaccttccctgcaagccaacagaaggctttgaatgcttccatgcctttccccgctcacatttatccatacatgcctttgcacacttagacagggatttctgtttgcttttgccaaagcagaagcataccattcctatcacccttcaatttgcttttgttgcttatttgtcatgaccatcttacaagtcagcacatgcagctctaactctatgcttttttcctgatatctttaatatacttaaaattttacacaattggttcacttacagatatttctgatgcagtcctttctttccttgtgcataccctccgtttctttctttctaccaccccatcaaggttcaactttttattgatgtatttcactgaagatgattaacagaacatatcgcatgaataatttttctcttttttacatgtggagaatgtatcacttttgatttgggttaagacataacttttaagtgtttaggagccaaggaaaaggaaaggattaagtaatgatcatatattattctgtagatctttattgaattcggtaaggtttattggatcttgagttttattcctttaaaggcattcttcacagaatgctaagcaagataaactctcaaaatacctgtcaaccccaaattctatgatttatgatatcaataagcttttttatcttaagcattaggctcatgtgtgatcctgatttaaaaatcgccactagagggagatcgcatcacaaacgtgaggatattttagggctgcagaactgtgcttccgatataagtttgatgtagtacccagtacagtgtcccgaacacagatgaggtttaataaagatctgtcaaagaaaaaaatcctgatggaatctcaatggtattccacctttcaaagtctgtaacaagattcgttcaattcaacctaaagatgggatcgttaactcaatggtgttatatcgttatgatgtgatactctgaagttactagaaatcatgtattaagcgatggtcatttacatgaaaaatgtgacttttctacatctagctgcgtatataataatattcaaaaattcatctttgcctcaaactctaaatccctctttaacattattatttttaatagtttgatattattttaaggtgaacatccttataactacctcccaggtcaagaaactgaactcaggcagacaccgcagaaaccttccatatatcttgtcttatctcaactgtctcacttccttgctcttctatatatatatatatatgcttttttttttttttgtgacagagtctcgctctgtcacccaggctggagtgcagtggcacgatctgggctcactgcaagctctgcctcctgggttcgcaccattctcctgcctcagcttcccgagtagctgggactacaggtgcccaccaccacgtccagctaatttttttgtatttttagtagagatggggtttcaccatgttagccaggatggtctcaatttcctgaccttgtgatctgcccgcctcggcctcccaaagtgctgggattacaggcgtgagccaccgcacccggcttctttataattttattacctaagtgtgtaccacccctggatattgtaatttaggcttgcccattttttgaaacttgtcctgtcttttaagtctctcgtagtctttgggttcctcctccattcttttgtttttctttataatttaactatagaagaacccagacatttgacttgtagggtataccagcttttgaatcttgcttatcgcacactcctggtgaagttaaacacgttccccattctttctatttctgaacctcggcagctgaatcaacaagagtgggctgggcttcattccattcacaagactagaagtggctaagctgttctttcaccagaagccacatcattctgatttccctctttttgtgatgttagcagctgtagatgctccatgtcttcattcattaattcaacgtgttaccaaatggtaatattgtattcaatctttttttcacttattagaaaatgcacatggaaatgcttttgtaaatacatcattcctctcttctactatttgctcctaaggacagaagtctgtaaccattatagtgattggcttctctaccacatgactacaccgtttactcctaccaactgaagcttgcaaagagagagtaggaaattgctagacccttagggaattattcaaaaagcaaacctgttcatttcttccttggtgttgaataagaggggaaaatgcacgagtaagcgtaaaactaaaggttgacgaacactgtgggaggcttgagagagggcctgggacatgacagccatgcctggatttcacagccatggtcagcatgggcacagggaggcaggagagacatgcccaggagtcgcttttgcaggttctccccattgtctggattgcataccacaagggagaagtgatggattagtccctccacaccggaatgaggagaatagcattcctgctcctaccctcaaaggcaaggacacatctgtattttgcctcccaacatggcacagaaatgttaaagatgctgggttgtgactggacatggcaacacaggctgctaaaagctatttcttgaaaaaactatgtatcataagaaatgtggtttttaggctttttaaaaaagctgtaggcacttctgtgaatttaaaataagcttctccactgaaaaatgcacatgggaatacacaaaccttttcatattctatttcaaagttctcacatacccctgcagcccagtcataaataggcactagagcaatacattctcaaccttggctatacattgaagtcatctgtagaattaaaaaatactgatgactgggtcccacccaatatatctttagcgaccattagaaaatcacataatattttatgggatggcaagaatcagagtcttcaaggacaagaatcccggcaactccagtgagaggctgtctccaccagacagaatatctactacattctccaaactcaaattttcctttggcatcaagcagactaagaaattactgttcatttgtgcctcagaagctaagtaatactagtctcttgatagtggtaaacatcttcaagtaatgaaccatattttcaaatgtatgaaggattttctgagatgccacttgtttgtccttacagagacctaagtatgcatatatcatcttgaagttctttgaaagatcaggaataacatcttgactttcaactgcaagttaggcacatacgccttattttttatttatttatttttttattgagacggaatctcgatctctcacccaggctggagtgcagtggcacggtctcagctcactgcaacctccacctcctggattcatgccattctcctgcctcagcctcttgagtagctgggactacaggcgcccgccaccatgcccggctaatttttttttttgtatttttagtacagactgggtatcaccatgttagccaggatggtctcaatctcctgacctcatgatccacccgcctcggcctcccaaagtgctgggattacaggcgtgagccaccgcgcccggcctatgtgccatttttaataacacaggagtaatgagggcaagtggctagcctagtggcttttactcagaagagagcaggtgcaaacgtttgctgaatatatgtggagagaagttggcaagaatatacatgatgaatgaggaagctggtgacacagtgagacactaggtaaactgagtgtatttaaagagcttaaagagaacaacagtgtagaatatatcagtgggaagatgacaatatgttctcccacactgaaaagtgacttctaagaagctagaagcctgtctcctttctccaccactagaaagcccagcgcccatcccgatgcttggaacatcatgtacacactacaaatattggtcagctctatgagccaagagttatccagttgcctttcctacaatttattcttttgacaggagacaacatattttaaatatttaaaattcgaaatatttcaaatatagagaaaataggataacatacacccagtcacttcctacccaaatttgacacaggctaacattgccttttctacatttttgagtctaatagtaagtgtcattccatgtcaaacaacccccaaaactttaatagtaaacacatgtctttgagatgacactgtcactatttaagttgaaggtgaagtaaggaaatcgctctgaaaaatttccacggcagattgagagacgagtaaaatgaaacaatggaaacagtggcccaaatatgttatacgtgtgtgtgtgtgtgtatatatatacacacatatatacacatatatatgcatatctatagatatgttctatttaaatcagtttctatttaaatcagtttagaggaagtaaaatggcagtttgagtgtgttgactttgtggcttgactaatatctactgttctctcatatgggaaatggaggaggggtgggcatgtgcttccaggcaaagagttattaaatgccacagtcaatcctgtcagtctgggttaattagctgcctgcctacacccccttcccagcctccttttttcacccccttgagactctgtaacagttatagaggtactcactataagctctacagtgacccagaaaaattaggaccgcgaaactgcagcaaatgcaaggccgaagactttcagcatcccagcttccaagggccttagactgagaggacatgtgttaagaagtaataccctggctgggtgcagtggctcgcgcctgtaaggccagtggattacttgaggtcaggagtttgagacctgcctgaccaacatggtgaaacgccatctttaccaaaaaataaataaataaataaataaataaataaataaataaataaataaattagctgggtgtggtggtgtgtgcctataatcccagctacttgggaggctgaggcaggagaatcgcttgaacctgggaggcggaggttgcagtgagccgatatcgtgccactgcactccagcctgggtgacagagccagactctgtctcagaaaaaaaaaaaaaaggaatatcctcttgccaactgaaaactgactgacctgcttttaaatttctaatcccaacctgaaaatgcagcaaaaagttcattagaaaaagtgaaagaagcgagtataacatgaaaacagagcccaggagtcagaaatcattactagaaatcagtcgctggggattttctgattccattttccatgagagtccatagggtgctctttcacttccgcccattctgtcttccccaaataactcctcctcctgaaagtcattttagagccacctgcttacaccgtttggagctgttacactgtcaccgaaacaaattagcctaatggttccgaaaccattacaggtcatcagagttcctggaaaggcgagaataaatttcattaaaagaaccgactgcctataatcccagcactttgggaggcccaggcagatggatcactgagggtgtttagcgcctgtaatcctagctactgtggaggctgaggcagaagaatcacttgaatttggaaggcagaggttgcagtgagccaagatggggccactgcactccagcctcggtgacagagtgagagtgtgtctcaaaaaaaacagaacagattgccaaagttgtatgtggctatttctatgaacttcatatttgcttcttggttaaagtttccatttttgaagctatgctttaaaaaggaagaaagatagcatctgcctacagatggagccaagaaaataatacagagaactaatgctgagttgaaagtaatggtaatgatattaagcaatgtggacttataggcgttcgcaatgacacatttgtttctgattgaagttaattaagaccatttggtttctttactgctaccacatgcgaccttttaaaaagaaaaagaaaataggtaggcttttttggagggattccagacttcagtatttgaatgtcaatgcagaagaaaaatgctgaatgcatgccctgacatggctattgcatttgtcagctgttgtacttactacagttattcagactgttgttcgggtcacagagagagctaccaccacatgaatcaaggcagggattgtagaggcatctttggtctccttcttgacatgaagtctgaactacagagggaggaaaaggcacattggctttcatcatctacaaattccttacctaaggatctaaaagatcaggaatgtctgatggagctgaggaataacacaactttaatttccttccaatttctccaaaagtattgaacgtacgttgaataggtgctttctggattcattttcctggtaattaaatacaatccaggtattccaaaataggaatgaagaaataagagacaaactacactaaaaacaggtggttgttgcatttaatgggaaaaaaatagtgttttctttttacatgggtgccaacacttgattacaaaataaaattcaagagatttgagggacagagaacgttataaaaatcttgaaattctgaatattaagtgacacttttttaagactcatttgctcccaattctagtctccctctaaggaaaatgctttctctagtaataaatagggcatcaacaccaatacaataaggatactttaccataatacaagtgttatgcagctgttatccatattttcaatatgtccttggaaagtgtcatcagcctagctgtgatgacttgagaactgggtttcttgtttctaagtgaatgacagcagtagtatcagtgtttgccctaatgatttttccttaaggtaggtagagaggaaactgcttttccttgattccctggtcatttgtagattaaatggagaaggtaataaattactgcccattcactctctcccccattacgatcaattaccttcaggcatgtcatctggaatctagtcaaccttgcaaggcacttttaagtataaataatagtatgtgtgtatgtataatcattcttacctataattctaagatgatgtttattatactgaaatatttatcctttccagtaccactaatgtgcaaattaatacacaaagccttgcagaaaagagatgtcactctttttttaatgtcagcagggtcaaaattttttctcaaagcaaacctaaacaatttctgtgagtttaggctcttgaggaggttttattgacatcatgcattcattattttggcaaatattaagtgcatgccatgtgacaatctatgtgacaagctaggcactgagcattaaaacataaaagggcataataccccctgggaagtggcttgtgctctgatagaggtatcatcctgaacaaaaccttctgatgctgtgtgatcactgctttatggaagacatatttatttttacttatttattgtttcatagagatgggggtcttgctatattgcccaggctagtctcaaactcctggtctcaagtaattctcctgcctcggccacccaaagtgctgggattacaggcatgtgctaccacgcccagctaaaatacatttaaagagcagtagaagccaatgagaccagtatggggaagtttctcaaaggacttttccaagtcatggtaagaggaaaggatgggtttcccaagccaagaaacagcacatgcaaaggcctagaatagggaagtgcacaggtcaaagtaactggagcttcaaccactgagaaaggggctgagagaggctagacagataggcagggacagagcctgaagagtttcaaaggcctgactcttcagcaagacccaaagtctccagagaagtggcccctgcttccctttccagctctgtctagcagaacaaacctgcaacccatgctgacaattatgtagtatttagtaccaggccccctttcgttctcagctctctaatcacaatggtctgccttctctcatggtcctcctacacatgccttgcaccttcccaccacaggaattttggtcaagcggtgccttgtgtctcaattgctttttcaagccccgttctttttggttaaccccactcatccttcaggtctgagctccagtatctcttcctcagggaagctttgtctgaggcgctttaccagggcatgcaccctattaagggcatccaagcaccctgaatttcccttcttagcctctgttgctgcatggttaagcattgacttgcctaataattcgtagcatgcctatgtcccccaggagtctgcaagctccatcagcggttttgcttaccactgaattcccaggggatggccacatataaacaccacaatatacattttttgagttgaatccattaaagtgaacaatataaaaatactaaaattttacttttaaatctgttttatcatatgactttcttacatctcacacatgtaaggaaataatctacaaagcctgccatttcatcatgaaaaatccaaaattatttcagagttgaattatacagaaagaaagaatagtttgatgcaaacggaagtgctcggttgatatgcacacaataaattacgtttaataaaggatttcattctgaatttaaaaactggtaaaacaaagcactctttatatattatttttatgtaataagtctgtgactgaaaagctctccctttaggtcttgggcatttttccattaaagttattctaatgatcaatatgcattacgacaaacctaatttatctataggtgaccagtctcattggctgattatgaatatacacagcccaagatatgctttaatgtagtagccatgtaataaaagctcacatatattgagtttttgccatatgccaacactatgaagtagttatcactattctgagtgtacagacacgcaaactgagacctaaaagggatgtaagtatcttgccaaaagtcaccatatagtaagtagcagaccgaggcttgatcctgggtatcagggctgcaacaatcatgttattaacaactaggctgtgcccgtgtagtataaacaaatgtgatgtttgagtctaggcatattcttccctggaccctactgagaggcttccacacacactggagctgcatagaactttcttttctgacagaaatagttacatttaaaaaacaatttattggatctagtttttctttttgagattcacacgcagatatcaaatccttttaaagtgtattgctcggtaataagaggcattaaactgcttctctgaacatgattattttaggaagacattacatttcctttcagaagccaatttcttctcactggaatctaatctgatttaattggatgctatacactaaacttctctctttatcacggctttccccatcgaacagttaagtgaatctgaccatgctgttcaggtgtctcacctgaggaatgattttcagtgtaagttgcttgagaattatgtttagcacaagaaagtgtttcctggctgactagggctgtgaggaccactatgttaggcaatctgggattatttacatgggaatcctacttaagcaacttcaaatgtgttcctttgttcccaaggagaggaccaccagtaaaggaatgttctggggtggtgggacacacttactgacgctgcagttctcctcatcactcccatccttgcagtcctcgtcaccatcacattgaaacgtgctggggatacattgtccatttctgcattccaccagaccctggctgtgacaggctaggaaggaccataacaatattcactttatttattaattcttctctctcaatctgcacatcaaataagcaacagccatttatcaagcatcgctaagaaacaaggtgttctgcacacacaaatgaacatatcattgattttatttctagaatttttcctgccttattgaacagcacttaccaagattaactttttcttgagaactgtgtgattgtttttagtgatggaagtatcatgatcctacttactaataaaaatgacaatttgtaaagggttcattatatggcaagagctgtgctaactgcattgtatatataatctcaaattctcatataaatcttgtaaagtagatactatcatctttgttttacagatgagaaactaaagtttacagagcatagtacttgctcaaagtcccatggctaagagctacagccagaatgtgaaggcaagctttttggactctcagccccaatatttcattatttatctacttgacctcataagccaacaaaatagtatatgggaaagaacttgcatagtaactaacacataataaacactttatttcaacacttgtttatgacaactgatatttgaaagggatggcctaatatccattaaccttctaattcctatcggttctctaaattctatacctattgtcttttagagtatcggaaacccatggatcatgtgacctcagccttcactgaattactaatattatgacctctctgttcttgagtcaagactccacaccagaagtgttctacctgagcaccatgtccttgcttctccaagatctagtgagatacagtccactctgttccactgtgtccactaggcaaggactcggaggacatcccacttcaaatccatttcagggaagaggagagctacgcattgtgactttttatatgacttttcttatgtcaaaataaaaactatgtaatccacatttctatttttgcctcaaattataagccaattaaatattcaatctcatgtatataatcaactttcttacttttactagacacaaaaagatgaaatgaaaagtataattaattcaaacatgcaaaagaacatatcacattaactctttcaggtcaactgcactctctcttaagacctgacagcttctattcaatcatgtatattattctctaatgggtatagtatattttccagggggaaaaagtgttaatagccatacttgttattagtttgaagtataacaactgtctgaagattttcattcacacagaaacacaacagtttataaatttatattattactacgttctctctttttttttttttaaagatggagtttcaccctgtcacccaggctggagggcaatggcttgatcttgactcagtgtaatctccacctccctggttcatgccagtctcctgcctcagcctcctgagtagctgggactacaggcacctgccaccacacccagctaatttttgtatttttactagagactgttggccaggctggtctcaaactcctgacctcaggtcatctacccatctctgcctcccaaagtgctgggactacaggcgtgagccaccatgcccggcctattatgctctctttgtatcatcatatgaacattaaaggctctcttctctctgacgattctttccatgttcttccacaaatggcccctgaaaacatgttagggcactcctgcagggaagcttaactactcatgtattgtttgcagaagaaaggttccccattctgtgggcagagcatcacctttgacaaagtcacagaagcataaaagagacatatggagcaacgagagagaaaacagacacccacttggctagatcagccaaatgaagcttggagttttgcagggagaggtgtggaagtcagatacactccattgctattgtcatcccatgactcagtgatctttacaggctagaaccaaagcataagaatctttcccttggaatgctgtgtatatagtgagtcttaagtacagtcctcaaccttgagtacagcctaaagaaccagaaatggaaaaataagcaaaacaaacgtcctcagagcactcacagcagttgacctcgtcagacttatccacacagtcgtggtcaccatcacacacccactccatggcgatgcagcgcccgtccccgcagcgatgctctgttgtgggattgcaatctggagaaatgaaaactcacgaggatgcagagaaccagcatgactaacaggcaggattctatggctcccagttcccatcgaagagagtctgttccaatggctccaataccttcaataacatttctacaataggtctggcccaattaaaatgccacgccctccccactcatgtgccccactgaccaccatcactgtggggtaagatgggtctgtttttcagataagtaactactctagctgccccaggacccgtagtttgttcttattgttgttggcttttgttttctttagttgtcattttctttccttatgaaaaatttatgatttctaccctggttcaaaaaacagaactgtgatttgtgtttcacaatgcggctagcggatttgatgtatctgtaacagctctctcacgtttctaggaattataacttacctgtctggcaaattgggaaggcacgtatctccttgtcatctctcctgatgctaagcttaagtttttaattgattatcttttttttgagacaaggtctctctctttctcccaggctggagtgcagtggtgtgatcatagctcactgcagcctcaacctcctaggatcaggtgatcctcccaccccagcctccaagtagttgggactacaaggaatatgccagcatgcctggccttatatccaaaagaactgctaggtaagccatgcaaaatatttatgttatattcatgattctttttagcctggacttcaactttgtcccaatttatatattagtgaaaaagaactaagtgataagttcgctctcacaaagggcagaatccataggatgctttgccatgagaggtggtataccctgaatataagcagtgttttagaagatgtatgtggattcatgaataatagattccatgagaaagtatgatgagtctagtaacagtgccatggtcatagacagacttccggagtgaccatggatcttaaagcatattttggatcaacagaggaaagtatagggaggacataggtttgagaaaagaagaaaagcataagaagtgcttgggcaggaaccagaagagcacagggagccagggcagaggctggtctgaaggaaagtgataattattgctattagatggagacaactggcatccagacacacaaacttcatgatagcctgctatcttcagaggaattctgttgcctgttaagaccattttttctcacatgctacctgcatgctggccctctccactaacctatccaactaccaaacgacactcactcattttcaatcccctgcatttcctaattatctcactggtaaagggaagggttgaatctgatgatctccaaggcctcctgcaactataatttctgtgatctatataattacaatttcctctcatcctttttctcaagactagtcagtcccaggatataacccacatctaaatgtaaattagtatagtcattatggaaaacaatatggaggttcttgagaaaactacaaatagaacttccatataacccagcaatcccactactgggcatatacccaaaggaaaggaaatcagtatatcaaacagacatctgcacccccacattcactgcagcactactcacaataaccatgatatggaatcaatttatgccatcaaaaaatgagtggagaagaaaatatggtacatctacacaatggaatactattcagccacgccaaaagaataaaatcctgttatttgtagcaacatggatgagcctggaggacattctgtttagtgaaataagccaggcatagaaacagaaataccacatgccctcactcatatgcagagttgatctcatggaaatagagagtagaacagtggttactagaggccagaagggtatggaggaggagggacaaagagagattgctgccaggtgcggtggctcatgcctgtaatcccagcactttgggaggccgaggcaggcaaatcatgagctcaggagttagagaccagcctgaccaacatgaagaaaccccatctctactaaaaatacaaaaattagctgagcgtggtggcacacacctgtagtcccaagtactcaggaggctgaggcaggagaatcacttgagcccgggaggcggagattgcagtgagccgggatagcgccactgcactccagcctgggtgatggagcaagactccatctcaaaaaaaaaaaaaaaaaaaaaagagagagagagacagagattgtttaactgatacaaaattacagctagataggaggaacaagttgtaggtttttatagcactggatggtgactatagttaatgataatttattgcatattttcaaataactaaatgagaagattctgaatgttcctaatacaaagaaatgataaatgtttgaggtgatggatacactaattaccctgatttgatcattacatattgtatacatgtattaaaatatcatgctgtattcaataaatatgtacaactattattagtcaaaataaaataaaaataaactattatcagaaaaaagcaataacccacctctatctagtcacacaggaatggtttgtacacatacattttaaaatatttttacagatacagcaagtggcagctagacagcgctcctagaaaccaccaggtttcccagcatggggttattcctaacattcatgattccaatgccttcctctgaccataccgctgatccttcccaaacattcattttgatgttatctaatgcaggacattgtctgatatcatttgtccagggtgtatcctcatcccagtttgcccttttgttcatgttgcaaagttcctacgtcactcaataatatgctacctaaaaattctgaagctagtcacaaagccaaaaaagtaaatgagcaagaggaattttgctgattttaattcatgagatggcattcagaattggacatgactctttaaaaagtggggttattctttaaaagataagatcaccatgtgtacacaaaacaaatgcatcatcctaaccctgggtgtagctgctgaacaggtggtccctgtactatttgaggattaaataaaggaggggacttcagtcacatgtaccaagggaatcaggcacagacaatatatctgccctcaaagtttgctcaaaagcccaaatctaacgtaagccactggctctaaccagaggagaaacagaacacatttgaggagaggaaaaaaaactattaatgcattaacaacctttaccagtcttcccatcccacttcttaaacattttcttaatatgattttttaggtattacatttacacataagacattactgaggacagtgactgaacaaacttcctccttctaaaaaacaagaaaccaatcattttgtaatttaaactgctaatcatattaacacataatgaactgtaagtttttggttataaatttctatgattttaaattaaaacctttggggaaacaatgctacttaccacagttttgctcatcactcaaatccccacagtcatcatatccatcacacacaaggctgtaattaaggcacttgcctgtgtgacagtgaaacagattctcgctgcagtctgcaaataaaagaagccaccagtgtgtcatcagagccatacagaatgctattgtagtacgatatttaacaaaagccaatcatggaagggacaccctaatggtaacctggtccacacctattgttttataggtgagaaggtggcacacagagatacaacgacctgttcaaggccacttgaacagtggctcccaagccaagtgattttatcactttctgatgtgtttctctgacttctattttatgtcacctgaacgatccttgattgttaaagatgagaaaagacattctcagttcaccatcattcctaatgaagttcttgttcatgcagaatagactttagtaactcttatgttttctttagagttgaagtctaggtttgtcagtagaaagcataaacataacaaataaaataagtcatttagattatggagttattatttcctttcacataaacattactgcttaagtcaattgagtgtttcataatgcaatcctcaaataagcaagtactgtccaaagactatggtggcaagatgagaagtgctatgtaatctcaggatgcttatagtttaatgttgaaataaacaacatccagggcaaatggtttcctgattttaataggaaaataaagtcttgtccttgggtaaaccagaactcctatcctggttctgccatctactagctgtgggacttttagtgtgttattgttagttcaagtctaggagtctgtgaactgatgtatgaaattgggacaaaatcagccacttaatagggtttgaaagaagagtttaatgaaatagtgtgtgtaaggcaattcaatggaaagagaatgttcttttcaacaaacggtattgggacaatactagaataatatttgcaaattatatgtatgataaagaaatttggatatccagagtctctatagaactcttacattcaataatcagacgaaaaagaattcaattataaatggtcaaaagacttgaatagaaagtcttcatgaaagacataaaaacacatgaaaaggtgctcaacgttattagtcattaagcaaaggcagcgggaggtgagagggcaggacaaaacaaaagaaaaaaaaataagctaaggcaaattaaaaccacaagaagatataactacacatcccttaaaatggctacaatggaaaagatggataatagcaagtattggcaaggattttgagaaaatgaatctcatggatctctggtgagactaaaataataatgccaccttggaaaactggcagtttcttatgaaggtaactgcaaccttaccatacaattaatttgtgaattccactcttaggaatctacccaagataaattaaacatatatccacatgaagatttatatatagatgttcacagcagcattattcataagccaaacactggaaaaaaatccaactactcactaactggaatggacaaacaaaacgtaatactcatgcagtgaaatactactcggtgattaaaaggatgaaactaccaatatatgtgacagtatggatgaaccccaaaaagttacgctgtgtgaaagaaatcagatacaaaaattacatattatatgactcgtttatggaattcccagaaaaaacaaatttatagaaacagaaatctgagaagtagttacagtagctgagggattagaattggtgactgactacaaatgtgtgggagataaattttgggggagatgcaaacattctagaactgtattgtgcggttagtcgcataactctataagtttactaaaaatcaatagatgaaatttataggatgtaaattatacctcaataaagctgtaaaaatgtttaaaatcaatatatgtaaagaaatctgcattttacagaaactagatttcttaagtatatttttatttcccttatttaaagtaaattaagtgcaaaacagtttgcttaaggctggagaaggaatacagaaaataggcggaatttcaatagggtggatgtaatgaaaagtttagcatatttcaagcagatgaaatagcaagaacaaaggaaagaggcaaaaaaatagggcacgtttgaagatcagtctacttggctgatgaaggccagaaatcaagcagtcagtggttcaatctcctgaattccagctgattgtttctcctcaagcagaagcctgtatctcatacaagtagcagccaccactttactgtaaacatcccatactagatgacgattcgttatccaaagcctttggcattgatcagttaaaacattaggcttgccaaaatatgacacttacatatacatgaatcataaattactgtttcaaaaaagcactcttctaaaaaaaaaacaacttaaagtttttagaatcacatcattttaggaatggaatgggccttagaaatcacctgttcagtgtcttcattaggaaggtgtgtatgtgcacagacacacacacgcatatatacacgtaagtccatacttataagcatacagaactttgtaagtactttttatttttcacttcccccagcctgaataattttcaaataaggacagccaccataagggaaaatataagaactaagaagtcctagcgatcaccttgacaacggtattttatcccactcagcagagggcgctatttccccaccctgcacccccactgctgaatgaggctacaacacatgtgacagctgagtggaaaggttatgacactggttcttctgcccacagggtagatctggggaattcgtgcatcaagatatatacactaccttgtgaaattctaaaagatctttttgatgtttttttgtcttaatctaaattactcttgtgggaagttttgagtcaacatgctagaatcagcaatagcccgggaaataaggcttctcaacttgacgatcagtgcaaagtatacgcatgcattcgcccagaggatgggggacagtgtttcagcacaatttaaaccctaggagttaatttctttgtaagcactacactcactttttttgacagtaggactactagggaatcaaatacccctttcagaatctgattaacctaagaacacaccaaaaatttccaaaagtttatttgtcttctatgaggcccattctaggacccctggtaattcatactaaaacactgcattggagatattttaaaaattgatgtcctcatttattaaattactttataaatggagaggattcaggcattttttaaaaatcctcattgttctcccaggtgtggattcaactttctactattataacttgcttggttagaagccatttttagaagtgagatacaaaatgagctgcatttggaaaacaatctgttacttccctaaggtctgtgtgattagtaaacacgcaaaaccttaaccagaggcactgcaaagccagaaatacaaatggcaaatgcaaatacagtagcaaatggcaaagatcacagtgtctccttttactgaaataaatgtttatttgacctggaaagagatgttgtcagtgcaatttggggccagcaaatcaaaatttgaaaaagctgcttgctgtgattttcttgctcaataacaagcataattttgcatggcctaaggtagatgtttttctagacacacctttttttttcttaaggagagcttgatacaaaatgtttcttctgaaattcttgcatgttaatattgatttcagtttggcatctcatacgcacactattaattcttgtctctcaaaattattgttaaattagagcagaaaactaacacacagaaaggctttttctcaaaggcttctttcaactgtacagtctctatgactataaacatgaatgtgttgcctcaactcaagatgcaagtacggatgctcagtttccacccacagaagattaaatatggaaaggaccagaggttatttcatccaatcctctgattctgaaatgaccagaggagttagacggtctgtccactgttgctcagctcatttacagcagaaccatgagaagaaccaggcttcttgactctctgagttctttctactattggcttccagctctagaaaagggtttctcaacggcagtatcatttgacattttggactgggtaattctttgttgttgggggctgccctgtgcagggtagtttgtttagcagcatctctggcctctacccactagatgccagtagcacctccctccactctcacagttgtgacaataaaaaaaagtctccatgcattgcaaaatgtcacctagagaattgaaaatcatgttgcacagtatacaaacatcacctgagtgcaaggcctagctttaatcccatcttttccatcagctgtctacgcaatccagcttctagtaatcttactctttttactagaaggactccctgctgctgcctttttttgtttgcttgtttacctcaatttttttgactttgtgatattgcttgtgttatactgttttaaaataccatatttaggctgggcacagtggttcacgccggtaatcctagcactttgggaagctgtggcaggctgatcactttgagctcaggagtttgagaccagcctgggcaacatggcaaaaccttgtttctacaaaaaatacaaaaatcaggcctggcgtggtggctcacgcctgtagttccagttactcaggaggctgagcctggagaattgcttgagctcgggtagtggaggctgcaatgagctgagatcacacctctgcactccagcctgggtgacagagtgagactccatctcaaaaaaaaattttaaaaaacatatttaatagtttctatgtgtatacgttagttccctgatttgattaaaagactcataaagaaagaaaccatggcttaacagtatctttctatttactaggtagctaaaacatgattcatacatagtaggaattaaagaatattcaatactttgattgattcagtataatcagattgccactatacaaaaaagtaaaatttgcaaacatttagtacttcttccataagcatagagtttttttatttttataattttgatgaaactatttctagcatttacttgcagctacatcttagtagaaagattattatagatacagtcatttttgatgattcaaacatcatttggaatatcaatttttattttgtgctttttaggctgcctccattctaaaatagcttcacgtggtgctgcttttaaaattgttgtgcatattttgtgtttctctcttccttacatgtatcagctgacattatcagctgtccccacgacttccagtggtcattctctgcacctagtaacaagaggtgctgggtgggagtggaggaacaataagataacaacagtgacaacaacagtcacgaccgcaaatcctagtgctttttgagacttactgcatgcaagacattggtctatatgctttatattcagtgaatcattattctgaacaatttgagagatattcactatttattgtttccattgtactactgaagaaactgaggcacagagaggttgagtaacttgcctaagttatcagaggcaggaaatggtaagatcgaaacctaagcagcctgactcaagaatttatagtagtcattactacaccgtattacactcggtgtaattagatagccaccatcctcaaaaataagtcaaccaattttacccaaaattcacagaaaatgattttcaaaaatatttgatagtggtttttatgtgtcataaaatgtgtgaactttgtggcagctatttcactgtgaaaacgttttccttgagtttctaatttaaaattaagaagtattcatctactaagcacttgctatgtcctaggcactattctaggagccagttatagactcaaaagattatagaatcttaacaacaaaagagacaccaagcaccttctagcccggtgcttccaagtctggccgtccattagaattacctggagagcgttacaaaagtactgctgcctggtccccactgcagacaaactgaatcaaaatctctgcagatggggcttcctgaggaggccagcatgcagccatccatgatgatactgaaagccagggttacagaagtggcctgcctaaagccacagaggtagacatttctaaaattttcctggtttttgaaaatttttctactgcaccactaaaattgtttcaggtgtttggaaatcttttcatccaacaaatacttaagaagagattgacaagacaaaaccagttaggggagaaagtcagaaagtcacagatacctggagtgctctttaataaacaattacctctgaaagccgtaatacatcaaaatcagttaaaacattttcctgcaatatgaatgatcagagtataatctcactaaatctgaacttttttatggacaaggacaagtcaaaggcagacgagctgaaagaaaaagcattagattttgaaccatttaagactgggttcaaatttagcgaatcatgggcaaatttattcattgccctaagctctgtctctgcacctgtacaaaaggtggtagataacacttcctatgctgataattaaatcaaagcatgtaggtaaatgcttctagcatagtttatgaggtaactcacaaataataagtcccttttctcccttcctttgaacctgactaaaaaggaaattaataactcaatgaactacacaggccacctaatatgacccatgttttataaaagcaggcaagtgcttagctagagatcatttttgcatctaatccatagaagcataatctcctctgacagtcctccttcttgcctacttgcgagaaccttaggaactaggcattttcttctgttcctcactgagaacgcacagcaaaacttccttctcctctcatgagtatctgtgggttgcattcactctgattcacatccaaggcctaattcagacttacactattccttcaccacagggtggtgacaaaaggagtatggcaccctccataaacactcatgctgaaacaccacaagcattcaaccttaaagctcaaaagcagatgtccttgtaaggtcaaaaacaattgcataagaagccttcaatgtctgtgttttcatacagaagttttctgaagggatgtatttccccaacggaccaaaagatcatttttgtgatatgttcatgggaaagggccatatctattttccttaataaatgcttcagctcctcagacattggcaaatgccttgcaaaacagtaacacgttgttgacaaggaaaattagccccttcaaatttaatgttaacaaatgcagcagaaagcacttacagggtttggagtgcaatgctcagtactattgaggaacatatgataaaaaccatagttggcccaccacaggagatacaggcatatgcagaatttgaacaataccataacttgggccacaatgggagaatagctagagattctaccaaattcccataaattggatatcgttacattgaattatttaaagttccctattttggctgctttgcacagcatcttctgctaagcccacagcaacacttcccagtgtaaatacacagcctacaaaaatgtttttatgtaaaattgtgtgccatgcgttgttttgaaaagaaaattccaagtcgtaaaacacaaatttcttactgaaaagaacgtttcctgaaatatgcgtggcataattgaagttccacgggatgctagatagtaggcagaataaaaaatgcatgaataaatgaataaataaaggtgaagattcacatgagaaataattctgatgaaataaaaagttaggcaaatgtctttttttaaaactacagaatttctcagaacctctaatatacaaatgtgtattctaaccctctaagaagtagacctgatagtatttcccaaagtttttttttttcaagcattattccagactcagatactacatgaaacaccagtttgggaaacactgacctgaaatgttaccatgataaactgccattcagtagttctgccattcagcaggacaaaggagcgtcctagcccatcagatgaaagatgagttggtccatttggcaaacagaccagaagaattttttgattaagatcagtattctcaagcacttattacatcttggcaattcccatgaggagtgaaacacagctcttgccatactaactgtggctgtttatataacccttaaagaacaattagaactcagatgaaagatgagttggtccatttggcaaacagaccagaagaattttttgattaagatcagtattctcaagcacttattacatcttggcaattcccataaggagtgaaacacagctcttgccatactaactgtggctgtttatataacccttaaagaacaattagaactcttgcatgtagtgttctaattggagatacttctgttttgaatacagattactcagtgtaattgttttctttttttaacctactaggggtgaacaaataggacactagctttgtttattacaatgtacttcttcaggatggttttccccttctttccagtttgtaagtgcaaaacaacttgaaatctgaatctatattggacaaaccactggccaattcagtcaaaatgactaatcaatcaatggggaataaattgaggacacataaggctgaatctactgattagtggattttaaacagttagtgccattgactatctccaggtttggaagaagcataaaaaaaaaaacaagaggctttgtatttactgtgtcatgaaagttaagaatcattagggtgaaaatgttgctataaaaatgtccttttttaaaaaaaattgacctttatactcataaacaaaaatgaaaattctcacccaatcaaaataaaccaaagccttctcccaatttaaaccactttgtgcaaaaacgctgcaatccctcatctgttccaatgcagcctctacctgttgagctcctaataaaccatgcctttgaaaggtgtgcaaacatgctgctgtcattctgggggaagataaacacgtttgctcgctttagaaaggcaaacaaaaagcagtctacacaaatgctgatgattgtcaggatttgagaatccctgtccactcagacaaaccctaaacagcttgtcacatactgcaatgagcctcgtcactccagtcgtcacagtcgttgtagccattacattgcagtttcccggggatgcagattccactggcacacagaaagttctcaccccttccacagagcactaaaaaaaaagggcaggaaataatgtcagaataagatgggttttttttcttttaagattacaaaaaataaatacatagaaaatcttcttttgctattcaacagatttgtttccaaattccctcagttttattgtcatcaatttttctttggcatcctagcacattaattgaaaaattacctggaaataatacaaagagtgattgcttgtctgaggaaagcaggagatagttcaccagtgggcttgcagagtgaggcatccatgttcagagagcaagagggtagcttcatcatttgcacaatttatgtggggagaatacccaatgggtgtatctttctaaataattgaaaattatgtccaagtaaagtgctactaattgaaccaacatttaaaaagtctacctttctaaaaagctactctatgtaccacagagaaagttccagtaaaaacagagtcagtaaataaccatttactgtgtgtttgaacatagcatagagacccagtgccctgtatttgaaatgtatttacttgccttaatgaaaatgccagttaaaatgtcagcgtctattttggcataaggaacgggaaatggcattcactaataaaattttcatttatttttccttaacacagtgacatttttatatttttgcttttaatattttggtgttctttttctcttcaaaatgcaataagtattccactgcttcaaaattacagtagacaataaatttaagacaaaaagatacaaaatttttcaggaagaccattaataaaaggataaatcagctcaacaaagtggatgttaagataaaaaatatttggtaatgtgcatcaaatgccttttaagtgtgcataatctttgactcaggaatcatcttatttcttagacttcacaaaaaggaaatcattatgaatttatgttttatgtttaatgatattcataccatcattgtttaaaatgaggaaactatgaaataaccactatgcaatattcaggggctagttaaataaattttgataccaccataatgaggaatactgttacagccattgaaaactacattgtagaaaatacttaatgtcctaggacaaagttcaagctactttagatgagaaaacaccaactggtcctagaaaacaaaatacagtttggcatcgggagaggtatattatctttggtattaggattaaagtaagtttactttttactgtattgtattctgcattttacaaattttcttacaatgatgatgttttatctttttagctgggaaaaaaataacttttttatgagctctagtttcagataaaaaaaagttaagtagaaccttcaaaaatctccttctgtctctctctcaccttccaccaaagcttgtgtgtgtgtgtgtttgtgtatgtgtgtgtgtgtgttgactgtgtggtcagttgcctggtcactgccaccattccctgcagtatgtattccttgataagatgaaccttgttgactagttacagggaatccaggaatatggaacattttaactcagcaatagaaatagagaaaagtacaggctgaaagctccagtcaatgaagcccatgtctgttatagttcccatcatgttcctaggacccagcggagtgcctggcactcaggaggttctcgattaatatatttcccacccatgttcctgggacccagccagtggctggcactcaggaggttctcgattcaatggaaaaagttacctaaatccctaatagaacaatatattgccataaagcagaaaaaaaacaaaattaatgaattatttcccaatgctatcaaggaaatcagcatttcaactcattgaacattaagcattagttgatctggtaagtttcttatgatactacttcatgtaacatcttcacaatatcaacaacaaaagcccagttttccattatagtccataatttcagtatcaatacaaattacatctatggatttcaactgccaaaatatccaacatgtttagtatggtgtcagaagattccgcacaggagtgcactcctatacctacaaatacagactcctaaacgattcatagaaaaccagatctaaaaatgaaaaaccaaaatactaagattttacctatccagtctgtacaatatcctctctctgggtttaagagaaagttttaaaggagggtttatcttattgtgagattgtttctgtattatactagagagtgcaaaaattccatatgtctgcatttcagcagctgcaatgcctcacaagaattattgcattccccacctatggctccgatgattcctcaggaaatggaactgaaagctcaagattcaatagctcctaacctccagattttatctttaagaccctacatatttgactccagtaaagccatttcttgcatatggtcatctcaaatctggatcaaatttaaaacccagcacagcttgcattgttttgattattgatatcccctgtcttggctgattcagcagaaactgacttcttttgtgtggttcctcatctggaagtgtggctgtccttggttttagggtatcataaattgttactgtattcttgttcttttttgaaagttcacagttttggtagttaatattacttttataaaactagaataacttttgtaaaatctttctgtttgatttcttcttaacctgtattcagaatttccactttacttgtataaaactgttcaattattaaagtactacaaacatattttatttggtagtttacaaatgaaggaaatgaagtatcatgaggtcaacattgaaatgggccaaagccacataattaaggaaagatgaaaaacaccccaaatcccaaggtctatgatctaggcccaatcctccatgccacacccactcccctgttcctggtacttgtgcaatagtgtagtcggctgatactcggccagtttaagggcactaggtttgagtaaaacttcaacattgtctttttctctctaaacaaaagacaaatgtctgtcttgcagtgaattggatccagatgagatgacattccatgtcagttctactttttttgaacaccctgagagagctcttatcaggtttctgtagagatttttctaccataaatatcactgtcttataacaatcattttccaacaggcttttgagtggccccttaggatgacaaagggagattccatgagaagtcatgctatacaatcttgaaactatttccactaactataattctaagaggtatatgttggaatttaaatcaatggcagattgataactggaacattcgttcattcattgaatatatatttactgagtgtctactatgtgcaaagtactattctagcctctggtaatatagcagagaagaaaacaaaaaaaaatccccaaatagagcatatattctattgatcatcatctgatgaagataattttaccaagtaaagatacttcactgccaaagctgacttccattacacatgggacagttaattaatactactgcaaaaatagcagtatatgaagttatactgcctaaaaagctagtttacatgtccagatgatggggacaattatggatcccctggacttcagaatgacatggatcttgaagagtacatacccaaaggatgatcagctcttttcagcattcttgtctctgacaacagactgctaaaataataatccctagcctgaaatcaccttgagattttctgcaattgcttccagcttcctaggctctctctgtctgtgtatcaatattattggcaaatgctcttattattctggttgttaacttttagagtccttttcaaaaattatccaccagcctgccacggactgtatggtgcccttacttgccctgtctttgagtccttgctgaaagtcaaaagctcagtttcaactccacctcggaagagaaagctgacacagctctgcacatcacatgggcccgtgctgagagcctgtcagcgctccattctccatgctgctcgaaatcaagtactataaaccactattgcccttaccttttacaaggttatgtcattagatgaaaaagactgagtgtaatctttcagcggctgatacaagaatacttcttggggagagcactgtatctgtaggcacaatagattggtaaaaggattggggtaaaagacaagaggtgagaaaggggagagaaaatctaagggtgtgctcaaccaacccaacatggactttaccctgccttctgaggaggtgagtcatattagatggaaggcccttcattctgctgaaattaagatattttcagtaggtatggatgagggtctggaagctctgagtacaaaaggagtgaggggccaggtgcagtgccgcatgcctgtaatcccagcactttggaaggccgaggcgggcagatcgcctgaggtcaggggttcaagaccagcctggccaacatggtgaaaccccatctctactaaaaatacaaaaattagctgggcatagagacatgtacctgtaatctcagctacccaggaggcgaggcaagagaatcaatcgcttgaacctgggaggcggaggttgcagtgagccaagatcatgccactgtgctccagcctaggcaacagagggagactctgtctcaaaaaataaaataaaataaaaatgaaaataaaaaataagaggagtgagaattcccatgaggagaaaggggagctggtgctgctgggcactgtgctgggggagagagaaatttgaaaaggtggctgagtctccattagaagtacagtatttccattttttggaaaatagaaatatctaatgacgtattttaagttatttcatgaggaactggagatataacacacgccttcctccatctgcaaggcttgtgttgccctctgatttatgcactcatttctttaacattctgtattattacagaataactattattctgtatattctataataattaattattatagaataattaatactattctgtattatgtatttttgaatacagaatagctcccttgccttgggaagcttatactctagaatgacaaactatatcaataagcataattttaaaattcttatataacacacaagatgttaataaatgctatgaagaagagagtactgcagggtaagggaggtatagggtataggagtggggtaataacattaatattattaatattggcacccaatattaattagggtgccagggcaggcctcactcaaacctgacatttgagcaacaacttgaaagaggtgagggagtctcaggaagattcaaggaagagctagtgcaaagttcctccggcaagagtctgcccggcaggtgtcaggatcagcaaaaagacctgtgtggctagagtagcatgagcagggaccaagcacaagaatgaggccaagcagaagggagggtccaaacacacaaggctctgcaggcctttgtaaggactttgtaactttaacacaagagtcattacatggttttcggtaaagagtggcatgatctgactgaaattcttaaaggattgctctgcctattgtgttggaaatagactctagggggacaagggaagaagtagggatagcagctgggagtctatttattgagtagctgtggaggtactgagacatgagtggatgctggatgtacaagccatgtaccacgtaacaacatttttcttaacaatggactacatatacaacagtggccccataggattacaataccaaatttttactgtaccttttctatgtgcagatatgtttacatacacaaatgcttattgtattacaactgcctagagtattcagtacagtaacatactgtataggtttgtagcctaaaagccataggctggactgcatagcctggacgtgtagtaggctctacatctaggttcgtgtaagtacactctgatgtttgcacatgatgaaatcacctaccaacacacttcttagaatgtatacccatcgttaggcaatatatgactgacagtactaacttctgactataggttggctcaggtcaaataaacaatgaccatccttgaatatctaggagcttgggaaatttcaaactttcttttgaaaacagagtatcatccacatcaagaatatacttacaatctaaaaatgaattcaatctatgtctttctgtccctctaatcccatcattaaatgtggcttcctcagaagtatctgtgttccaagctaagcaatccttctcactctcttcttagacatctattaaatgcagggcaggcactacactaaccactcctaatagtgccagtgcccaagaccatcaaaattgcagtcttctttaaaaaaactgttttattatagctcacataatttatattcacagaagatttccgtttgctgattgtctctctctcccttctagaatgcaatttccttgaagaaaggcattttatcagtttttcttactgctataccctgagtctagaatagaactgacacattatacgtgcaagttagatatctgttggataaataaatgaagactgagaatatgaggtgtctatggagcatgaataaatgatcgttcctatttattggctctcaatggcaatgaatatcttacaacttattatttacattgctaggagaataaactactgatgcaggaataaaaatccctttgtgttacagtgtgatgctcactcaagcctgcagacacatctggtttatgagtggcatttgctcttagtaggacaacagatggcccttctgcggaaaataatcttccccactggcctgtgatgatgtgtctaacattccacccctgacacccacattacccacactttgggttaaaatggtaggttttagaagaactctaggttagcaaggaaaggggctttggggccacatcatggattaaaggggtgtattcagtttcctactccatttcaaccaaagagctctactgttggctgctttatacacatgagtccatggaaaattttctttgaaaatgggcttttgttgtcaaaaacaagtttgaaaactccttcacccttaagattttctgttcagttgaacacttagttctgaatgtaattatagactgtttagctttatgttatcattagcttttcattgtacttagacttgagaaatgaaacatagaatgagtgacttttaggggtagagggggactcaggaaaggtatagaacatgaagactcagagtaagaagtgacacctggacccacaaatgagctcagaatagccctgcttgaaggtgtacagtgtgtggattcaacgctgttacatcagggtacaagaaaagccacaatattttcttaaagtaaattcatacttccccactcaaaaagctgatgagaaagatctttcaggcatattttgcagggatctctccctccttaggatggtacaaggatgcaaggggcttacatggaacctggaagaacgaaggaaggacttctagctttcattcctcagagaactgccagaggctcatggcctctaagtcctcaagtgagtgctagacagaacgcgccattgtgtctgtgccaagccagggtacagggccatggtccccagggtccagctttcctggctgccccacacagccattccttttggaggtccagcctcttctacaagcacgtgagcactggtctctgctatataatgggaaggccatcctacatccccctgcttcctcctccaccctccagacatttctctccatgccactcaacctgggtgacccaacacaatctctgctcagtccttccctcctcaatgctgctttccctttccggaggctgcagagatgaaaacacacttttttttgttttgtcttcttagtagatggtgctattatactgatgtttccttcactactgagaatgcaaaggtctccattagtaccttttaacttacacatttttggtgaaaagtagcatatgataggtggttggtaaatgcctgctgaataaatgcacttaaggagctcttaacatcaatattctaaaaaaggcaatgtcatggtgacatcttcttttatgggctgtaggcttcaccttgctgcaaagacaaggtaaaatcagccccttgacaacaatacaactctttcattcaacgtcccttggtgtcatttatatatcttttaattagtgagaaactgtctctgtcaaacaaatgttcagagaaaatcccaaacaactcctgaaattaagtcaactcattggttcatttttttcctttgaaataaagctatgctttgattcaatgaaaactttgccatctggccttcagcttaaattcctaaaaataagagctaagtatacttattgcctgcctgatagcatgatggaagagctattactctataaaaaaaaattagtcatcataacattttctaaaacattgtcaagaaacaacagaatagatctgtaactggtggcactttgataggagagagaatgtaaatagaatttagaaagcatttccatgtcatcattcaacatttcaagtacagtcacagtaaaaaatcctacccagtagattttaaatctaatttaaaaagtagaaagttttttttaaaaggcagagtaaaaagcaggaagctaagctttatgatcagagactgccagaaactgaaggccaagcagaaatctaaagaatcttaattacatttcaattttggaaggaaggaaggaagggcgggagggaggggtgagggagaagtcctaaatatgacctggaagcattttttttaaatcgttggaaaacaagatgtacatcatgattctgttatttatcatttcctgaacagaagtgcagtaacataatttcaaatttctaaaaaacatgggcaatttttaaacttttttgcttattatctatctgcctctcaatgagacagacagatgtttctaaattcaaagataatttctcatttaggtttcttgggaggtgctaccttccgaatttgttttaggaaataaacacttagtttctttaaaaaaattgtgtttaataatactttaatatatttttgagactttcctccaattataaggctgtttcaagtgacattttgcatttattcactatgaatcataaaatgatagcaatggaacaacatataaactacttctgacaaattttaaacaaatacaggatggtttctataaaagagttaaatgattgcatataaatctaagaaaaataaaggagataaattttatttggaaagaaaatagtctcttgcatacatatggtagtatctgaaaagctatatatatattagtattttttctagaccttttttaaatgtgtaactcagtcacaacgtttatggaaagacttaggacaaacataaacaaagaaaaatcatcagtttgaagagccatcccatggtatttttcttattcgttgggctatactgtacaaattgaacaaatttcattttacaagttaacaatttgtggacttcattccaactctaaccaaacttatttttaatcacagtttcttttagtccattttatgtattggctatttaaaagctaaaataaattgcctatgactttacaatattatgtatcctgagaaccagaaatagaaaaaaaacatacttctttcaaatttacagtgaaaagaactttgaaaaatatctttcaaaaacagattacggttctaccctaatgtctaaaaattcacttccaatcccatgaagaatgtattgcatcactttcctacctactctctattgttgattaccataacttgactatttcaaagcattagcattctttttttttcttttttttattatactttaagttctgggatacatgtgcagaacgtgcaggtttgttacataggtatacacatgccatggtggtgtgctgcacccatcaacccgtcatctacattaggtatttctcagcattagcatttttaaaaatccactgatcttcaggatattggtactgtaggacctcaactatcttccggattggataaccagcggttggatgccaagattctgaagccctaggtcagcactccgctggagcccctcctatactctccattcccttcactcaccacataaaccccacccaccagctcccatgcagcagccggtagtgacagcacatattcactgggtcaaggtagaattgggaaaacctagctacttctgaacatctgacccttcatgcttaaactaccccagaataatcagataacttccattctgaacactaccataattaagagaaaaaagttaatggtgaggaaatgagttcataaacaccctgatatccacactaatactgaatctacagaccagaaaagaaactattcacaatcatgacctgagataggaaaataaaggtaatcttgtagaaaagcagagattggtatttaaacttacactatctgcgctgctttggcgaattacttaacttttctgagcttcagtttccttacctgaatcccacctactttgggatcgtctctgagtatattaatcagtaatggacataaagtgccgagcaccaaatcaggtaaggcccagtatgttctgtttactaaggctgggaagtgtacaactcacctctgaaagatggccatctcaaactattgaaaaacgccttttgcttaaagggttaacctgcagttaagctgaggtcctaacccccaaacttatggatatagcatatctacttagacttggaaggtaggggcacctgggttctttgaaacaacccagataactggaggagaaagtggtctcaagtgatcaacacacacaggcattaatacaacaacatctaggaacagaattatttaatacgaacttctctttggctcataaacagaaaaggaagtcaattgcttcaggaaagttgattttcactgtttaatcgtttgtgtcctgttaaatgatttacacgctggtggaacacagaggtctctggattctttctcccaggctcctccgcttttctactaccgcatgcctttcacagcacactacataaaatctctctcagtatccctagttaccaggattgcatataacaaagccacacagactaaacctaacaggggaaaaaaaaattaaccttgcgtaaaactaaatacaagcacaatttaattaactcgcattccagagtcatagctcccaatttgctaagtctagaggattggttacacaacatccaagcactcagcagggaggggagaaaaactgctaaaatgtttccagaatcttcacaggactcacatgttcttttatactggtaaacaggaatgatggcccctgtgaacaatctatagccatccaatcaaggagacagaacgagccagggcaataaggggtaagaggttcaaagaggttgaagtttcaggagagactacaggggaagaaatgtacagaaaatatctggccttaagattagccctgagtcaagcagagaatggtctactttatccataaagagggaacgcattgagcagataacgggaagtcaaaaactgtgctcctattcctatgaactctcattgctgcaatttgagcagatacagagtctcctctaaaaacacgctatcgatcaactgaatatgcttaaccccgagaggtttcataacatgaagatatgtcagtggtggagggtgtgggaggaggggctgaactcagaatacaggtgatacttctgagagaaggttcatttttttccacttgacaaaagggtaggacacgtgcagttcccaagccatatcacacgatggcagccatactcagcacgtagtcgctgtgaggcacacacagggaagaattcagcctgatcccctcaactggtgagaggcatggcgacccagtggatttcagctaagagatatcttttctgaagggcatacttggcttgtgattgcgactgagtaaatctgaaataatgaaatcccacttctaccaatgattacttaaggtaagtgaaagcccttcacagtttatgcctactcctactgtttgcacacatttctactgctttttttccccctgactggtttatcagagctccttgtgttgcaattattttctcccagtgtttcctgtatttgtcttttaaatctatagcttcttcagctacatgaaagttttgcaaacgtgaagtctaacatgtcagtctttatggtttacgtcttcataaaccatgcttatatttgtgatagaacaaaaactctgtgagggcagtgaattttacctgtttggtttcttgctgtggctgaaggacccagaagagtgacaagtgtagagcatgaactaaataaactttgcattcacctagagcctttctaaagcagatggaaaatactactgccaaaattaagagatacattctggccacaatacaccaaaaacaggccacaagatagagaaactaggtcagatttcctaatagtcaaaactgatttcgacgtggccatagggggaggagacagattgatcaatcggttgatttttgttaaaataatcaagcttcccaaaagccatagtcaaaatgaaaaatacgtagcctgacctctcaaaatgctttccagattcaaatttcagcaaaagggaaagaaatttattaactgctttgaagccagtacctttcttaacacctaccacaagagggagaccacatcataaattcaagcacacggcccgtaaaatatttgtgaagtgccccccgtgtgtaacagtatttgaaaaccatcctatttcatgtgttttcagtatttattttaaaacaaaatcatagctcttttaaaaatcattttgcattttacatgccaacacaaaaatatgaatcctcataaaccaataactatgttatttgtgcatttattttagaatttgctttttacattcttataataaacaataacttcagaaattcagtttttactcagccagttttgtttcaaatggctttttatacatttttactactaatttgtacataatgtgatttctgtggatgctgaatggatttttcagcaggtgatctcattacaagataatctcattacaaatccctgttagaatttctcaccgtggtatccagattgaaatgaaattcttcacagctgtagaaaagttcttccgaaatttgttggtatcataagctctaaactgctctactctatggactttcaagaaaactaccaacttttgcctttccgtctggcggcagccatcaggtaagccaagatgggtgcatacaagtatatccaggagctatggagaaagaagcagtctgatgtcacgcgctttcttctgagggtccgctgctggcagtaccgccagctctctgctcttcacagggctccccgccccacccggcctgataaagcgcgccaactgggctacaaggccaagcaaggttacgttatacataggatttgtgttagccgtggtggccgaaaacgcccagttcctaagggtgcaacttacggcaagcctgtccatcatggtgttaaccagctaaaattttgctcgaagccttcagtccgttgcggaggagcgagctggacgccactgtggggctctgggagtcctgaattcttactgggttggtgaagattccacatacaaattttttgaggttatcctcattgatccattccataaagctatcagaagaaatcctgacaccccatggatcaccaaaccagtccacaagcacagggagatgcgtgggctgacatctgcaggccgaaagagccgtggccttggaaagggccataagttccaccacactatttgtggttctcgccgggcagcttggagaaggcgcaatactctccagctccaccgttaccgctaatacaagtaaagtttgtaaaattcatacctaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttatctttgctttatcttattagggagttgtatgttagtgtataaaacatactgcgtggtataataggcttaataaattcttaaaagaagagaaaaaaaagaaaactaccaacttttctcagcaactatcctatgaaaattttgtgacagtcatttcaagactgcttaaaagtagacagaacaggaggccaaaaacttcataaaatgtggtataattcgaaggaatcctgggaggtctctctgcttaaaatatttcccagctgaaattcctcactgtgaatcccactcgtttaacttaagccaaaagtcctcaattaaaagccaattcctaaggactcctctatcttgcaactaaccaagatttccagaggctctccacaaaaggcacagtcctggacatggcaaaactacaggaccttaagagatgaagccattatcagtgattaatacctcagcagatagcacttaatatattcatcttctttatttctactttttaaaagacattagagaatttagatgagaaaataggaaagggtggcatctaaagaatggggccctggtgagaatatacctgggtatgtactgaccctacaggaccaggggtcagtgtggggttagcaggggctaaagaagaggggagtagtaaattacaagggagtaagagtggagggaagtcctttgccatgctaagagccaggcatccatgatccttttaaagctaatacttatctggtgctttctcttcacagtatatgtcttaaagactttaccttcatttttccatagaacacattcaagaggtgataacctcgttgactagaggatgaaactaaagctccagttactttccccataaaatagctaataggtggtggagctacatatcagaatctaagcagtttgactccagagttcatgctgttaatatcaatgctcaagagggccgtattagtttcctattgctgccataaaaatttgccacaaattgggtggctgaaaacgacagaaatttattctcccacaatgctggaagtcaaaagtccaacaggggtctcactgggataaaatcaaggtgttggcaaagctgtcttctagaggcatccctcatttcttggcacatggatcccctttgtcttcaaagccagtaacatggcagttgtttgatcttagggctgtcatcacatctccttctctgactctcctcttctgcctacctttttaaagatgcttgtgactgcattgagcctaatgagataattcagaattcccctatttgaaggtcagatgaggagcacccttatttccatcttcaacttcaatttccattgccacataacctaattacaggtcccaggatttaggacatggacatctttgggggggtcattattctccctaccacaggtgccttaatatcttattcattttttatgtgcctctgggttccataccaacaaccacctgcaaatggctgactcaagcaagtgtgccttctctcccacctgctgactgccctcttcttccctcctattgcctttgtcagaaatgctgcagcctggaatctttctctagtcgaaatctttggctctggtcttatttcgctcatttctcctacagcgaggagccaaggtggcagccatcttggccatgcaagatcagtgggaggagaactgctgttagatcctactcctgtaatgagaatgttcaaaagactggggaataatactctaaaatgtaaataaatctgacatcaggccttggttcaaccaagtgttccctgtgcttttgtagctatcagctacaagtgcttgtgactttcccaggaagcaaaagctgagcaagaaacagaagagggcaatggcctgacgaggagcttagccttgacttccctccctttccatttgtcgttaacaacccaaatctctttgaaacctcaaaagagcaatatatttcaggacaaaaaataaggtaggagatgtcatattgttctgcagcagacatagaaaagacagcaaagaggcagttgcagaaagctgaacagatagataaatccttcagccagggctggctacataatttgcagtactttatttatttatttatttatttatttatttatttatttagacacaaggtctccctctgtcgcccatgcttgagtgcagtggcacaatcttggctcactgcagcctcgatctcccaggctcaagcaatcttcctacctcagtccccaagtagctgggacgacaggcacccaccaccacacctggctaatttttgtattttttgtaaaaacgggttttgccatgttgcccaggctagtctcaaactcctgagctcaagcgactcacccatctcggcctctcaaagtactagaattacaggcatgaaccactgcacctggccagaagtgctttaaagatactaaaatataaatatgtttttcctttaaaaataataaataaaataaataccaatacattattaatgtgacatcacaattgattataaggtttttttcttactcaatgttttgaaaatttattttttaggccatcaaaattgtactgtagcaaaattattttcattctgaatagctgtaaatggcattagtagctctacacacagacaaggttgcaagcaatttttgttaacttttaagtttgacaaggatttttcttcttatgcaactgttactggagctgttaagaatattttagaagctatgacaacatttgggataaatttcaataaattatttcaaaatacaaattttagtatgtctagagttgatgagtctcatggaacaattttaatacaaagacttaactcttcatatgagtcagttttgtgtaagtctgaattttaagtgtaaatttattcaatgacattttgatgtttcttctgacatttgctgaaaattgtggagatcgtacaagaaattgaaagtagcctcatgatttgtatataattttaagtgcctgtttatacattctataactctattttcaacttcaagggaaattttcattttattttatcttcctcattaataattggtccatctgaagttcacgtgaaaataacgttcttttccactgagaatgtgaaatgtaacttgtttctaagcttgtggatattcattttgcaatgtttcagcatttaaatccaaagattctaaaatctttaaagagctctaataattccttgataaatgctttattgcaatgttcatgtgtatgactttattttgtaataatctactaataacgtctacttcctgatgttgccaagcagtttctgtcccaaggttcaggctaaagcgttaatatttgtgtagatgccacagagacggactttggggacaaacagccaggctggcctcacaggggtaccagtgctgcccccctatagagctcctccttccccgcttgtccttggccgctgctaccatacctgctgcttctgctgttgccaatctgtgcccaggcactggcccggccaccttgttgccctgtaattaccagctgaagactccatttcccagtcctgtttgtaactaggtgtggcacaagcatgggctttgggtagccaggctaattatcccacatgcatgctgcctatgtgcccctgatgcacacgctataccatctagtctatccccactgctcacacgcatgatctattacccatcaaacttacctgcaaaatgcaagtttaaggataaagttattaagaattttaaggcagtgacaacagagcattaaaccaaatgctgatcccttctgagagtagggtcctgtgcccctgcagaagtcacccacccatgaaggcagccctgccctcagactttgaagaacaaagaatgtcaaggagggtagtgggatgaaagcttgagagaagtcccctaagaagtcccactggcaggggtctcagcatcccagtacccctcaaacctgaccccttgatcactgtacccatcttccacccacatctctcctgccacacccaccaaagtccatcctgcaggagccactctatagacaagggagccatgactataatgtggcagggactgccggttgtcatcagaatgcactccccgcgtttttcacagtaatggagtttaagatgcctccatgtacccagccaaagactacatttcccagttccctttgtgataggtgcagccatgttactaaggtctctccaacagaatgggagcaagtcattcttctacttcacctccttcaaagagacgtgctgccatgtacttcctctctgtaccattccacaagctggaacacagatacagggctcagccagctgcaaccacacaggtgaagaccatagtctagggattggtgaagcaagaaatagatggagcccaagtctttggataatttcatggggtaagcctgacttggcaaactgaaaagctcaccttggatctcttgcttaacagagaaaaaaaagttttatttaagccactctattttgggatctctattgttatggcagcttagtatttgcataatttgaatctggagagggttcattcccattgttgatctattcattgagcaggtctgaaaataaggtcaagcccctggtatgagagtaaggtccctgggaagaaggtgggtgggttcttcacatcacaatgagaactctgaaagcactttcccacaaaggcattcatttactcacgttagctataaacgtgacagacttcagcaatccagtccagcctagggctgtacctacaacattgctactacgagaaagcagctttcatatctgaaataaccaatttgtaaatataactttgaaatgcagccaatttattagctgaaatcttcctggaattctgtacctacatcatagaactgtagtgaagattaattgagataatatatgttaacaattaagcatagcatctgataccaaatgagctttcaatcaatttgatctttttattattactgacattattaaaccggcatcataatatagtcataattaacataatatagtcataatatgacacattatcatgatatatatgataatataatgtcatatatattgacatcatttaattatttttattttgagacaggatcatgctctgtagcccagcctggagttaagtgggacactctccactcactgcaaactctgcctcccaggctcaagtgatcctcctgcctcagtttcccaagtagttaggactacaggtgtgcatcaccatgcctggttaatttttgtattttttgtagagacagggtttccccatgttgcccaggctggtcttgaactcctgggctcaaacagtccactctccttggcctcccaaagtgctatgatttcaggagtgagccactgcacccggctgacatcatttattttaaggaagtatatggcaacaggcttggggaaacaatccttcctcccctggctgccacacagagagggataagagataaattacttaaatgtttacaaatctcttagtttccacaagaagttttagcaagtcttttcaaaacaaactgcataaaatattacctcaaaaatacatgaggtgttaaaatattactcaaactagtcaattagaagtaatgggttaagaaatcaccaaggaaagaaatgtgcatcagaaagaagaaaccaagaattcagtacatgagagaaacataaaaggaagagctgccaaaagtggagagtgggcatgattcattctggagatcactgtaaggtttccccgaaagacaatagaagaaataagttttgcttttacaggattaactttatagtagataatacgcatagatcagggtaaggcagtttttaaaaactgagaggaaaaatgggcttctactctgaaaaaaattagaagaatagaaagaaaacaataaaactttcttcaaagctatagggaataaaaagagataatggaaaaatcttaagacttaattaggtgtggagaaaaatctgccaagagatgaagccaagaagtcagattgttaattgcttatttatttctagagcattgtcatcagaacgtgaataatgaataagacagtaacaaacaacagaaaagtaagaagtagttgaacatctggggaaagatttcttaaataacctagacttggcagtatttcatccactcagcatttttaaggaagaaaatatcccatgcagggaaacattcaaacaactgaagcttatctacttaagagttgtaaattctttcatgattttattaaaattctgttaaagggaaacctgttctctactttctgaaatgtagtgtgttaattttaaccactttcttaatgctccagggtacttttggtgaacagcaaaaacttctcagccctgcgtggaggctcctggggtgaatttgtccccgtgctaacctgcctaagactttcttgctatttagagtgtgtcgctcttctccacgatgtaatcacagcagtcccgatctctaccagtgcccatatccctgcaccagtaactgtacccctccacatttccaatctatttcccagtaattacagagatctaggaaacccaaaaaagcaaatttttaatgtttttttttaaataaaagtgaacaagctccaaaagagggcctcagggaatctttttttttaatggcataaatgaacatctatttagatcataaccacttttgtttttttgctttttaataattacttatattctgagtaatttgggtagcaatctctggagaagtgaggtgtggccatatattcaaatgactgaattaaaatagaggtacctcatgaaaggagacagttgctatagtggaaagggcacggggttttaccaatggaactgggttcaagcaccagctctgcctcttaccagctgtctctgagtctcaacaccttactctttaaaaagtgaacatacacacccacaatgcagagttattttaaagattaaaagaaatacagtattgtgcctgcctttatacttggcacatatagagcttacgtagacaaactttagtattatttttatatctttgaatatgtatggacatttctatgtatgtctaatatactcacaagtgattaacacaaaccgaaaatttaatctgtaagaaaaaaaatctactttagattattttaggtaaaataagattcattagatttctggaattttacagctagaagagactggcaatcaatcacacagtcctgcttccaatcccagaaatgaggaaaccaatgctggagagtaaacatgacttggccaatgtcataaagctaattagaaactagaggtagaactggaactacgattttctaatgtccaattcagagttaacctagaacagagactgacaaacattttctgtaaagggccagatagtaaattgttagactttgtgatgcatacagtttctgttacaactgttcaactacaccaatgtggagcaaaagcagccataggcaatatgtaagagaatgagtgtggttgtgtttcaatattttattcagaaaaacaggctgcaggctgtctttggctcacaggctatagtttgctgacccctgatccagaagaagttaacagattttttagctagaggaaacatgatggacataattccaaatcaacacatctttctgctttctatcgccagtgcactagaaaagctgtgtgacaatgaaagaactcagaagaatgagacttaaatgttgctattatgactaacatcttaaaatagtgtttaataaacacaaatcttgacctcaagattattttattacttagtagcaattaggataatctaaaaaagaagctctaagaaagcaggaggagactcaaagaattggaattcaaaattatcttggctaaataataacagtgaagagaactaaaatagtagtacacatacaatgaagcaaaaactaaaacagaaaatactatggaaaagataaaagtgttctaacctaaagaaataagtaaatactgccatcaaaatttactgattacaactgaaaacatgtcttatctatccaagtagtacttttacattagaacctatctctccaagagatcatccttaaagtcagaatcaaagagcatgatgttggggccaggcccagtggctcacatctgtaatcctagcattttgggaggcagaggcaggcggattgcctaagctcaggagtttaagacccaccctgggcaacatggcgaaacctcgtctctactaaaatacaaaaaattagccgtgtggtggcagatgcctgtagtcccagctactcgggaggctgaggcctgagaattgcttgaatccaggagacggaggtgagctgagatcgtgccacagcactccatcctgggtgaaagagcaagactctgtctccaaaaaaaaagggggggagcatgatattggaaccaggaataatctaccagaaataagaacacctccaaaaatgtgtctttctggtttgtgtcaggacctcctgataacattggtcccatgatcataatcgtcataatattcttcagacacataaagaaagatctcatggaggaaggtgaccaaatgctttttcctttccactgaggatgaatgtgaagaaatacctatgctgcaatatgaggcagagataaatttcttgttcctaagaagtatgacatattggaacgggttggcaaaggaatagtgttcaagcttcctctagagaggctttgagagagtctaaactttgcatctgtttggcgtgaggtttcctccctaagagaaagggaagtagaagaattttcaacctctgaattttaagggagctgttcaaattgtaatttgacatactcaattgaactaaatgtagtactctattttccctaacacttgtgttgctccctagtagtaaattggttgtttacttttgaacatctaccttggaggcactaaagagtaacaggatgatctatgattggaattgggttcattacattgtaccaacttgctcccaacatctgttctgtttacacaatgacacattcagagtattcagtgcttagtgcaaacaactatgatcttccaatatttgatttctccttgggctttcacacacctcagctttggtttcactgaatgatttttggaagaaaaaagggcataaaataaagctataccaatgaatgagagattgagtgataactatgaaagttttgtgtatacaacttctgcaactcaaagggctctctgatggtgttagcaaaaaaccgtgtaaacacccttgccctctgtcaggacacaataaaagctgtttctttaatatcacagtatcattgtctgtttttaacttttctatttacatagtaaaggaaatttttcacttaatatttaaaggattatataacgatccaatacaatattaaagcacacagaataatgttgttcaaatatataatatatatagatgactttttctacttgtatatgttcacttagaatgcttttaaaatttatagctaaatccagctacaagaaaattttcatttcttcaatatagatcataggcattttatttctgtgcatcaacttttaaaaagacagcttcaactatcacataataatgttgacactttataaatattagtaaaaagtcaataaaaatgaagccactttcatactgttaaaaataacatgttaactaaaaaaaatactgttggaagacatgtatataccacattcattacaatggaaagtagagaaatacctgttagttgtaactaatgttacaaacaaaatttctatagaaagaatactatgaaaattagaactaaagcatatttttaaaagttcaattggcaggatccaaaaaaatacctacccttgaacaagagaaattatatttaatttctttaaaggaaaagtcactttttatgttaaaactcaaaaatctcagaaccacagttttttctcttttattttccaatgtaacatcctccaggctttttcaagcaaccacatggatctaatagacaactcacgtatacgaaccagtacacactcaattttaccaattggtaaaaattgttttctctcacccacagctttgaccaggtcacccctgcccccactgtggcttctctattgttcttatcaaatgcagactcccgggatctcagcttcaaagacctcctctagttttctcagctttcatttcctctgtaaccagtctgtattcttccagccaagaaatccttcattcagccctttgattcaccgtccccaatccttcatccatcctttttcttacacttccaacactggctcagaccacattcaacagtgacttcgcccctgaaatgggattcaacctcaacttattaggttaaatatccaactgcttttgtttgcttctttatatttttaaatctaatgctatttgctctgtacaaaagagattattagataggaccaggccccctgcatcaaatttctcaagtattttagtctttcatgttcaatctgttagacctctaaagggcatagcacagaatgaaagaaaagtatctgtattacatttaaagaccgaaaaaaagagaggcactgtagtatattttatgattgcaggttgtaggaatgtccattgatattgctttagggaccatgacagaagcagaagatagtgggaatgttaagcactagatacaagatgaacaaagacacacacaaccccatatcacaccaccgaagtgataaactggcaacgagaggtgagaaggaggaacagagatggatacaggagggaggggaaactgggaagcaaatgggcacagtattcccagtaggaatacaagtcaccagagttcttcctgccaggcagaacacaagccatctgactatgtgccaagtgctgaaatggacacacaacattagcaacacaaagcactatctcattagacttcgtttccaaaagtctattttctttcctccaataaacattaggattagcctacttattctgttgctcccaacactaattccaatgaaactcccagttaccatgtgaaaggttggattaattcaatgaccctattttcttcattgctaagagcacctttatacattctctcattcaaaaatacattgagtatcaaggttatcttgtcagagaatatcctgaaatgatgagccctagtttcttcatctgtaaaataaggataataattatgtaactattaggtagtaaggaaaattaaatgagacagggtatgtaaaccacttagcagtcattggcatccagcatgcgtgcaataaaagttagctatgattattgtcattgttattactataagaaccttgattttagcagatgacagttgtcattgtaacctaacgtgagctttaaactagaaaatttaatttttagactaaacaatatttatatgccttttctatcttcctatcaaatacaatgaatcccactgtttttcagttttcctgaattcatgcaactcccttccaattctgaattcaacaggttgctggcctgtttcctagtcaacactacagaggaaaaacatgagcgaggaaggaaaagtactaaagcagaagatgtctattccttagtccgtgttgtagttaaaagatgagtctgttgagtcattacccacaactcctatgggtcccaagggaggacagttgtcatcagaactgcttttgcaacctgcccttttaaatgctctgagatatttgtcctctttcttcttgactttttgctttgcacttcacatgccccctccatgagctcattcactcctttgattttagcccaacacatacatgaataactcccaagctcttgtctctgcagctcaagcctctctcctgaatttcagggacctgcaaccaactgatatgccaggaaatttacatctccaaattattctttatcataaacttttctattccttgtggtctctactttggcaagtagtatgacaaacatgtttcaccttttcccaaccaaccacctggtggtcatccttccttctaccttttgctcttcccagtgaaccaccaaattctccatatgtgagtccttgagaacagggattttgccttatttgttcctcaaccccagtgactaaaacaatccccagcacatagcaggctctccgtacatatttgttatataaatgaatagtgcatagttaccgctccataaccatctgctatatgaaggactggatgctttaagctgcattctcacaaaacaggaacaacatacaaattattctcctttacttaaatgtttctaataatttcttcttataaataagaatattaaaccatataatgcagttttgttttctatcagaacaacaagacatcatgtgttttgttacaatgttcaaatgttagtcctctggctgttgagtttcatagctaaacaagaagtttttcagtcttcagactttgtaaaaatctgtaaaaaccctctattcaagttatactcagcaaggggtcttctgaaatgtgcgtggagaaaattggaaacagcttagcaactgaaaagaataatatttcataatatcctatggagtaaaaagtcagatcccgtggggccactcactgggcatgttaggcaatttcagaaaacattttcagaaaattttttcaaatattctatatgctatttggtggacagaagtaacctgtcatatgttgcccacgacttttgagtggttagcctcacttttcatttaaaacgtttttatttgaatcggttgtagtagtataggggtctaaaggacatatgtgcattcttgctagaaagtatgtggcctgccttttactttgtgtctatagtcaaatcaacttgcattgctttgcttcataaaaatagcataaaatgtgctacaaataaataaaaggaaagtacattcatgcctgcatctgtgtttgacttgcaaaacaaaagacttcatgaaataaaaatattttgaggctcttttatttttatcactacttattctgtactgggcagatctgaacactacatgttttcttcaattagaagtcatccaacaggtggacttattttcagtgcaaagtcttagccaagattaagccatatatttcatacatcttgttcaagatgactgagaccaaacctctaaatttctttttctccaggtcaatattcgcagttctaaactaaataaccacttttttttggtactgtgttgagatttattcaaactgccaaccatgaaaagaaaaataggaacattcccaggaaaaagagtggggtacatgcagataactattggttatccatcacaaattataaggttagtgaatagtatttgcttttatatgcaatcatgtgctatttttatatacatctacatagagctatccctacacatctacttcttgtatgagatgaactcatcccttctttcgtgggctgaatgctataggtctacctttaatttatgctattaagtgcctgcaagagatgatttttaaataagtagttttgcatacagaaccaccatttgattccaactttgaatgctattaagctaaatgtacacagaaatcctttttactccttttaagatgtgtacactatgtttatgacagtgaagtcctaggtctttgaaacactaacaggcccagattcaaaggggttcagatcacagctcagtcaagttccacctctatgatcttgagcaaatcacttaatctccctatcagttctgtcatctataaaatgggaagtgcctcagtccattcaggctgctaaaacagactaccacagatggggtggcttaaacaagaaacatttatttttcatagttctggaaggtggaagtccaggatcagggtgcacagtggcattcttagtgagggccctcttcccggtttagtcctcacgtggcctctcttgatgcatgtacagacagagagagagagagagagagcacacaagagcgctctatctcttactcttcttctaggagcacttctaatcccatcatgggggctccacccccataacctcattttttctttttttttttttgagacggagtcttgctctgtcacccaggctagagtgcaatggtgcgatctcagctcactgcaacctccacctcctgggttcaagtgattctcctgcctcagacacccaagtagctgtgattacaggtgtgtgtcaccacaccagttaatttttgtatttttagaagagatggggttttgccatgttggccaggctggtctcgaactcctgacctcaggtgatctgcccgccttggcctcccaaaatgctgggattacaggcgtgagccactgcacccagcccataacctcatctaaacctaattatctcccaaagtctccaccttctaataccatcctcttggggttacggtttcagcatgtaaatttgtgggtgggggatgcaaacacgcagttcatcacaggaagaataaccataatcctcacagtgctgctgggaggagtaaataagaacatgtatctaaagggcttagcacagcacttagtacataataaatgctcagcaagatacatactattatgataacactgttattattaaacactattaggaaaacaccattatttgaattgcaaagtctggccatcgtttcttcattttgtttgttttattctgttactaccttaaccatattcaccagagtgcagcatggcttaaaattaattgattttttattctacaaatctttaatccaaacactatttccacagaccccaccagcttctaacatttagctattccgtcttcacaatttcagcatttttctgagcttagtattcatcacacatactgatgcaatcacttgcatatgagtacatgtattcccatcactcacgttccattttcatccaatgtttgcctgttttcacacataagttatcactggagaagtggaaccaggataatagccaggtctgcttaatcctacaacagccatcttctaactgtggaaggtgtttccttagagatatacaagggctttccaagggtatattacaggcagagatagttttaaaggaatcaatttccacacccttaaatttcctcttttctatcattgcctatctgagggcacatgcaggataacgtcctttcttaccgcccttttcgcaatgttcctttttttcatctgacaaaagaaaggcactttttaaacatttcaaacctgctatggcacatgctcctgggtataaaacatctggagttccaaacacatagacaatttaaaatatcttccatcttgctatcctgcctcctcattctccaaatgttgtcagagaagatattgttcctgaaggaaaatatttgaaggacaaagttaaaagagcacaaataaaccccgaaagcagaggaccagaggctcatttcaggcaacaaacttattttattttgtctgtccatctgtctaccgaaatacgtatcttaaaatttgaagtgaaacgtgggattctaagattctaggtccagttaaaatggagtaaaaatgtcccaccttacctccccctgtgattgtaactaaatgttgtggacagaatacacaaagcaattgtctgtggtatccaaacagtaaagaccagtaagcggactaggaagggaaataaaaacttaaagaaagagtaataaggaggtgagctttctggtgtttttctttttctactcatatttcccaacatagaatgaatgcaacaaaatcatggaactgtgcagcagtcttgaccaagagaaactctctccttggtcagacgaataagcaggaggggccctgcaaaaccaaaggacggggagtcccctgagacatctcttctcctgaccgtcccttggagggggccctagaagctgtgctcatggaagctgtactcatgcaacagtggcagcagcagccaaggttgcctatttgccccagagttggctgcaacagtgcaaaaggctaaaactagagcttttttgacagaggaccagggcaaatggtccctggaagtcagagagtttcagggagatcacagagaagagggagcttgagatgaaagatcccacagagctatgtataaagtcctgcctgggtttatccctcaggtctccatgcatgaaaatgatttgaaatagaataccaaaagctttgagaagtaagcaacaatgtaatccatggcccagatatcagactgatccctgggaaatacactcatggggaggatccagagagcactacaaaggctttgaaaactgaactgacattggaaacaaagcccttagaaggcataatgtgacttgtgaccggaacttaactgggtcaactgactatgaaaagaaacaaacacacaaacaaaattagcattttccagagaattctaacaggacccagaatatcataatattttcaaaatgcccaggatataagttaaaattaattaacatacaaagaagcagggcaaggccaggcacggtggctcatgcctgtaatcccagcactttgggaggccgaggtcaggatcacaaggtcaggaaatcgagaccatcctggctaacacggtgaaaccctgtctctactaaaaatacaaaaaattagccaggcatggtggtgggcgcctgtagtcccacctactagggaggctgaggcaggagaacggcgtgaacctggaagagggagcttgcaatgagctgagatcgcgccacagcactccagcctggacgacagagtgagactccatctcaaaaaaaaaaaaaaaaaaaagaagcagggcattctcagcaacccctaagtgaaaagataattaataggcaccacccctgaagtgacctagatgttgaaattattgaacaaagacttactttaaagcagctgtaataaccatactccatgaagtaagggtcaacaaatttgaagtgaatgaaggatagaagttatcagtaaagaaatagcagctatggaagctcagaactgaaaaataaaataactaaaatatttttaaaagacactgaaattgcagagtgaagatgacaagacagagtaagtgaacttatagctaaattaatagatattatctaatatgaacaaaagagaaaagttttcaaaaaacgaacataacttcaggtacctgctgtatattatcaaaaggtccaatattgatgtcattaaaaatataggaaggaaaggaaggagaatgagatttgtacagaagaaaagtttgaaaatttaatggctgaagttttctaaatcaaaagaaagatataaatttagactcaagaacctaaatctttggaatttttttggaactcaagaatctcaacagaacccagataagataaactaagaaaataaaatcaaaataatcaaatgactggaatttattcaggaatgcaaggctaatgtaacagtcaaaaagtaataaatgtaatctctacattaataagctaaagaaaaactacgtgatcatgccaactcatacagaaaaagcatttgataaaattcaacatctttcataataaaaactcctagaaaatgagatttagtttatgggattacctgattaggtctactgaggatattctacctttcttaaagtcagctgtgccaaataacataatctaattataggagtgactgcaacatcatattcagttcatccccacattcagaggtgaggggattatacagggtgagtgaaccacagaactggaaccctaggaaccatcttagaacaatgtttaccataactagcaatgaacaatgggaactcaatgttttaaaattagtaccttttacaatagctctcaaagtatctaacaaaatacgtgcaagacctatatgagcaaattataaatgccaatagaagaatcaagaaagacctaaataaatgataaaccaagttcatggtttgaaagacttaatatgtttaagatgccaagtctccccaaattgatccacagctttaatacaaatccaatcaagatttttggaacacttttttttttgtagacatagacaagctaattctaacacttacatagaaaggcaaagaactacaactgaaaaataaatgttgagacataacacagtggaaaaactcatactattctttgttaagtcttaatatcaagccatactaatcaaaacaatgtggtttggttaaggaatgagcacataaattaatgaaacagaatgaacagtccagaaatagacccacgagaataaggtcaattaatttttgatggaggtgcaaaagcaatttaataggagaaatataggccttttaacaaatgtgtctggaacaaatggacatccatttggaaaaggaaaaaaataccacttgacctataccttataccttaggcaaaaagtaactcaatgcaggtcatataaaatgaaaactgaaaaagtcttgggagaaattatgaaggaaaatctttatgcagttgagataagtaaatagttcttatatgatacaaaagtatgttgcattaaaaaattggtaaataaaatcatttgttctgtgaaagacactgtgaagagaatgaaaagacaaggtacagagagtgggaaaatattcccaaatcatatattgaacaaaagacttgtacccagaatatataaagaactctcaaaacccaacagtaagaaatcaaacaacatcaaacaaccccccactcctgccataaaatgagcaaaagatacgaacagacacttcataaaggtgatattccgatggcaagtaagcatattaaaagatattcatcattaggcaaatttaaccacagtgagatgcttctacacacctattagagtggtcaaaacagaaacaacaaaagtcaatctgacaataccaagtactggtgaagatgtgaagcaactggaagttgcatacattgttattgatgggtatgcaaaatgatacagccactctggaaaaactgttgacagataccaatctaggtattcatcttagagaaatttgcctataaaaactgtaagtgaatgtttatagcagtaattttcacaattaccaaaaaactggaaacaatcaaattcctttcaatgagcaaataaacaaattgaggtacagccatacaatggaatactagtaagcattaaaaataaccactgatacatgtaacaacatggatgaatattaaaggcattatcgtaagtgaaagaaacaggtttcaaaagggaatatactgtatgattccatgtgtgacattctagaaaagccaaaccagagatgtggagaacagatcagcagtttccagaggtttggagtgtggttttggccataaaggacaagacgaagatgatatatgtaggatgatagaactgttcagtaatctaattttgtggtggttacaaatatctatgcatgtgttaaaactcagaactatatatacacacacatacagtgaatttcattgtatggaaatttaaacataaaaactaaagtcagcctatttctttcagaaagtaactctgatttgatgaataagttttgacattgaagactggcattactagttagataaattttacataaactggatgaacaaaactgacagctccaagttttgataaatatatatttaaagcatgtaataatataaaaagcattttattaaaatattgtattagaaaaaattaattgaaattaaccaatatttccattttttataaatttttctgaatatatagagctaaacaaagtgcctcaaagtgaaagagtaataaacagatatttgataaatcctggcaatattctcagaagtagagaccatgcatggctttactgactgggtaacaaattcatttgcaagtaaggtgctttccaagtctgtgctttcaaaaatggaaggagaatctaatcaagttgtcatctaatcattaaaaataattttaatgataaatcattactatttgctttttgacagtacagtgggaagcttctcaaataattgaatgccattattcaataaaactctttctatgcccatgtgtttaatcatatgagtaagttttcaaagcactaccatctagaagaaaaaagtaggaacacaattgatgccaaactctgatatagtctacacaaaccagtgttcaaagaaaataaactgcatctaatacatcaagatatggaattctaatatgtgtcacatttaaggttagtaattatttataaacatttataatagattgaaagtacaactttttgataaattaatcagaaaataaactgttgacagagtcttatgactgaaggaaagttttttaaagtaataatttccattttatgcacagttttgttctagagatgcatggtagggggataaaaataatctaagcattaaaaagatattacactgtaatgaaattctgtaggtgaaaggaaatagaaatgacttcagagagaaaaaggagcaaagtaaaatttgctgaatgttacaagaggagcttataattttttaatgtttggtgaatgtcaaggcactatgggatttaggtttcactagacacatttaaaatagttatatgtcaattattataatagtctttaaattctattatctgacactatttacattcacagttaaaattttgtagatattaatttaaaattgtacaagggctgtgtactttgtcaaaatcctttgagggtacacagcaaaaatatttggaagaccacatatctaaaacactatgttgcactgcctcctcgataagagcttaactttttgtttaaatgtgtgcagggtttcagacacaaaataaacatatggatagagcaggtgagaatggagacttcaaattgcttcccaattgctgagctcaatggaattgcagttatgaagctcacaatgctatttagcagaatgaagtcacaatttcaaaagagattcatagattttcatgtgatgattctgaatcatgcattattttcagtgggtggcccagagtttagagttcaaactctaggatgtctgaattactagataactgccacattactgttgagaatatcaaaaagaactgattaagcttaaagaataatgttcacctaaaagacatagatagtatcctttcccaggaattttgggaaacaaatacgaaacttagaactaagctaatatttctgctatgtgaaagaaaaaaaaccagcattttgtttttcatttacctggttctgtaaagatctatcagctatgattaaattgaccatgatggggcgtacaaagctgaatacagaactaaaatagatgatgttttgaatagcaaatgagcagcattcttgttagagtaatcagaactgattattgaccaaaatagactcagggatgtgcacttatgatcatacatattaaataatatcagacttttgacttgttgctaaaaatttccatattctactgtaatctgtaagaccacaaatgtggatttctgattgtgattctgaaatgtgattctgatttctgattcagaggcataatattgacaaaatgaagatggtcttggtctccagccactgaacaaaataatattctgtaagaagcccaaggatcaacctatgatcttgagcttctgagctatcaacctgtaagccaagcagctagcttggcaagagagtgagaagaatgaatgcagatgaggaaagaaaacctctatatttctgttttaggaaccactgtgccacttcaagcaaagcaatatttggcagagaatagaaacttaatctcaaatgatctataaacaagaattacggagcccgcagagaacaggtagtatttaggctcaacaagaaaacgattttatctggcactgcttctttatcctgggtatgtggcatagcaaagtcaaaacaagcctgtaattctcccagaaaaacagtggaaactcacaggatgagcatttctcgtggtcacagatcaaaagaagttgttagggacttaaaagtatttttaaagcttcaagttacagcaaaatgaaatgttaaataccagaaaagttgatcatgaagtttcttcataagaattctggcatatccttagctctatcactacccaataatgacagctgtttcttacatagcttctcttcttcatctcatttttgaccactctccctagcatgttctatgtaacagccctacagacagtttctgacagctgattaaaagaactgaggggagatatctggggcaagaacgtcgcagcagatggaacagagtagctacagcctagagagcaaaaacaaaaacattaggagaaaagtcagagacgcaatcagggccagataatgtagagtgggatgtctatgttgcacaactctaggaggcacaaatgatacagacgggaggtggaaatgctgggtagaagagggcggttccccaacaaaggccccacccttaagctggaagacccacagctctaagtgaggacaggcatttctgttttcacacccaaaaagttgccttttggcccaccacacccctcatcctgccctcatataaacccaagaccttagcgcgcacacacacggagcggctgaatatcggaaccagcagatcagtgaaaacggaataacttggcagagaaagagagaagagagaggttcggccacagaggggagttcagcggagaagtctggccgctgggtgctccggctccagggaaagaccaccttcccactccattcccctgcttccggctccccatccacctcgctgagagccacctccaccactcaataaaaccttgcactcatccttggagctcacgtgtgatctaattcttccagtacacactgggcaagaacttggggtacagaaggctgtcacactggctccctgcccttgcgatagggcagagggtccattgagttgattaacacacaagctgtctgcagaaggcaaatttaaaagagcttgcaggccgggcgcggtggctcacgcctgtaatcccagcactttgggaggctgaggcaggcggatcacgaggtcaggagttcgagaccagcctggccaatatggtgaaaccccatctctactaaaaatacaaaaattagccaggcgtggtggcggctgcctgtagtcctagctactcgggaggctgaggcaggagaatcgcatgaacccggaaggcagaggttgcagtgaactgagattgtgccactgcactccagcctgggcgacagagcgagactccatctcaaaaaaaaaaaaaaaaaaaaaaaagagcttgcccacttgggcttcaggagccacagacacccacccccagaccctgcggtggggctggagcccaaaagcactcttgcaggcctctgcacctgcccatctgcatgctccccctaggggtttgagctgcagggtgaccacacaggagacacccctgttgcatgtgctgagaggggaatcagggaactctcccgttttactattcacattgctttctatatgactggtattctcccgcagttgtgcaatgcagcaatactgatgaagtcctgacagttgtaaagaccaagggcttttatactgagtgagagggaaagccttaggaaacttagagagaatagatgtgaaagtttaaaagatccctttctctgctgtgtgcatagggaggtatcaaggaagaggcagtaatagcccaaaggggcagagggaggcagcaaggaagccaataatgaggctggaaggataatccaggcacaaatccaagtgagctgggcccggtggttgtggagatagtgagcactggttggatcacgcatacattttgacagttgaaccactaaaatttacagacaaatcaggtatggagtgaaagagaaaaagaagagtcaaggatgaccccaagtttttaactagaacaactgaaagaactacattgttattgactaaggagggaaaagctgggagaagagaaagtgcatgggcaatatcagattggttttgtatctgtttcgtttgacatgccttttagaaactcaaatagaaacaaatagaaggcaaatttgtgtgtgtgtgtgtctgcatgctgcaagcatacatatgcatgcaggtccagaggtcagaggagggatgtgggctagagatccgcatttgtagttgtcagtgtaccagtggtatttaaagccatgagcctgaattagatcaccaaaaggagagagatccaaggcctgaggcactccagtgtctacaggtgaaatgaggcgaaaacacaaaggagactagactaagtggccaaagaaagaggaaaacccaattggaagtcaggtgaagagtttatcaggtaggagggagtgattaaatgtagcaaatgctggccgggcacggtggctcacgcctgtaaacccagtactttgggaggctgagacaggtggatcacaaggtcaggagttcgagactagcctggccaacatggtgaaaccccatctctaccaataatacaaaaattagctgggtgtggtggcgcacacctgtagtctcagctacttgggaggctgaggcagaagaattgcttgaacccaggaggcggaggttgcagtgagccaagattgcaccactgcactccagcctgggtgacagagcaagactccatctcaaaaaaaaaaaagaaaaaaaattagcaaatgttgttggaggtcaaaaactactgagaactactatgggatatagccacacaggtagagacccttggagatgtggggacaaaggagtttttcttgagaggtgtaagcaaggacagtggaatggaggtttgaagcttagggaagtggaataaaattggggatgatagatagatttaagaatcatcagtgcatatgtggctataagcaaatatgagatttcccagagaaaatatataagatgttgagaaaagaaggttgaaaatagtatcctgtggaatatcaacatttaaggggccagtagacaaaggaaggagactagagggtggccagggcagtgacaggcagatcagaatagaaatgtgctagaaaccaaaggcaaagagtgctacgaatgaagaagaaaccaacagagacaaaagtcttccattgcagggggcagccaagtttatactccctccttcacaaccccacatctcttctcctataggacattgtccttatgggctgtaacagatactgtcagtttcaaagactaaaggaagtgcataccccagctccctcacccctctagtagactaattctaaaccatatgttgtacactagttcccagattttcccatgggattgctccagttgcccactatggtagctggtttagtaatctactcttttttttttttttttgagatggagttttgctccatctcccaggctggagtgcagtggcacgacctcagctcactgcaacctccgcctcccaggctcaagcaattctcctgcctcagcctcttgagggcctgggattacaggcacacgccaccacgcccggcttttttatatttttagtagagacgcggtttcactatgttggccaggctggtctctgaactcttaacctcaagtgatccaccatccttggcctcccaaagtgctgggattacaggtgtgagccaccgcgcctggccagtaatctactctttattggcctgtttcccttcccactcccgtgacccccaccccaccactgtctcgcgtctctcccaaatgtaccatggctcaactccttgtctcaggtctgtgtctgtgcgtcccatgtccatctctccactggcctatgaactctttaaaaatatgcctgtcttcatgccttctccagttcctggtaaactgcctggtacatagaatatacttactacatgtctgttgaattgaaggatttacatttgcacagggcatgtggcttctctcaaataaagaagttatctgaaatacattatcccatttagcccataacacaattctaccacttaggtattattatttctattgtaaagttggagcaatagaggtttaaagggcttgagagacatgctcagcgccttcacgatgctatttgcaaaatatccatataagtacctcatctatctctagcaaaatattgatgtaagtacctcaaagaaatagtattaaattatttcttccaaataaacccacaattcaataggagaaattcggactatgtgttttaccaggatcctgaaactatcattttgctgcttgtgcactgaaatggttgctagcagcaaccggagctaggcagagcaaataaggtgctatgaaaaggaagaggaaaatgaatgaataaataactgaagttctttcatggcagagagatctcttcaggcccacagaaatacgatttaaaatcaactttccatatatgattacagactaggtaaaggattagtcagaaagctcagcatgattgataggtcctgaactttagccccctgagttctcacatctcaactatggaaacacacaaatgtttattttaaaacctctgacgaacagttcccacagcattatcactttagcacattatttactttacaagacctagcatcaacataagatagaaaggataagacaactgtgtgtccttctatatgggaacaaaataccttaggagttatgactgacttaaaggatattaagagaagatgaatcgaatttacagagctaagcattgggaaaagcagctgttacaagttgtgggttttggctcgattcactctggaaagacacgtgagagctcttgtgagaagggggctgtagcggcgggtattaataaggattaataatcaaatctcaagatggtcccaggatggtggactatttgggggaggatggagcctgggggactggatttaaaataagctgggaatgacctcctgaacctcagtttcttaatttataaaataaagatgataataccttggagatttactctgaaagcaaattgaactaacagctgtgaaagcacttcagaaaggagaatggggtacataatgtaaagggagggaattactatttccttgggcaaatgatttcacaagttggaagaagacgattgagacaagagtcaacttttagtcaccattcatttcatcggctaattaggaacctgacacccaacgcaagtccacagtgccgaatatcttcaccagaacaccttcttccgtcccctttgctaagtaggagcctttctcttttaaaatattcaggattcatttatgtaattgacttcactctattccattgacatttaacctgtgtccttttatactttctgtatcacagcatatttacatgtagttattaatgctcttttaacattctgtttcttacacgtgggtatcacagattaggtttaacactccttaaaggtaggaagtatgttaaactattattataattattactgttagaaagtactttgcaaaacatatagccctggaccacggtttctcaaaagcagcactcctaacattttaggccatgtaattttttgttgtgggaggctgtcctgcatgtacattgtaggatgtttggcagcatatcttgcctctacctactaggtgttagtagcaactccccctgttctcacagttgtgacaaccaaaaatgtctacagacattgccaaatgttcccaaatgggggctgcaaaatcacccctagtgaagaaccaatgcgttaaacagatacagattaaaattatggtcatcataattacttttactttttcagagtacctggaatgatacgcagaaaagaaaaagtgctcaatcaatattgaatgaaaaaatgaaagaaaaactacattagttgtatttataaagtggctctatagcataatcccttatatgattaagactgtattatataataaacactttgctggttggcatacaatatattcttacactttttagtaactatgtctgtgtatacaagaaattacattcttatgcatatacaaagattgtagctggcagtgactttctctatagcacacaaactatgaatagtgtctagcatcctgtttacccataaagcaagagacagaatacttattttaaattctaggtaaatattacatcaaacaccaattgtcagatgcatttttggagaattatctctacatgaaaaaaatattacaaccaagaattctaaaaaagattatctgacaagtagaggatctcagatgagtgtacttcggaaatttctgttctatttaaacatacatttttaaatataaatgtttcatcaatctttctaagattttttccaagatcatcaatctcttccaagattagaatatttgcaatatcctctgatattagagagccaatgttttaagtggcattttagtttgttattaaaaaatactaataatgggctgggcatggtggctcatgcctgtaatcccagcactttggaaggccgaggcgggcggatcacgaggtcaggagatcaagaccaccctggctaacacggtgaaaccacgtctctactaaaaatacaaaaaattagccggaagtggtggtgggcacctgtagtcccagctactccggaggctgagacattctcctgagaatgacgtgaacccgggaggcgaagcttgcagtgagcagagatcgcgtcactgcactccagcctgggcgacagagactccagcctgggcgacagagactccatcttaaaaaaaaaaaaaaaaaaaaaaagaggatactaataatgttattttgattttcaagaactgatatgttttgagcaacagtgttacataacactgatgatttttttattttcaagttttctctatgaattcttaaatcccgtatcaatgggttacattttccaaattaccactaatgaagactgtaagcattcttataaaacaggagaaaatgtagttaaaacagaaaagacttaaaggacttctctttcagttttactcactcagccttctagtggcttttagctatatactatcttttggagggaatcctaatttagcagcagacctctactaaacaacgtgtgaaaaagaaaacaaacttccatttctggccatgaggtagtaacttgcagcagatcaatgcccctgtcaagtacaactagaaaagccagataaaacacaagaaacatctgttggaaggcatctgagagctgatgagataattaagatgtgagtggccaaggtcccagagagaagataactatagaacaaagagtctacattcttttttaaagttttattttaagttcaaaagtacatatgcaagtttgttatataggtaaacttgtgtcatgggggtttgttgtacagatcactcacttattaagcctagtacccattaattatttttcctgatcctttttctcctcctaccctccaccttctggtagaccccagtatcagtcgttcccctctatgtgtctatgtattcttatcatttagctaagtgagaacatgccctaagagtctacaatctgtgtatgccttgtccttcatggaacttgccagttcttggcatggtgctacacatgtgaccactgcaaagacaagataagccagcagaacttttggcaattccacaaaggcgaagagacaaaaattagagtttggtgttgctgaagcagccagatactaaggggccaggtgagcagtgaaaggggagacatagagaagcagatctatcacttgggagggttgccttgcaaggcatttgccacagagggcaggagcctaaagaactaagcagaaaacttcagaaaagtagaatggaaattacagaaattatactgctctgagcagaaaataaaataaaatttggaactactcaaggaggaagggaatatagtaagcctaccagtttctcagttgagactactggagaaccacactctcagaatggagaaaaaccagaggtagacggagccttataacaatgaggcaaaatcagcttagtctctgattaaattaaggctatctggccccatatgtgcctagtgatcatatatgtggcacatacgtgtgatcatatatgtgtctggcccatatcacatatacgatctggccatatatgtctacccttcaagaatctattgctacatttgctggcccactgcctttagctgtcagatccttcgggttttgcctcagctgtggaacactgaagagatctgcctcactcagtggcacactcttcccaggaaggaccacatccaatgactgattgaggtggagacacatagactcaactattttggatcaacatgagataactcttgtaggcttaatacattccagaactccccaaggatttagctgaggctttggtgggcctggatcatatttcaactccttctgcccaattctgctttctctccctcccttaacacaaaggctgaagcttaataaatactctgtacaccaaactccatctcagttactatttgcagaaaactcaacttttagcacctagtgtcagacatggtctaagaaagcaggtgataagatatggttattgatctagataacctcacaactacatcagctgtgaaaactagcagccaagcagccactagaaggggcaaaacatgcttggagctctccacaatgccccattaccaaagaattgtcattatttttcttgtctgttagctccctggaaactcagagcaaatgtgattatttgacctgaataagagcttactcagtgcaaaagccttttccccggggtgtttctaaaaaaaaaaattaataatcgattaacactgtaactgtctgaggtggggatatcacttggggcaaacaagaagctaaccagaaaaattaaaagaaaaatgtggggaattcctgtaggaaaatttgaaaagctctaatacattgctgagaatctagaagatcccatgaatgtgcaggactatgcatatacctaagaaggacccagaaaggcccaaatatctcacctgtggcagacattgagaccctgtacaagcagaaatttaaggataaggcagagctgtaaactctgctatagtattgactgctatagcattgactctgctatagtgtcgactctgctacagtactgactatgcaccctaacatgcacagaatcccttggcaaagactaggatatatacctgttaaaggcatttaaggaaattctgtccaaccattagttgaccactaggctgctatctgggcaaaaacttcagtggccagacatgacaaagaacaaacttaacataatttgtttcagggaactcactgaacaaataaataacaataattaaagcaacaagaaacagaaacagcaactaatgttggggggaagaattcaacttgcagagttgaacattatattattttaaatgtccaactttcaacaaaaaattacaagatgtccaaagagactggaacatatgcccatatagagggggaaaaaacagtcaacaaaaactgttcctgaggaagctcagacattgaatttactggacagacttttaaatcagttattttaactcattcaaagaactaaggaacacatttctagagaactaaagggaagtataagagcaatggctcaaaaaatacaaaatattaataaagatatatagattattttaaaatattagaaattatgcagtaaaatatataataactgaaattaaaaatttactagaaagacttaacagcagacttgatcaggcagaagagaaaatccgcaaactttaagataagtaagctgagattatctagtctaaggaacagaaagaaaaaaaagaagaaaaattaaaaggtccttaatgacttggaggatgtaccaacatactcataatgggagtcccagaaagagataaaagaatgagtcagaaagaatgtttgaagatataatagctgaaaacttctcaaatttggagaaaaacatacatctgcataacaaagaagtacaaaaattcaaataaactctaaaggatctacacttagacacattgtaattaatctatcaaaaatcagacacagaaaattttgaaaacactgggagataagcaactcatcagataaaatggagcttcagaaaggttaacatctgacttctcatccaaactgaggagtccaaaaggaagtgggataacatattcaaagtgctgaaaataaaagactgtcaaacagaaattctatgtacagcaaaatatcctttcaaaatgaaagacaaattatgatattcccagataaacaaaagtggagagaatttgctattaacagaaccaccctgtaagaagtactaaaggaagtcctttgggataaaataaaaggacagtatacagcaacttgaatccatatgaagaaataaaaggtattggtagaggtaattaaataggtaaaagtaagataaaagaaatgtattttttctataaatcttttattatcctatctgattcttaaaaacaactgcataaataatttataatcataatcaataaacctatgttgagattatattatataaagatgtaatttgtatacataatggtacaaagaaggaaaaagaaacaaagctatacagaagcaaagtgtagatattgttgaaattcggttaggattcatctgaactagactgttataacttaagacgttaattttaagttccagcacaaccaataagaataactaaaaaaaatagccaagcaacaagaaatttaaaatggcacaccccaatatatctaacacaaaaaaagtcagtaatgaaggatcaagaaatacaaaagtcatagagaaaacaaatttcaaaacagcatatgcaaatacttataattacattaagtgtaaatgaattaaacactacaatcaaaaggcagagatttgtctcatagataaaaatatgagattcaattatatactgtgtgtaaaaggcatactttatattcagaaacacaaataggttgtaagctcaaaaatggaaatttttaggtgcctatgtgtttacacatattttctattgctgggtggagtgtactacagatgtctattagatctcattggtttatcgtgctttgtaagtcttgtatttcccttttaatcttctacctagttctactcattattgacagtggaatattatggttgaattgtctatttttccttcagttctgtcagatttaagtatttctggctctgtgttatgttttcctgacgaattgaccctttatcattaaaaaatccctcctcttttctgataacaattttgttttaaaatctatttgatcaaatattagtatagccattccagctcttttagcaaagattgaatggtatatttacatatgtaatctttatcaaaattatagctgaatttttttcagaaattgacaagttaatcctaaaatttatacagaaaggcaagggacccaggatagctaaagtaatccttaaaaagttaaagtatgcacacttcataatttcaaaatgtattgcaaactgtggtaatcaagaaagatagatagatcaataaaaaataattgaaagtccagaaataaacccatacatctatggccaattgttttttaacaaggggctccaagtccattcagtgggaaagaatagctcttcaacaatacatactaggacaactgaatttccatacgcaaatgaaagaagttggactcctacttcacaacatacagaaaagttaatttaaaatggatcaatgacttaaatataagagctaaatctattaaaatcttaaaagaaaacaaaggaataaataattagtcaccttgtattagccaatttttaaaatacatacactagaagcatacacaacaaaagaaaagacagataaactggacttcctcaaagttaaaaactgttgttaaaatgaaaacagcccccgaagaatgtaggaagatatttgaagattatatagcttaaaaggcacacttgcatccagaatatataaagaacctgacaattcaacaatttaaagaggcaacctaattttaaaatgggcaaagtatttgaatagatatttctcaatataaggcatacaaatggctaacactaacaagcacatgacatgttgctcaacataattagtcattagcaaactgcaaatcaaaaccacaatgggataccacttcacatcaactaggacagctataaacaaaagagacaagtgtggtgaaaatgtggaaacactggagccctcatacattgtttgtaggaatggcatttcctcaaaatgttaaacatagagttaatactagtcacagcaattctactcctaggtatatagctgagagaattaaaacagtatgtccacacaaaaacacaaaatcttatacgcaaatattatacagacagcattattcataacagtccaaaagtgaaaacagtccaaatattcctcaattaatgtatggatttttaatgtggtatattcctacaatggagtatcaattgacaataaaaatgaatgaagtactaataatacatgctacagcatatatgaaccctgaaaatattttgctatgtgaaagaagtcagtcacaagagtcccatactgtatgatttaattcatattaaatgtccaaaatagtcatgtttatagaaacagaaagttaattagtgtttaccaggggctgaggagagggatagcaatttactgctaatgcgtgtaggtttctttctagggtgataaaaacattctgaaattattatagatgattatgatggttgtacaattctgtgtgtatactaaaccacttaataatatactttaaagagatgaattttatagtatgtgaatgatctcagtaaagctggcatttctaaaaggtaactagcataatatgaaaaaataatacatcatcttaatagatatagaaaaaaataataaaattcaaaacccattcaggattttttaaaaagtcttagcaaactacaaatagaaagagcttccttaatctgaccaagagtatcctaaaaacccttcaccaaacatcagaattaaaggtgaaatattgaaaaccttcttcctgacatagaagaaacagaaagcagaatgactgaaaaggaggaaataaattgtcattattttagatgacatgattgtgtacttagaaaattcaaatgaatttacagacaaattataaaaattgttgagtgatttatcaaatttcttggatacataaaaacagaaaataaaggaaatgttttaaaaatatataatttacaataacatcaaaaataccagataccacaaataaatctaaagatgtgcaagatctctatggttaaacctataacacataattgagagaaattttaaaatgcctcattgaaaatacctacttaaatattaccatagtatataattgttatggttggaagactgactgttgtaaagaaattttcctgaatttgatctatatatttaatgcagtcccaatttaaaaacaaaacaaaaacaaaaacagcatttgtggaaattacatagtgattttaaaatttacattaaacgcaaagggccaaaaatagtcaatctttaagaagaacaaagatagaggacatataatattcaatataaagatgctataaaactatagtaatccagatagtgtggtattgtcttaattctattctgtcaattagagggttcaaaaatagatatacatgtaatcattcacttgattgatagcagcagtgatattacagtgcagagggaaaaattgtcttctaaataattaaatggtggtgggtcaattgaatatacacatagaaaaaaattaattcctatcttttacctttcaccatgcacaaaaaataattccagaattatagtagatgtaaaactgaatgtcaaaacaataaagattctagaagaaacataggagaaaaacttctatgtttgggggtgagcaaagatttcttaagacacagaaaaaaaaaacacaaaagaaaagattgatattatggacccattaaaattaagaccttctattccatcatagatgctaataagagtagaaaggcaagccatagggcatgagatctttgcaatacatatatccaacagatgacttgtatccagaattcatacaaaactataaactgaagacaaaaagacagaccatcaaaaaataggcaaaatatttggacagacatttcacaatactcccatcaaaattgttaaaatgaaaaagactgacaatgctaaagattgggaaggatttggagcaactacaacttttataaggagctggtaagagcataaattggtacaaccactttagaaaacttttttgttgaataaatataaccatattcaattaaagacaggcacaagaggctgggaacggtgactcatgtctgtaatccaaacactttgggaggccaaggtgggtggatcacgacataaggagttcaagaccagcctggccaacatggcgaaaccatgtctctactaaaaatacaaaagttagccaggcatgatggcgtgcacctataatcccagctactcgggaggctgaggcaggagaattgctcgaacccgaaaggcagaggttgcagtgagctgagatcatgccactgcactccagcctgggtggcagagcaagtctctgtctccagaaaaaaaaaaaaagacatgcacaagaatagtaatagcatcactgtaatagctgaaaattggatacaatgcaaatgtccatcaacagtgaaatggaaaaatatattttggttcaatcatatattagaatgctgtataacaatgagaatgaatgaaccacaatatgaagatgtaattaatttcttgaacataatgctgagcaaaagaagacaggttttaaaaagttacatattgtatgattccatttatatgaagttcagaagtaagcaaaactaaggtgatagaagtaaggatagaggtttcttttggaagggtgagatatgacaggcagcgggcttgaaggcatttctggggatgttgttaatattctattccttgatctgggttctggttacatggatcttgtcacttggttaaaatttatcagactgtacacttattatttatatccattcctgtataaatggcatactcaaataaaatcttctaaaaatgaaatgaaacacagacacctacattgctttccgttttcctgctgaggtgagaagcaaattctgctgacattgctgctttcagtttggtttctaaactgggagcatctgaggaaatccggccaggagtaattcaccatccccaggactgattcacagccttcttttgcagcctcacagaaggacctacagggcaggagtccatgactaaaaaaaaaaaaagagaaaggtgaaaattagtgtctttacagaataggttttgaaataatagtgaaattaaagttagcccctgtgttgtgatattatcttaatttatacttactatagtcagcaacttaaatttttacattcagtcctatgacagtgattttagctattctatggtcttgattctagaagaaatagctagttccacatcatctaactatttcttgtaggaacatttatcaataatttgtttaatatttactgggctaaaatatatagttgtcagcctaaaagagctctatttaatatcaaaaggggaaaattaacatggaaacgaaggccctcagattgcaaaggaagaagtaggtcaaaaatatgttattcttgtatttttatcttccctttgagaaattcaagtatctctgagtggcagcagagagtaagctgttccattattaacttccccagcctccctggaaaatgaacattatacagatgagtggcaacttggaagaccttgtacagttatttatcttttcagatttctagtctgtcatctgcaaaataaaaaaaaatgcacacaattgtctgttaatagtatgagtaatgatgcccccagagcttatctttattcacttaacatgccatgaaacagtcctagatccatagctctgtggatggagatgggatactaacaaagtcaaggccacggacttgcttccttgcagacccaggtaattgtttctactttacagctgaaggctgcatctctcaccctggctggtcaattgctaaaagcatttcaaatagttttaaggaaactgggaaagaaaatagacatgtcagttaaatcaaagcatacacttcacaaatgtggagccaataagatatcacagaatcgtacaatattagatatgtaacaaaccttaaacaataccttattcaaatccttcaaatgagatagttccagggagattctaggacagacttgaggtcaaatagctcctaatggcagaagcaggaatagaatcctggtgtttcaagtttcaggacacattctacctactctccctgtctcttctcttctaaggacctaatagttgggcttttaaaactccttgatccaacaagcacatttacaataccccattcatacttctacagattacaaaaacataaggggataggccagccgttgagatcaaatgaaactaatagggtctgtaaaataatcttagggcagagatctttgtacataaaaatggaaaaagggaattcaacaattacattcagataaaaatatcttaccttcctctcagaaagtcaccttaaaactgagtatcttttggaatactgatcttcatataattgtctacatacattaatatgtaaccaaattcaacagtgaggatgttgaagaagaggttttgtatttgaaagaattagcttcagcatataaaatatgaattggttcaggcaagtttcttggtataaagaagacacccgaaatatattagatatttctgggactaagaaaggatcacttaaataacactgtttttcattatttcctgcctgtcctgactcttatcccagagaagttagcgaatatactttctcaaataaaactaggatacacagtaaaggaaggtggagaacataaaattactatatgcagttacttatgtttgccaggcactgttcttagtaccacacatgcatcacctcactgatttctcagaacaggatgagtaataggtgttattactaatccccaatatacaaataaggaaagaagcacagacaaataagacatttgtccaagttcactgaggcaatgagagtcagagccgggattagaactcgggcagattgacccaggacctattctatttactactgtactacgagtaagtcctaatttcatgaatgcatgtcttgaaagcacaacgcaaatctttttttttttttcaaatggagtctggctttgttgccctggctagactgcagtggcgccataggctcactgcaggctctgcctcctggtttcaagcgattctcctgccacagcttcccgagtagctgggattacaggcatgcgccacctcgcccggctaattttgtatttttagtagagacagggtttcaacatgttggccaggctggtctcaaactcctgacctcaggtgatctgcccaccttagcctcccaaagtgcagggattacaggcctgagccaccgcacccagccaagagtgcaaatcttgatatgcactttgtgagtggcaccatcatatacgtgatgggtgagatctccattctacaaaagcctacaaatgtgcattgaatcagtatttgtcaaaggggctaagaaacacaaggaaagggtaaatacatttgtgctttcttctctaggtgtgagccagcccacagtaaagctataaaacaagctaggcttgtcgttggtgttcctcctttgccttctagttcttgaccaaggtcccagggtcccaatgcccttgtgatcaccccgatgccagcaccccacctagatggccacctctaccagagtgcttgaaacatattattcccttcctacaatcaaaacagtactcccaattgcagctgatctcaattaagcttttaaataagaaaatagatgaaaaaaacacagaataatgcataataatagatgaacacttaaccctcccagagatttttgcatctttaaaagaagactgctcactggggcaatggaatctctaactgatgaaattccagataccatttaaagggaaaaaaaaacattcaacattttttgaagatgagaaagatgtctgcaaactgaacaacactctggagcccaactctcccaagcagttcctggacctttcctcatttctgaactgagttattttattttattttatttcatttcatttcatttcattttatttatcattctacatcttttcttagaaccttctagggtaacaaaaatgaagtttcatacaggaggccagcagactgttttcaagttctaaagttaagtctttaattcagaaatggaatcattgtcattgactcttacggtggtcatttttctacaggaaagcctcagtctatcaccctgcaactttcacatggccactcctccactgttgaatcttgggcaatagctcactcatgtcaaaactcagtttcctcatttgaaaagtgaaggttttggaagagctggagtttggaccatttttcatagtccttttactactaacattctgtaagtcaaaattcattctttaaggcaatgtttctcagaggagcactgataatcccaccagatttgctaaatttcaaaaggtaacaggcattttcctcaagatttgttctgggaatatatagagacattaaaataccattaggccctccattctaaaaatagggcctaagaaaaatgtctactgtgtttccaaatagttctcttaagaggtgtaaccaactgagacccataagctttaaactgctggaccaggatatgtgaaatagtgatggggtattaataactagcaacactttccaacagtgagcaaaatgtgtagtcattttttcttactttgcataaaattcaactgcctagggaaggttgaagcattttgcttttcatcacatggaacagcgtggtgagataggccacactattttggaatatgtgtctatatccaagcaacaaacagattgatgactttaaaacagctctgcacagggaaggagaccactttagctatctaaaaactattttagaaagggtgattattttaaattgatgtctgaagtgcatttggtgttgtgcaaaagtacctagtacatttcaactaaagttaaagcagaaagcttttatacctcctctataattatttgttcaaacatttgatagctatataaataatactacaatatagtgatagtgaagtttttatggtgttctcactaggaaggctgttataaaattatttatctaccaaaacttgtacagtttatctataaaaatgttagagaatttatcttcaaataattttgttatagtatatatacaaattaatatatagattttatctgcaaaaaacaagttctgataaggacataaagtttaaattatgaaataagtcatagccacaaagcaggcttatatggttaatggatttttaagttttataaatcatttttctcttaacttttgattttgaactactgttaaacttacagaaaagttataaaaatagtacagaaaatttccatatatccttcatccagactccactaaggtaaacatcttacataactgtagcataattattagaaccaggacattagcattgatacaatatctttaacaaaactaaggaccctatttgaattttgccaggatctccatttaggatcccacattgcattcaattgtcactttttacttttggcaaataaactaatctttaaatattattaggagaactcagaatttaaaactcttttttcatgagaaaaaaaaaaacagaatctttgtgacaggtggactttaagatggcccgcaatgatctctgcttcctggtattcatgccctgtttaatcccctcctctggagtgtaggttgcctgagtgatttgctcccaaccaacagaaggtaatggaatgtcaacttcatcattagtctacataagattgtgacttctgcattgctaacagactctctcccttactggctttgatgaagcaacttgtcatattgaggagacccacatggcaaggatctgaaggttgccactggctaatagacagctaggaactaagaccctccaaccaaagcctttaaggaactgaagtttttccaagaatcacatgagcttggaagttgatccttcccaggtcaagccttcagataagaccccaaccctgccaacatctttaattcacctatgtgacagaccctaaagcagaggacctggctgggccactcccagatatccggcccatagcaactgtataataatatatgtgtgttgctttaagctgataggtttatggtagtttgcaatatataactaatacacttttcttgacacatcacattgtcagaggcatgctactgagtttgatgttctattcattgacaagactcacacaatcatctttttaaaaatacattcctaagtttgtctttgttaggctgagctgttcagtgaaaaatgctcacaaaatcatagtcacaggcacctcccagagctgcagaacttacttagtcgtgaagagaatgttaatgctggaaggatcttccaagataatctactcccattttctccttttgcattatgaggaaattgaagcctaaacagattttcatagccaaatactgtgactccagtccagtgctcccaaatatcttgcctatctgacctccttgcacaatctatgagcaacagataacacaggaacataaatcaacagatgacaacactactggaaaacccaaataacaatagatggcttgttctccctatgataagcgaacagcattggtttcctatgtcagcatcttctgcgacctcaagagaccatataagaggttaggcttagcggggtatgagaagcagaaaagaggcttctttggtttctactccactaaacgtggggatggacagcggtgcaagggaatttttacatgtgtcattgtctcccatcagaagataaataatggaagcatttgtggtattttttggtcacattggtctgactctaaaatccaggactgtgtctttctttttcttcatttgtaatagtcatgatcctaccaggaaagaggtgagccactaaagcaggttcactgcagaatgtttaatgaagggctctgatcacctacagaaggaaaaggtacaggcagggtttagataaaccaacaaggcatagtacagtaggctgctgcagggagctgttagcaccctaggtttaagagacaaggggaaaaagaattttctggaacttggagagagttgtatggggaaggctgcttgataggggtcgtggcctcttacagtgagtgggttgcagtcaacccatgtaacctggcagaaaggaaaccaggggatcactacccaaactgtctattctcccacactatgatctcatgctggtggcttccattggctgaacccaacaggaagctagaaagtagccactgttgaagcggcctcccctgggaagagttaggatggaggagagtggaaagtagatatggagaagtaaatgagaaacagccagcacaaagctgcatgccttgcacctagtgaaagttcagcaaatacttgtcaagggatgaaacacagtgatgtgtgagcagacggttaaactatgattagcttgacatctggtgggactgtttacaccacaagaatcagcaaattatgcaaataatggttttgttgttggtttgttttttcttcctcagggatccaatttaccagcacaccactgaataaaagtctaaatcatgtcatctactacagaaggaaagctgttttcatttccactcaaaagaaaattacagccatgaacttcttgaatccacataagaaatgatctcaatattaactccttctccaccacttctaccactcctccttcacatacattattttttcggggagtatagctcaggggtagagcatttgactgcatatacattatgtttttggtggtaataccatctacctaagtctccaagtccaaaagcctttgccttccagtcaacttagacattcatatgcaaataatcactaaatactgccaatattacttcctaaaaatccgtcaaatccattttcccttctctcccattttattttctagaaaaattaagccagctgtactctctctaatatatggtagatctggctgttacttcatctgaattgcctttttaccccaccttgtttacatggcaaatttttcttcttcctccaaaattaatttcagcagttacctcctccctgctagtagccttccctaataatgccagataaaatgaattcctcccctttctctgtgttacctccatgccttgtaaactgatcacattttacagcaatttaattgtgtttatgtctggtcctctattacgctaagtcccttgaagacagtagtatgttttattcatttgcgtaacccagcatctagcagtgtgcctggcacattataggcaccaataagtgtttgctaaaggaataaattgataattttccaggtatctttgttgaataaactgatgccaggagctgagatagagctagttcctagtaagaccctctattcctcccttacgtcaggcccccccacccacactcccaaccttggcaacagtaactgcttgcaggactgatcccatcatgacctcttttcccacttcaatcaattatgacaggatgctcagtatatccggctctccctcacctcccggacttccagatcctcatggatcaaatgtaagcttcgcagtgagttttcctgaacaacactgcctaaaattgcacctcttttcaccatactcccaccctcccaaagctctccattcccctgctttgctattttcattgcacttatcactatccgctaaacgagtatttattatctgtctatttatttgcttactgcctatctctcaccggcataacataagctctgtgaagccagggatatttgtttatttcatctgcagctctatccctcctgtgcacagtcagcactccataattatctgttgaataagtaaatgaatcacacgcagaggtgactcctgcctgagataaagctgtcagtagcaaagttgggaggagaacctaactcccaacttaattgggaatacaaaagctcacactaccctgcccaagaggtgccctccacttcaggtcagcaggttctacatgcactattcaacatttaagtaatgcccacgtaagagttaaatgtcagtaaaactgtcataaatgaaaagcctacagactgagggtcttgtttgctatgccaatagcagtgtgtccctcttaaaatacagaaacttagaaaatactaacagataaacacagtttgaattaagatgggcataaataatgtaaaaatgacacagccactctgaaagagaatataaaagtccatactcttttaaccaacacattcctgattctcattaatatttggcatacttaccagggcccaggggatgagagattaacagatcacaaaagaaatgtgcaattgttgaattattttgcagttgttttgatttttacacattataaaaggatgccatgaatacggatattcaaatgaattgaatcacaagtattatttatacattctagtcagagccacataattatcgggggaaccagcccccaatatttcaatgtaggttctttctattttccctaagagttggccagtctaagaaataaagagagtacaaagagaggaattttactgttgggcctccaggggtgacatcacatattggtagatccgtgatgtccccttgagccgcaaaaccagcaggtttttattaaggactttaaaaggggtgggggtgtacgaacaaggaataggtcacaaagatcacatgctttaaagggcaataaagatcacaaggcaaagggcaaagcaaagatcacaaggtaaagggcaaaattagaattactgatgagggtctgttttcagctgtgcacatattgtcttgttaaacatcttaagcaacagaaaacagggttcgagagcagagaactagtctgacctcaactttaccaggacgcgatcttttccagaccttaataagcctgagggtactgcaggagaccagggcgtatttcagtccttatctcaaccgcatcagacagacaaccccagagtggccgtttatagacctccccccaggaatgcactccttccccagagtattaattattaatattccttgctgggaaaagaattcagtgatatctttcctacttgcacatccgtttataggctctctgcaagaagaaaaatatggctgtattctgcccgaccccgcaggcagtcagaccttatggttatcttcccttgttccctgaaaatcgctgttactctgttttttttcaaggtgcactgatttcatattgttcaaacacacgttttacaatcaatttgtacaatagtggtcctgaggtgatgtacattctcagtttaagaagataacaggattaagagattaaagtaaaaacaggcataagaaattataagagtattatttgggaactgataaatgtccatgaaatcttcacaatttatgtttctctgccacggctccagctggtccctccattcagggtccctcactttcctcaacacataataccgatgaattattgaggagaaaagtactgcacagagcttgatgaaatgtgtgtgcttgtgacactgtcagtaacatgacaaggcatttttagaaatatttgatctgtcatggcctgattctctagctttacatctttgtaaaatgaaagtaattggaattatatgacagtatcttacctatgctttgagctattttggctcataaaatgaaacctcatctatcacttcatattttatgcataatgccaaaaaagcaactaagtcaccagtgttgcctgatgttgaaaagggaactttgctacaaccagctgcctaaacagccaggttgccagaactcatgtggctgactgctgtttccaggttagcagataaattcaggaaagtaagcagcaaatgacttcagaatatttctttggtaacagcaacagtgctcatcttttttgtttgactactgatctatatatattttaaaaaattataaatatgaaagtatttaattccttaatgtttccatttattcccaaatgagatacaatttgggacatatgtaacttaacacctagagcctgaaattctattttctaccatgaactgtttaagcaaagaccaatccatccaatacacagaggggtccaagcagatgacctggctcctccccagggtgatactctttaaatatttgtttaatatttatttagctgagaaactgagatttgcactgaagagaaacaggacttcaggtagcagggacccaatttgcaaactcaacttagtaaaccagaagtcctgcagttaactcagcccattctttctgaaggcagttaggtggccagttgttgctactggatatgatccatcatatgtcaacacaatgccccccaaaaccttcaagtagattctctgattagtattccaaagcaaacataaaagagtttttgagaaaacctatgctaaatttaattttcttcatcttgtttcatgagtttttggagctccttattcatcagtgccatgggccactgtaaacggacctgcctctcaacccagtgaaaaaccaagtaaccttaggatgctggattccttaccctagtgtctccagtaagttctcatcagtcagtttaaatacctccagtaatagcaaactcaccatttcctgagacaacaattctatatttacacaagtttattatccataaaattcttcctttagctaagtaggaatttacttctcaatgactttcaattactagttctattaatatgtttgccctgtggaagaacacagaaaaagtatgctcccccttccatctcatggcccagaaacatctaagaacggccatggtatgccctcaaagtttcacacccccagttccctcaagtattcttcacatgaacagattctcaatcgctattctcatcagtatcctctacatattttattgttgttttctttctgttctttatataaactttaatgctaaaattttcaattagaaagtctttttaactgagtgcatatgagttaatattaagaagaagcacagagctgctaagccagtcttcaggcacaatctagtaattcctcatccattaggtccaggattttaacagtgatggagaagtgagagttaatttagtatctgttagctggttattctgccaaccagatcatcagtgttgcctgattttaaaaagggaagctcaggagcttcagaaggaagctaaattatctctggaaatattatccaagtcgccttaaagtttcaattcccttaatatacacacaaaatttgatttatgcaaaaattttaggaacatataaattatacaaaaagtgtagtacaactatagtcaacatattttgaactctcattaacctagacatttaggagggttccctgattgaagagttcatttattcctttactcagctatttaatgagcacctgctatgtgttgggcagtgttctgaacaatgggtatacaatgatgtacaaagtcaacaagttctctgccactgtggagcttgtaaagtaagagaggcaataaacagacaggcaaaaggggttataactgtgccatggtgaaagataacaggccctattgagggtgatcagagatttgtctgcagagatgtcttctgagaagagggcttagtgtgaggagaaagatactaccaggtaaaaggaacattatacacaaaggaagctagaaagagattggcatttttgagaggtagaaaggaaggtcagtgcaactggagccaggtcaacaacactagagaagcaaaaagggcttcagaaactatggtagggacttacaactggctatgggcagagctatgctttgaatcaaatgtaatctgcccccaaactttcaagcgcattctctgcagttgccagatgaaattctttaatcttcagtgaacacacataatataaaatttgggtaacagtatggtgtttttcaagaagctcatttgaggaaactcatttggttctcactgcaaacctacaaggattaagtacactaaagaaaactgtagtatactatggaaaattgagtacatgacagaaaacatgtagtttccatgcttcaggtgtaatttttaatcttagtcatgtggctaagtaattttttttataaaattgctctagatattaagaatagttgtttaggacctaatggcaaatcaatatgtcagagggaaaaacaaataaccaacacatcaaattcttaaagttaaaatctcacttcaggagcatggaatatctctgcaatgtactggaacatataagcaagctggagataatctgctgggtctcctccatttcaattagcctgttttgcagtacatgatgtgtacatttattaaaagcagacacagtctaaaagagaaactgtgaaagctcattgttataacatatgatatagttgatcaggatctgaggtctcaaaggaatcaagttaaaaactataacatttacacataccattataatatttttaaattaagttttaaatagtattatgtaggtattgtctctaggatgaaatacaagcaaatcttcattatttggttagcaggggaaattagtatgatgaatgatccaaaataatgaaatataaaagaaaaatatatttgactttagaatttttttttataatacattttacttctctgaactcactttgcttattaaatttagcttgcagatcccacacatacactaagtgacagcaagaagcattggtctgaaagtgcaattataaaattaaatataataataaatgcagggccaggagtggtggctcacacctgtaatcccagtactttgggaggctgaggtgggtggatcacttgaggtcagaagttcgagaccagcctggccaatatggtgaaaccccatctccactaaaaatacaaaaattagccaggcgcggtggtgggcgcctgtaatcccagctactcaggaggctgaagcagggagaattgcttgaacctaagaggcagaggttgcagtgagccgagatcacactactacactccagccttagcagcagagcgagaccctgcctcaaaaaataataataataaatgccacaataaaaaataaaataaggccccaaaggatacttgaaaactaatataataatggatatcattatccatgaaaatagaagtaaaaaattaccatattagcacacttatcaggtcaggggaaaaggaaattgtacctaaaagtgccctgaaaactgtaagcagcttaactaaaaatttacagctaacattcaagtagagattgaattataatcaggagaatgattgaaatgagtttacacatatatatacatatatatatgtatatatatatatatatatatatatatacacaaatatacacatatatatatttgagacagagtctcactccatcgtccaggctgaagtgcagtggcacgatctcagctcactgcaagctccacctcccggattcatgccatcctcctgcctcagcctcccgagtagctgggactacaggcgcctgccactatgcctggctaatttttttgtatttttagtagagacggggtttcaccatgttagccagaatggtctcaatctcctgacctcgtgatctgctcgcctggcctcccaaagtgctgggattacaggtgtgagccaccacgcccagcctgaaaaatatattttaaaaacccaatcctgcttacaatagctacaaaaaacactttggaataaacaaggaagtgaaagatctctacacaaataactataaacattgaaaaaaattgaagaaggcacaaataagtggaaagaaatggatgttcatggttggaagaattcatattttcaatgtgtccgtactacccaaagtgatctagagtcaatgcaattcctatcaaaataccaatgacatttttcacagaaacagaaaaaataatccccaagtttgcatggaaacacaaaagacaaaacagccaaaccaagcctattaaaaaaacaaagctggaggcatcacactacctaacttcaaaatatactacaaagcataatgatatggtttagctgtgtccccacccaaatctcatcttaaattgtagtttccataatcctcatttgtcataggaagtactcagtggaaggtaattgaatcataggggcagttacccccatgttgctgttcttgtgatagtgagtgagttctcatgagatctgatggttttataaggggctttccccattttgctccgcacttctccttcctgccatcatgtgaagaaggatgtgtttgcttccctttccaccattataagtttcctgaggtcttcccagccatgcagaactgtgagtcaattaaatctccttcgtttgtaaattacccagtctcatgcagtcctttatagcagtgtgagactggaataataacacatagtaactgaaacagtatggtattggtataaaaacagtcacatagaccaatggaatggaaccaagatccaataaataaatccatgcctttacagtaaactggtttttgacaaggtgccaagaacacacaatggagaaaagacagtcatttcatgcaatggagaaaagacactcaataaatggcattagggaaactgcctatcaacatgcagaagaatgaaattagactcttatcgcataggatatgcaaaaatgaactcaaaatgggttaaagacttaaatgtaagggcccaaactatgaaactactaaaagaaaacatagggggaacctatagcctggttaatgatttttgggaaatgatcccaaaagctcaaacatcaaaagcaaaagtagacaaatgagatttcatcaaactaaaagcttctgcacagcaaaggaaataacagagtgaagagacaacctatggaatgggagaaaatatttgcaagctatacatctaataaagggttaatatccaaaatacataaggaactcaaacacctcagtagcaagaaaacaaatcacctgatgacaaaatgatcaaaaaaacctgaatagacatttctcaaaagaagacatataaatggccaacaggtatatgaaaaaatgttaaacatcactaattatcagggcaatgcaaatcaaaacctcaaatcccaccactgctttatcaaataagttaaggtaatattcaaaatcttttgttgtcatttcagcaatgttcacagcagcttcaccaggaatagacttcatctcaagaaaccactttctttgttcatccataaaaaagctactcctcatccattcaagtttgatcatgagattgtagcaattcagtcacatctttaggctccacttttaattatagttctcttgctattttcacaacctctgcaattactttctccactaaagtcttgaacttctcaaagtcatccacgagtgttggaatcaagttcttccaaattcctgttaatgttaatgttttcacctcctgtcatgaatcacaagcattcttaatggaatctagaatggtaaatcatttcctaaaggttttcaattttctttgcccagatccattagagaaatcacaatctatctatagcagctacagccttatgaaatgtatttctgaaataataagacttgaaagtcaaaattattccctgattaatgggctgcagaatagatattttgttaacaggcaagaaaacaacattcatctcctcttacatctccgtagagctcttgggtgaccaggtgcattgtcagtgagtagtaatattttaaaagaaatctgtttttttctgagcagtaggtgtcaaaaatgggcttcaaaataatcagtaagcagtttctctaatgccatttattgactgtcttttctccattgcatgaaatgactgtcctttctccattgagtgttcttggtgcttttgtcaaaaaccagtttgatgtaaaggcatggatttatttattggatctcgattccattccattggtctatcagtaaacaggtgtgctgtcatccaggcttttctgttacacttatagagtatgagtagagtagatttagcatacttgttaacggccttaggattttgggaatggtaaaagatcattggcttcaacttacagtcatcagctgaattagaccttaacaacagagtcagtctgtcctttgaagttttaaagccaggcactgacttctcttctctagctagcaaagtcctagatggcatcttcttccagtacaaagctgttttgcctaaactgaaaatctgctgtttagtgtagccatctttatcaatgatcttagctaaatcttctagatgacttgctgcagcttctaaatgagcacttgttacgtcatcttgcacatttatgtcatggagatggtttctttccttaaatctcatgaaccaatctctgctagcatcaaacttttcttctccagcttcctcacctcttccagccttcacaaaattgaagagttacaatcttgctctagattaggctttggcttaagagaatgttgtggctgttttgatcttccatccagaccacaaaaactttctccatatcagcaataaggctgttttgccttctaatcatttgtgtgttcacggatgtagcactgtttgttgcctataagaacttttgctttgcattcacaattggctaactgttgggtgcaagaggcctagctttcagcatatcttggctttcaacacgccttcctcactaaacttaatcatctctagcttttcatttaaagtgagagatatgccactcttcccttcacctgaatacttagaggccattgtagggttgttaattagcctaatttgaatattactgtgtctcgcagaataggaaggccccaggcgagggagagagacaatggaacaatagtcaatatatggaatcaacctaagtatccactaaccaatgaatgcataaagaaaatgtgatacacacacacacacacacacacacacacatatacacaatggaatactattcagccataaaaaagaaaaaaatcctgttatttgccacaacatggatcaacctggaggacacttcgttaagtggcgtaagtcaggcacagaaagacaaataccacaggatctcattcatatatagagtatttaaaatttgatctcattgaaatagagaatagaataaaggtgaaaagagactggggaagttcaagggtgaagattggggaaatgttggtcaaatgacacaaaattacagttagctagggggaataagttaaagagatcttttgtatagcatggtgactacagttattgataacatattgtattcttagctggtcatggtggtgtgtgcctacagtactcccagctagctgaggggctgaagcaggaggactgcttgagcctaggagcttgaggccagcctggacaatatagcgacaccccatctctaagtgtgtatatatatacacacaaatatatacatatatacacacatatatatacacatattaatgtatatatacacatgtatacacacatatatgcacacatacatatatgtatgtgtctgtatatatatgtacacacatatgtgtatatttgtatgtatatgtgtatgtgtagtattcttaaaaaatgctaaaatgatggatgtaaagtgttctcaccacaaaaatggtacaatgtgatgtgatgtatttgttaatcagctagatttagccattccatcatgtatgtatacttcaaaacatcatgttgacacagtaaatgcatgcaattttatctgccaatttaacataaataggaattcaaacacacagaaaaaatgcaacttattcttgtattactattctaaaactttgtaacattttaattcagaaaataattgatgttatatgtgaataagtaatacatgctttgaaatttttttaagtgtatacttaatatttcaaaaattccatgatatacttttgattgatgtacttattgaaattatccctgatcctgtttgatattgtgctggatagcctctgtctatctctctgtgtctacactttggccttcttgccctgctctgcctcccagtgttgagtggaagaaccacccaacatctatgtatggttcacacttgctttaaagtataagatttgggacttttgaactgatgagatttagttgagattctggatctcatccaccatgctcacatgaattatgcacccttgtcctctggttgtggatgagttcatttgatgagaggcactggcagatgggagggtgggaggtgagtgaggtcagggtatttatccttccttctctctcactgcaagactgaagggttggcagtggccgtgctcctctgcctagggtcatagcacctggcctgtccaagaccctttacccatagatacaactctctctaactctctctaggtgctactggccattattccccttcaatcttgggtggtggaactgtatccccgtatcatgagaccctggtgcctcccatcacttatttgttctcttaaccctgcccacagctccataaatagtctcttcaagaaactctcttatcacccctttgagtgtgttgtctgtcttatgctggatcctcactagaacagctattatggaattcctctgatagcatcaatctaacattgtgaataattttttcccataaataaaattattccagattttcaaaacatttctattttcaaagaattagaactagccatgactaatgtggctaataacaaccaaaataaaagggagtcatttggataattttttttctcctaggacacttctgctataaccaactcttatcactgaataatctgggttccgaaatacctgtcatcgccatcaatgatgcactcagggaaggcgagggtacagccaaacagcatgatatgttgatagcaactgaggcgatggagatatgtgaaaaacttgaggaacttttccatttccatgtttctgacaactgagaggagaggtgtcagcgtggcgtggtagggcagcatctgacactggctgtgggtgatgttcatacaggcacctgggaagtaaagacatgcacatttaagagtggacacatcagaagtatatgtttgcaaactcatttaatatttgtttataagataaagtatacttatcacaagaaaaaatttagatatgcaatcatacacataggtgcatgtaagtatgtgtatgtgtatgataatgaaatcaagctacaaatatttacagaggaaaagcattcgtgtcctgggaaaatgtgtggaaaatacatactcctcatacatatctagtaggcatataaactggcaatcaccttttcttttggatcacagctgggcagggcaatatgtatccaaaaaaatcttttcaccatgcatattctttgacattatcaagtcatttctagaaacttatcctaaggaaataatcatatttgtgaatgtggatttatctacggggatcttgatctttgcatagtttacaatttttaaaagatagaaatcatctaaatattcagcaaaaagaattgttctttagaatatggaacaaacaatagaatatttaatttaggtacatgaaagatgcttcagaagactatttaatcacaacggatgatgctcataatataataagtaaaagtaggaagtcacaaaacaatttgtatacaatgatcttgtttttaaaacacacaattatgcaaagatttgtaatcccgcctatgtcaacagttcaggagcagctcagagcctctgacattatcttctcccatagttggctcttttgggcgccaccatatccatggcttttccattgccttcatgccagaaatttgcctggttgacccgatataaacaaaaatgttgacatgcattcatatgatgggattttaggaatcgaccacattttcttttttattccttattctcttgtctgtataaagattcattgcttttattgttgctgcttaaacaagattctcttattcacaatcgcctcagtttcaagacccagttacatgaaatcatatctatattatacatgagaaaactcaatttttagaaggctaagaaatttgcctagaggtgcatagccattatgtagaaatttcagatctgaaacctatgtcttctgagtaatttccattacttagagctaatgtagagggttatgttaaaaatagttcttgagataattcttaatggctcatgaaaggaagaggctaaaaagcatataatgacatatctcaaggtctgtatgtatagtaatatgtaatacacctgtatattttgaccacacctttttatcagttttaattacattattttatttaggggttatcagcttttgggcttatgcttttgatggaagcccatatttgaagcaattagaatactaaaaggctcattccctccacccagccaaagaaaccactgaatattaagagatcattttaaaaatgcaagatagaaaacatcctaggggccgggtgcggtggctcactcctgtaatcccagcactttgggaggccgaggcaggcagatcacgaggtcaggagactgagaccatcctggttaacacggtgaaaccccatctctactaaaaatacaaaaaattagccgggcgtggtggcgggcgttgtggggggcgtggtggcgggaggctgaggcaggagaatggtgtgaacccgggaggcggagcttgtagtgagctgagatcgcgccactgcaccccagcctgggcgacagagcgagactccgtcccccaaaaaaaaaaaaaaagaatcctaggaattttcccatattagcatttggagagcttcactgtttcctttactgctgcataacattccactatatgttgtactgggatttatttaagcaatctccctttaataaatatttggactgttttcaactttttgctattatattgctgtaataagtaacctgtacatatgcctgagatgtacaatagattcccagaagtaggattgctgggtaaacggataaatgctttcagaattttggtagctattgtcaaattcccccatcatcgagaagtaccattttgaattctcgccaacaatgtatgaggatgtctgctttctcagtctcaccaacagagaacagtgtcaaacttttggatttttgctaatctgataggtgagaaattatattgtagggtgatttttcatttgcatttaacttgttgccagtgaagttgagcaccttttcatatatttaaggaccatttgcattttgtcttcagtttcatatgcttggaagatttttcctactgacttttaggggtgttttttctacttttacaaactccttattagggagattaatgtactgaaaatattctaacactttttctatagttttgtggttttgaaatcattttaaagaactaacaactatataatcatttaacagatgaatatattttattctactttaatccagccgttgaaatatttaaagggggctttctttgaaaagtagccggttcagaggcagagctcaaaatcgaatctggagtaaggtatgataatatctgacatttcagtacccctttgtagtttacgaaccacttctacccttatcttttaaggttgtattagttaggtttggtttggctgtagtgaaggaaaatggaatataacattgctttaagcagaacaaaatttctctgccccataaaagtctagatgagtggtctaggacaggaattggatcccgtggtgccagaaacataggctctttatgtagccctaacttcatggcccaagatagtgaaatctacagtccagacagaagggtggagaagtagtaaagaggacaaagacacacactcttactatttcttaagaacagtttcagctgctacaagacccttccacatatatcccattatccagaatgtcgtcacatggccacatctagttgcatgagaggctaggattattccagtttgacatgtgcccagataaaaatggggagtgggatcaactacaaacgaaggagaatgaatactggtgttcaaccagaaacctttgccagaaaaacaaatagagaaggcatcattatactcattataaaagaaaacaaaggccgggcgcagtggctcacacctgtaatcccagcactttgggaggctgaggtgggcggatcacctgaggtcaggagttcgagaccaccctggccaacatggtgaaaccccatctctagtaaaaatacaaaaattagccgggtgtgatggtgggcgcctgtaatcccagctactcgggaggctgaggcagaagaattgcttaaactcgggaggcggaggttggcagtgagctgagatcatgtcactgcactccagtctgagcaaaagagcaagactctgtctcaaaaaaaaaaaaaaaaaaaggtacaactattttcctattcaagatgtttgattaagcacatatcctccctcctgacatttcaccaaaaaaagaatagtaaaggggaaaaaggcataaactcataacagcaaagagcatggagaggggcttccatcagaagataaatatttttagcaaatttctgccagccaaaaagagcatgcaagaaattttgaagtttgtggaagaggatgaagtcaatctgcccagcagaacctaggagaggttctgggcttgagttgtcagataaggcagagaagaacaaaaactggaactaaaaaagggagatattaaagatctgtatatgaaacaattgctcctcactccacccacacgcacagaatacaagacagccacaaaattaccaccattaaaaagaaaaaaaaagaaaaatattcatctatctctaaagaaattacacaatggtctgaaaactgagaaagctggtatggctattggtaccacagataaggttaacaataactgaaaatgtcgctctgaaaaaatagaaatagttcaagacagaagagaactttaaaaaaatcatcaataacttcagagtaaagtgcccatgtaatttatcatcctacctgagaaaatttaaagaatgataacaatgagctattaatagctatgccaggaaaataaatataaaccatgactgtctcctatgagccaagatatatagatttaaataggtattgcatccataaatgagaataggatgctaagaaaaagaaaactcagaagagaaaaccttacaatcgacaccacataaatgcaaaggatcataagagattactataaataattatacaccaacaaattagataacctagaagaaatggataaattcctgggcacatacaacttaacaagactgactcatgaaaaatcagaaaatctgaacagcccaataatgagaaaggatattgaacctgtcaggcctctgagcccaagctaagccatcatatcccctgtgacctgcaagtatacatccagatggcctgaagtaactgaagaatcacaaaagaagtgaaaatggcctgttcttgccttaactgatgacattacctttgaaattccttctcctggctcaccccggctcaaaagctcccccactgagcaccttgtgacccccatccctgccctctggagaacaacccctttgactgtaattttccactatccacccaaatcttataaaacggccccacccctgtctcccttcgctaactctcttttcggactcagcccgcctgcacccaggtgaaggaaacagccttgttgctcacacaaagcctgttcggtggtctcttctcacggactcaagtgaaagaaccagtaacaaaaagtcttccatcacagaaaagcccaggacctgacgtcttcactattaattccacaaaacatttaaagaactaatatcaattcctctcaaactcttccaaaaaactgaagaaaagtgaacatttgtaaacacattttacaaagccagcattgccctgataccaaagccagacaaggacactacaagagaagaaaattacaccttaataactttgatgaatatagatacaaaaatcctcaacaaaatgctggcaaaccaaattcaacagcacattaaaaagatcatttaccatgatcaagtggaatttatacctgggatgcaaggatgtttcaacatacacaaattaataaatgtgatacatcaccttaatagaatgaaagacaaaagccatacgaccatctcaaaagacagaaaaaacacttgagaaaattaaacatcctttcatgataagaccttcaacaaattaggtatagaagaaatgtacttcaacacaataaaggccatctacgacaaacccacagctaacaacatatgcaatgggaaaagagaaaagccatcctctaagatcaggaagagaacaaggatgcctgctcttgccactaataatcaacatagcactggaagtcctaaccagagcaattaggcaagagaaagaaataaaaggcaatcaaatcagaaagaaagaagttaaacggtctctgtttgtaacaacatgatcttatatttagaaaaacctaaagattccacaaggaaacctgttagaataagcacattcagaaaagtagtaaaagtagtatgttcaaaatcaacataaaaaatcagttgtttcaatcagaaatggagagaaaaataaacttaaattaaaaataaaaataaaccagttctgcttttatacattaacaacaaactgtacaaaaaagaaatcgagaaaacaatcacatttacaatagctacaaaaaaaatacttaggaataaatttaaccaaggaggtgaaagatcttacactgaaaatgatgaagcattgatgaaagaagtgaaaggaaacacaaataaatagaaaaatatcctgtattcatggtttggaaggattaatctcattaaaatattcatactacccaaagtgatctacagattcagtgcaatccctattataattctaataacatttttcaaagaaatacaaaaaatcctagaattcatatggaaacacacaaaaaacaaagaaccaaaaaaaaattgagcgaaaagaaaactgaaggtttcacactacttgatttccaaatacactataaagctatagtaatcaaaaaagcatgatattggggtataagcataaaaccaatgtaactgaatgaagaatccagaaataaatccacacattgatgaccaattgattttcaacaaagatgccaagaatacacaatggggaaacaacagtctcttcaataaatagtgttgaaaaaactggatataaagatttagaagaatgagattagtcttattttacaccatatacaaaattaactcaaaatgaattaaaaacttacatgtaaaacctaaaactataacactactagaagaatacatagggggaaagctcagtgacattggtctggttaataattttttgaatatgatcccaaaggcaagggcaacaaaagtataaatacacaaatgggattacatcaaactaaaaagcttcttcccaggaaacagtcagcacagcaaagaaataacttacaaaatgggagaaaatatttgcaaaccatacacctgataaggggttaatatccaaaatacaaaaggaattttatttagtagttaggaaacaataactaaatttaaaagtgggaaaaggccctaaatagacatttcacaaaaaaatacatacgaatggccaacaggtatatgaaaaaaagttcaacatctctagccatcagagaaatgcaaattaaaaccataatgagctattacctcatacctgttaggatggctattactaaaacaaaaattaaaaaatgaaaaaacagaaaataacaagtgctggtgaggatgtggagaaaagggagcatttgcacactgttgatagggttgtaaattagtgtagccattatggaagacagtatggacattcctcccaaaaattaaaaatagaattacaaaacgatccaacaaccccaatactagctgtatattccaaggatgtaaaatcagtgttttgaagagaaatctacactcccatgttcactgcagcattattcacaatagcgaagatatggactcaataaaaatgtccatcaatggatgaatggataaagaacatgtagtatatacacacaatgaaatatgatttggcctttaaaaagaaggaaatcttgtcatttatgacaagatggatgaacctagagaacattatgttaagtgaaatcaactaagcacaaaaagacaaaaaccacatgatttcacttatatgtggaatcttaaaaagttgaactcatagaagcagagagtaaaatgatggctaccagggactaggggtataagggtgaggattgcaatatgttggtcaaaggatccaaaatttcagttagacaggagaagtaagatcaagcgacctattgtacagcatggtgactatagttaataataatgccctgtacactttgaaaattgctaagaaagtagattttaagtatactcaccccccaaaattatttgaggttaaaaaataaaaacagatccaagtgatgttacaacaacttttttcatatttcatgtaaataaaggcagcattttgcattgggaaaaaatgggttatgagccctcacagagggaccaactagactggaaatttttggtgcctgttcctggctgtaccaggaagtcaactcaggtcaggactacatcagcagagtggaataatgaaggtcattctctattctagataattcacctaagaagaaacattttgccagaatgatttctgggaaaaatcaatttgaaaggatatcgtgtacttaggaagatctgtaagagggttacagtaagctaagagaaaacataaaactgaagacagggtctctccatgaagatttaagctttcgtttttaacttttattttaagttcaggggtacatgtgcaggtatattacatagataaacttgtgtcatggggggctgtcatacagattatttcgtcacccaagtattaagcctagtacccattagttatttttcctgattctttccctcctcccaccctccaccctctgatagaccccagtgtgaattgtttccctctatgtgtccatgtgttctcatcatttagctcccacttataagtgaaaacatgtggtatttggttttctattcaggtcttaactaactgtaaaccaaacctaaacacagtaactattctacttctcataagagaaaatcaggaaacaaaagatgcattttcttaatgagtgatttacaacatttgtaaaaagtctttacagacatagtgaaggcacagttaagccaatgtcttgctaagttatacaaaaatatgtaagtattttgtgcaatgccacgtaaattatcagagttaagtaaaagctagctattcttgtcaagagaaatacgaggtttgggagtttattttctatataattgtatatattctagactaaacgctttttaatgcaccccgattctcttggtgatgtattttgccaagcttcaagctttcacattacatagatagatagatagatagatagatagatagatagataggtagatagataattgtctctatcttattcctaaacgcaccttcatacttggttttaagatgtttaaatcataagtaaaggctcataacctgttgcaattcattcattcaagaaactacttactgtgacaatgctttaacacagtgaggggtcaaggtagagaaatgagccgtaatataggcctcggccgatgtgtaggaagaggcagatgaagaatattgaggcgccattggcgtgaaggtagcggatttctttgtaaatcaattattcacattccatagaattaagtgagacttaacattgcagctgtagcagcatctgtcaggcattttttataaattttgaaagaactacaccttgccccataaaatcatccatcctagagttatgaatgaatgataacaataattaaaatgtatatagtgtcttcaagtttgttaaacagttttctatacataatatggtggttccacagtctgattcaaaatcctggctactattttatatttctgtggcctttggcaagttattgaactcctctgtttatcagtttcctcatctgtaaaatggaaataataataactgtgtaataggtttattataaggataaaacaatgcttacacaatgtccagcacatagtatgtgataagaagtttttgctattattattatctcatttgtgactcacaaaaactctgtgaactagacaggggagagatttgtatccatgttacataggtaagaaaattgaggcagaaagctttcattctgcttttttcttctggattctataatgtatccatttataaagggaataattattcatttatataggaacaaaattcaaaattgaactacttagttttgcttacttgtacaataaaacaatgctgggagttataatttttttttaaaaaagtaagcattttaaaacattagtcatttaaaaatacgtattgagtctctactatacaaaggcacttagtgctatagaatgtttttaaaaaaagaatttggaattagaccacatttcacatatttagccaaaatttaacacatatagaaattatttgtttttcatgccaacagtggtaaaaataaattctataatgatgagagtataaaaaattacttactggagcaacatgttcaataaggaaaggatttattgtaaaatccactacctcactagtagtttgttttaaatttcaccactcatgaaggtgatgagatctcagtagactttcagccctatgtagtttattgggaatctcatttagtaatagttaagatttgagtacgggagtaatgaattctaggactaacagggcaggtctgcataccaaagcctggattacaccagctgggtattgtggtccttaatgtatttgtaaaaggctcatttaaataacgctctctaattcagaatcctctaaacttaaaatctatcataagtcagaatcaagttgagcaattgtttacctttttactctctgactctgcaaaggaagattttatggagaataagatcgtaaggaaaggcatgttctacatactcaaaaggaaacatttaaaatgaacttctagtctccttaaaatacacataaaacatgtcatttctttcttttaataaatataccttttatattctaataaatataccttctaggtatatttagtatataaatgtatacctaggtatatatatttattaaaaccaggttcattgatttgaaagataaaaggtatatttatcttttatatttattattaattactaaaagataaaaggtatatttattatataccttttggggagacaaacattctgtccataagattgatctataattttcattttcatattgtctttgctttaaatatctagtttctacttgattcaaaactacctatcggcattttctattttctctagaatattttgcatttaatggtgattaattgttccttaaaagtgtgataaaacttgtctataaaattatctgggattttaaaataaatttttaaaagtaagaatgatttttataggtagttttaaaactactgattatgatggcagcggtggcccatctggagatgctgagaagatgccagctgcagtgcgggaggcatggccagggctgcatgctccactggccgaagtcggtgggagccgggaacaggtgggagccccacccccttctcagctggcagggcaggagccctgcactcccgggtgtgaaagtatgtttagttcatattattaaacatggtttctttctgggtaggggaatttggtatgattttttccttcttgctttatgcttccagttttctatattgcttaaattaaatagtagatatataattctgataaataataaaattattatttttaaaagagcttttaaaataaacttaaaaatatgaccatcttctccgccataagtctggcttgtttttggtgagggatgtgggagtcagcacgaaagggaaattgtagtacatgggtcaaagcaaagaggaaaagggagcaagtagactcttcctgacctttctggctagtattttctgagttcttatcatgtgccagactgtaagactagccccattgacaagtcttgcagtggcttcttctataaaagcagcagcaacctcaacaaagaaggaaatcctgccatatgatatggtatgcatgaaacttgaggacattatgctaagtaaaataagccagtcacaaaagggcaaatactgcatgattccacttacctaaagtatcaaacatagtcaaactcatagaagcagaaaagcggaatgatggttgccagaggttgggcagaaggggaaatgaggagttgctaaccaatgggtatagagtttcaggcgtgcaagatgaatgggcacattaacaagtgtaatgtatactcaaaactttgttaagaagttagatttcatgttttctttttaacaataaagaaattagagataggacaagatggctgactagacgcatacaagtggaacagctcccctggagggactgagatgactggcatgcttttttgttgttgtttttttaataattgtctcatttattatctttctttttttttcatatatactttaagttctagggtacatgtgcacaacgtacaggttttttacctatgtatacatgtgccatgttggtgtgctgcacccattaattcttcatttacattaggtatatctcctaatgctatctctcccccctcctcccaccccacgacgggcccccgtgtgtgatgttccccatcctgtgtccaagtgttctcattgttcaattcccacctatgagtgagaacatggggtgtttggttttctgtccttgcgatagtttgctgagaataatggtttccagcttcatccatgtccctacaaagtcatgaactcatccttttttatggctgcatagtgttccatggtgtatatatgccacattttcttaatgactggcatgctttaaacagatcttcagagggaaggtgctgagggtggatggagggaagacacagaagctcagctgaagagggagaaagttggcacctgtagggccaactctactgggaggttgacagcgtttgatgtgtccccaggcattttctgcttcactgcttctcatgattggctgtgatatgactggccagtacccaaactctagaataagctagagaaactctaggaaaaaactttagatttaaggtttccatttctatggatttggggctttgtcttttgttttttggggtttttttgagtcaaggtttcactctgttgcccaggctggagtgcaatggcgagatctcagctcgcttcaacttcaacctcccaggctcaagtgcttctcccatctcagcctcccaagtagctgggggtttttttgagtcaaggtttcactctgttgcccaggctggagtgcaatggcaagatctcggctcacttcaacttcaacctcccaggctcaagtgcttctcccacctcagcctcccgagtagctgggactacaggcactcctcaccatgcccagctatttgtattttttgtagagatagttttgccatgttgcccaggctggtctcaaactcctgaattcaagcaatccacccacctcagcctcccaaagtgctaggattttggggggtttttttgagtcaaggtctcactctgttgcccagactggagtgcaatggtgagatctcggctcacttgaacttcagcctcccaggctcaagttgctgcgtgtggtatgagccaccacacccaaccaggtctccatttctttcccacagcaacctcccatattattcatttaaaaaaatttctcattaactttaaaggacatattatatggtaacatagttactgtggcttaacagccatcaggacatcataaatcagtctcctgaaatgcacattctagaggattatattgagtgcatatctataaacacatagccacaacaaaacagactctctgagcttgagtacttaaaacacaatggaggaatttggaggccattccaatgagaaaattacaaaattttatatctcccacttcctgaggtgataacattcccattaatacctgcaacagcaatgttggccttcccatactctacagacaaaattgaaaactaaagtctctgttcaattgattcaagataattattaaattttaaaatgaagcagtttaatctgtttaaaaatagaagctccaggatagacctttaaattaaaatatatttttgtccttgtaaagaaaactttacaaaaaaagttgtatttattatagaattaaaatggtatgaattagcaatattatattttagaaaaataaaaagaattgaaatcgatcatgtttgtttctgagcctgtcttatagaatttctcactttatttctcaagttgtaagaatatgttcatgttgcaaggcagttagtagacaactggctgcttggggacaggacttctgtcttatccatctttatagtccatagagccaaaacctggagtatgacatccaataaatagctactgattaacaaatggtgcttcacagaatattaacctagattctccaaaatttgagacatctcatacaatttagaaaagtacacaggcatgagaatgggtttacacagcttaatataattacaaacaagtactataccataagtcttattaattcaaacactggccaggcgcggtggctcacgtctgtaatcccagcactttgggaggccgaggcaggcagatcaagacgtcaggagttcaagaccagcctagccaatatggtgaaaccccatctctactaaaaatacaaaaattagctaagcgtggtggcacacacctgttatcccagctactcgggaggctgaggcaggagaatcacttgaactcaggaggtggaggttgcagtgtgccaagatcgcgccattgcactccagcctgggtgacagagcaagactccgtctcaaaaacagaaattcaaacaccacatgtgaatattagattaatgatctggagcagcaaaatagagaataaaatgtgttaacactgaaacacaagaagtggattgcgtcaaattgaaaagatgtaaagcttttggtttggaaaactcattaccttactcatttcagctacaagtgaaaaggcatattttccaaaggcacaagtaacagcaaacagattcccactgatgggttttttgctctcaacacaaaattatacaaatacttaaaacctgagacagtcaacaaattgaataattcaggcaaaagattacatacagtgccaattttctttcagaaccagaggaaaaagtaaattacatagtttgggtttttttggttttttgatttttgttttgactttcatctgagcctttgacttttaaaagatcattttgaccagtattatttttacaatgctgttaacatgctactgttttgcttgttttcctttttttctctctgtgaatcaaaggtattattaggctgttcttcctaaagaggaaattgtgataatgaagctggagagaaaaaatttgagccacaagcccttttgatgtgactgtttgactctcacttgctgtatgtattaatatggcataaacatataagttttgggggcatttgtcacctgggggatattgcaggattcatttaggagagagggtcaggagtcttgccaagacatctttgaaaaaggaaatctaggactgtacccaaaggagagtgaaacagtcactgttccattactgctttcagaagcctagttctgcagatgactgagtttgctctttctgggaggaacccaatacatcctagggaaagaatcatctaaagatggaatgaggaggaagggaaggaaatcagggaaaagagaagaagagaatccattcttatattcgagctacttttctctctctagaattgtgcaagtctttactagaatgctgacaaccaaacaagcatgcaacgattacttaaatgttgcactcattcttgcttagatgttgctgttagccagaagcccatgtctgaatctcataattgttctttcagaataaaggatatgatttaatatatagaggagagaaaccaactggacctgaacaatgggggtctaacactagtgtccaccagagcacatgggaatggcgtctagaggtcatgactacagtgacttttggaatatcactaagaccttgagaagcagcttaggcagacttcagaccctccaaggtaccaacaaaatatttttttcctctacagcaggtgcccataatcagaatccaaagaaccaatggcccctacataaaatttaggctgtctatgaacttgtatggggaaaaaataacatctccatttccaataacacccaactgaaatttagtataattaaattgccaatgtaggcaacaactatagaaaaaattagaaatcagatatttccatcaatatagagttgttacaaacatttcaagatattatttatgctcatccctattataaaataatggttataggtcgagcacagaggctcacgcctgtattcccagcactttgggaggctgaggcaggcggatcactcaaggtcaggagtttgagaccagcctggccaacatccttaacgggtaagagatttaccagatttcagatatctaattagactccctttctcaaactctcctctaagatagttgcctgatgagtagtaatccaggtaaaactccaaggcctgctctgatcctcttagctgcatattcttttttttttcttttttttttttcttttttagatggagttttgctgtttcacccaggctggagtgaagtggtgcgatctcggctcactgcaacctccgcccccaggttcaagtgattctcctgcctcagcctcccgagtagctgggattacatgtgtttgccaccatgcctggataatttttgtatttttagtagagacaaggtttcaccatgttggtcaggctggtcccgaactcttgacctcaggtgatccacctgcctcggcctcccaaagtgctaggattacaggtgtgagccaccgtgcctggccagctgtatattcttgtagagctcatgttaaagctaatgaaaacatctcatgttaaaaacataaaactaagaagaaagaacaacctaagggttttgaattggtgcgtaagctttctacacccagtaacttttgggtatgagtttagggcatttcggtccatgtctagttatcaatgtaaataaatcactgcaatttagacagcatcatggtcatcatccaaatcattttttcttcagaaagaagactatgtagttcactgagggggaaaaagctagatataaagtgaattcccattattggggaaatggttgaaataaattatggtataatgacaacatggaatactatttagtcattataacaatagattagaattaagctattgccttgaagatactaacttgaagtattcttggatgggaaagatattttgtaaaaaaaaaaaagtaataaaaacaatgacccaaatcctctatgtgaatattatcctgtgtacatgtatgtgtatatgttcatataagattgtaagaggatggagaaaactataaaatcatacatatttggctattaggttcttcttaggcagaggaaaggagaagaaatgaaggaatttatgcaaaaatgggaaataaaaacttcaattacaaataacatatatatcataatcacattcatacattatataaaagagaaaaatcaattccccatattgaaggaaatgaaaaagaagaaatcagagtgaataaataaggtaaaaacaattgaggagtaggaaataatcccagaacagcaaagtaagatcctccaaaaatctactcctccacaaaagcagtgaaaacactgggaaaaaaaactgtcaaagttaatttttttttactagagagcatctggaaagatggtgggataggaaacaccagcaatctgtctccccacctagacaacaattgcactggcagaatctgtctgatataactattttggaactctggattctattgaatgtttgaaagtttcagaggtgggacagagcagttaaaggaacagagtttttgtttgttattgaagttaaactggtataaattcaagttagagtgctgtaactttaagatgttaaatatgatgccaatggtaaccataaataaaatagctatcgaatatatatatatcctttgagattttatatatatatatatgacaaaggaaatgaaaaaggaatttaaacgtttcaatattaaaaaaaaaactaaacacaaaagaaggcagtaatccaggaaatgagggatgaaaaaaagctacaaggtatataaaaaacaaatagcaaaatgacagaagtaggtcttcatcagtaattactttaaatattaatggattaaattttttcaatcaaaagacagagattggcagaatgggttaaaaaaaccataatccaactatatgctgtctaccacagactcactttagattcaaagacacaaataggttgtaagtgaaaggatacataaaaatattccctgcaaataataaccaaaagaagagagtgggatgactcacttatgatggtttgacttttataatttttcaactttacaattgtgcaaaagtgacacacatttaatagaaactgtattttgagtactcatataaccattctgtttttcactttcagtaaggtgtacaataaaatacacgagctgtccaatatgttattataaaatagggtttgtattagatggtttgtccaactgtaggctaatgtaaatgttctgagcacatttaaggtgaaggctaagctaagctacaatgttctataggttcgatgtattaaatgtatttttgacttacaatagtttcaacttacaatgggtttataaggatataactccataataagttgaggagaatcagtatccacaaaataggctttaaatcaacaacggtggctgggcgcagtggctaactcctgtgatcccagcactttgggaggccaaggtcaggagatcaagaccatcctagccaacatggtgaaaccgtgtctctagtaaaaatacaaaaattagccaggcatggtggcatgcgcctgtagtcccagctactcaggaggctgaggcaggagaatcgcgtgaacctggaaggcagaggttgcagtgagccgagatcatgccactgcactccagcctgggcaacagagcaagactccatctcaaaaaaagaaaaataaatcaaaaatggttagaagaaataaagaaggacattttatattaataaaaggttcaatataaaaagaagatacaacaattgtaaatatttacacacctaatgacagaccgtcaaaatgtctgacgcaaaaaattgatagaactgaaagaaggccaggcgcagtggctcatgactgtaatctcagcacttcgggaggccaaggtgggcagatcacttgaggtcaggagttcaagaccagcctggccaacgtggcaaaaccctgtctctactaaaaatacaaaaattagccaggcatagtggcgtgtgcttgtaatcccagctactcaggagactgagtcaggagaatcgcctgaacccaggaggcgaaggttgcagtgaactgagatcgtgccactgcactccagcctgggcaacagagcaagactccatctcaagaaaaaaaaaaaaaaagaaagaaagaaaaaaagacaagaaacagacaaatctacaataatagttggagacttgaataccccactctcaataatggatagaacaactagactgaagacaagtaaggaaacagagaaataacacaattccacttctaggtataaacccaagagaaccagaaacgttttcacacaaaaacttgcacgtgaatattcacagaagcattattgataatagttttaaaaaatgtatatgcaatcctaatttccaacaatggatgactggataaagaaaatgtgatagagccatatgaaggaatattactcagcactaaaaagaaatgaaatactgacacatgctatatcacggatgcattctgaaaacatcatgcaaaataaaagaaggcagatacaaaggaccacatattgtctgttgctttttatataaaagtttcagaataagaaaatccatagagattgaaactagattagttttggccaggagctgagggaaaggggaaataagggacagggaatatgccttttttttttgcaatgatgagaatattctaaaattagatagtggtgatggtctgaaatagaagattcaggatccggttatcaaagatgtgataagagaacagaacactttaagctttcagcacatcaatttactctcttgtcactttaactcctcatcagagttactaggttattttattgtgttccatattatcttttacccaaaagatcttggttggcaaaagtttcccctttccttaaagttaaatatatatttaaatagttataaaatacataaggaaaaaatggtgaaaataaaaacccagatatagaatacaacctaaaaaaagtccttgctgaaacatagtatgaacattaactatgggccttttcctttttcacattataatttgttttcaaaatgtaactaatgttaactccagaagtaccagatgtcacataaagcttatttcactttcacaaaacctaactgtactacatagtgtaatatgggggtattctggttaaagctttacaaaatgcaggattctatgtcttggcatgacatgaagaacccccaagaaaaatgtcttagggaaagactatttcttggtattttcctacccaggatatttgggtagaatagaatgaatgtctggccattgtatttttggactgaagtatatttaaatagcttttacatatgccaggaattgaaaataacatcttaatttgagcataataaaagaggaggataaaaataaactctctgctcagtgttaatacagatctaagacattaaatgatattttaagtaaaactggtgaaataaacatcaagtcatagaagtgtgatcaggcacttctagcaaaagtgataaatcatatattaaaatttaaaatgactatagttcatttatttattcattcagctaatattttattacacattgactatacagcaataaaaacaacaacaaaataatctactctttcttctctcccagaacttaaaatttgtttaataatgttacggcaaagaaaacaataagattaaatgatgatgaaaaacttgaaagagcactgatcttggagtcctaagatctgaatcaaaatttcatgtctactaattactaggcaagtgatactggatacatcaactaatttctctaagcctcaaattcacaccgtgaaaaatggggtatgctactacctgtctggtgtatttcatcagttaattataaggatcacagagaaaatattcaaacattccctaaaaactctaaaagttctataatcacaggcttgcattattactgaaatgtatggaaagctatccaatttcttgcaataaataattttagttgatattaacagtatactgagagtctatgtggccagacaggaaagactaatgctaactgtcaagtacattaacaatataaaatgacacatatgctagggttttggcctttctccatttagccattctaatttgacctggatttcctctacatgtcaatttatgctcatattcacaagcaatgttccaatcataggaagagcaaatgagtcagacagacttctatcaaacttccaatctgagcaacaacagccacatgtttctttactcttcaggacatgtatttgtcaatcctgtttgaatcttaacaaataatggaactttcaaaataaagacaaatgcacttagtagaagaaaataacaattactgtaattgcaaccacattaacttgactgagtttttgtttaaattacttctgtacttctatgaaaaacactgttcttaagaataatgaagtgcttaagacatgactgaaaaataaaacctcacaattaaacccatgaggaaaataaatttaacttggcataattctggtttgcaaaaatactgtcaggtaatgaacccaaatccatatgaatcactggtaaacactatgcacaacaaacagttaatacctataggtgctctgtgaaacagtggaatccaaactgtctgtctcttttgggttggagaaatagaataatcctgcttttcctcaaacactggcaaacatatactatgatagctaaaagtcaacttaatccttcctttcctggctcaaaataaaaataaatacgccatctcagacttaagatgtgatatccctttgtgggttttcatgaaagagagagaaacacacaagaaaatgatcatggttggatgggctttgtgtaattttcaatcacataaccttgttttagaaagtagaaatgaagagccaagacaactatggagaaaattctggcagtggctgtactgtgctctgattattttttattagcattggttgtatcacacccaaagcttcttggcattttccatacaaatccactcccaccgagtattctgtattccggaagggcagtaactttatcaaaaggtagagtcacattccagagcatatcatctgtcacctctcaccaactcaccacgccccatgtccacactttctgtcttttctctctcccagctcttctggaataactaacaaatccttccctttgccctcatgcagaagagtttggcacatgccatttttctcaaggtgtgatttttttttttgtcattcaccaacatgtaaaataaattttacagccaataatagcaggtgaaaagggaagcaagatgaaaaaaggacacatgaatgtctcaaaaggaaatagggggctgggtgcagtggctcatgcctgtaatcccagcactttgggaggccgaggcgggtggatcatgaggttaggagttcaagaccagcctgactaacatggtgaaaccctgtctctactaaaaatacaaaaattagccaggcatggtggcgcatgcctgtaatcccagctactcaggcggctgaggcaggagaatcacttgaacccaggaggcagagattgcagtgagctgagattgtgctactgcattccagactaggagacagagagactccatctcaaaaaaaaaaaaaaaaaaaaaggtaaatagggggatagctcccattaaatcactcagcatcctgttattgaattggtcctcctgcaagggaccaaccacaaagtcagtgacttaacttacttattaactcaaaataagtaacttaaaacttcaaaaacttcaaagctgaagcgcaaactttcacagatgaaccactacaaaatcaatgccactatactggggcaagcagcataaattttcagacctcagaaatattgaatggcattgatacgttttcatttcttactcagtcctacctgaacatctgggctaatggcatttcatgtttaagaatagggcactcagcagggcgcggtggctcacgcctgtaatcctggcactttgggaggccgaggcgggcggatcacttgaggtcaggagttcgagaccagcctggccaatatggtgaaaccccatctctaccaaaactacagaaaaaaaaattagctgggcgtggtggcgggcgcctgtaatcccagccactcaagaggctgaggcaggagaattgcttaaacctgggaggcggaggttgcagtgaggtcagattgcaccactgcacttcagcctgggtgacaagagcaaaactccgcctgaaaaacaacaacaacaacaacaacaaacaaaatagggcactcagctacgcttaccaggaaactgagtggagattttcctgtgtgaccggcaagtgattgtgaactaaaagcattggttgccaaacttaaaaacctacctgtgggacattaaaagcctctagcatgtatcacctttggacttacttgtattcctgtgactttggtcccctgggagagaagcatccgtagtccaggctggaacgtgttggtcgggatgtgcagtagacaccacagtgctctggttataaattgtatttgtaagaataacatcggacccttggatttcaccatcagtgaccaaaggttcactcccatttgatttaaaatagaccttttgtaatgttcctgaaagacaaaaacaaacacaaaaaaaacctatctttgaaacattactagaagtgtttattttaaaaaacattaagaaaactctagagctactttccctatgtcattctaaccaggtaaacacaaagacgaagatgaaagccgtaatagtgacctccttcttggggtcaacaaccacaaaaccaagagtttctcttctaccacaaatcacacagccctgtgatgaaacatggctttctcaagagcttacggtttagaaactgggtctcctatcaaggtttcctggtgcttcaaaaatgtagggtaattctacctcacctgagactcaccacacaataaaatgtggtgaatcttacagcattctctttcacttccttagtttcttaatctcaccggtcattgtttgctactcaggacccaggacatgtgctctacctctctctgtatctgtcatcaaaggacacaatggtgcttgccatcagctttatatttcccacattttgcactaatgttcagtaaactatgcatcacacacaaataaaaaataagagggctcatacatttatcaaaacttgtatcataggaaccaaaaaaaaaaaaacctctaaagcacaaactaaaagaagaaactaaattatcttcatcttcgaccagaaaataaaaatgtaattatatgaaataagaaatactcatttaaaaaatttatttccataggttattggggaacaggtggtgtttggtaacgagtaagttccttagtggtgatttgtgagattttggtgcacccatgcaccatgcaaagtttggcacatgccatgagcagtatacactgcacctaacttgtagacttttaccccaactctctttccacactttccccgagtccccaaagttcattgtgtcattcttatgcctttgcatcctcatagcttagctcccacttatgagtgagaacatacgatgtttggttttccatactcattaaactaagattatcaactggccactttctcaaggtatccattcattgacaaaacaaagaaccaaacctaagattattgaaaaccaccttgctttgtctttaggaagaaacatttgaaaactttgaaagagatcgtgtatttttaactcagtcaaaatagacagcagattgtgtttccagaatatcgcactgtacttgagcatgccacgaaaataaatgaatgtgatattgacccatcgatagaaagagccaagggagattttcttttctaaaagcatttacagtgaatgctctaattggctctcacttttctaaatagtcccaaggaccattaaaaataaaagaaacataaataaaatgtttaatatcagtctatggaaacaatttctctacatatgcttgacacttggaaaacattaactacaaataaaaatagaaaagcagctgtttctagctaactgagatcaacagtttcctctgccaaaagattgtaaataaaacattgaagcataaaagctaaatcatgatcatgtaatgcgggtaacatgctctccaaaccatctgtgtgatcatgagtaaaagtcaaatgcagtaggtaaaatgaaggaattcatttaattgttattgattttcaaaatgatttagactttatcctaatcaaaataaatgtgataggtttaattactataggaaatgtatttcacacatacagaataattagtaattaatcaattacctatagttttccttacatccatttgttaattgctctcttccttgcttatttttggcataaagagattttttccataaggtgatatttatgctaatgtggttgtaatgaatatataggcccattaagttgatttacttatcttgctgaatctatgagtaggcatccagttctgtcaacatacttttagcaaatgccaattgttcacggttgtaccctggagtaattcccttaaaattagttccttctcatataaaatatttgaacacttgttcctaactttttggtaataattagccttattaataatctttcctttgtcattttaatatttcctttatcattttaaccaaacagtgtttaaagtgttcataacatctggctgggcacagagactcatgcctgtaatcccagcactttgggaggccgaggcaggtggatcacctgaggtcaggagttctagaccaccctgacccgcgtgaaaccccgtctctactaaaaatacaaaataaaattagctgggcatggtggcgggcacctgtaatctcagctactagggaggctgtggcaggagaattgtttgaacccggcaggcagaggttgcagtgagccgagtttgcaccattgcactccagccagggcaacaagagtgaaattctgtctcaaaaataaataaataaataaataaaaataaagtcttcataacatctgtttatcctaagaagtcctctgaaacattgacatttttaagaaaacactgacttggataacaactttcttttaaaaaggcagcttcattgctcttaagctttatgtattgaaagcaatttggcagaataaaaagaaagataatatttgagaggtactgtagttaatgtttttaaagtatattttgggggaagagaaacagaataaacttaaaggacatgtctttaaaagcctgaactcactggacaacttgttttcaagtatctctggaagctgaccaactcccaacacggttgtctactatgcattttcttttaagcacaagaattagaactcaataaaactaaatgctttcaacctgtatcatgatgagctataaaaatgctaagaggccgggcgcggtggctcacgcctgtaatcccagcactttgggaggctgaggcaggcgcatcatgaggtcaggaaatagagaccgtcctggctaacacagtgaaaccccgtctctactaaaaatacaaaaaaaattagccgggtgtggtggcgggcgcctgtagtcccagctactcgggaggctgaggcaggagaatggcatgaacccgggaggtggaggttgcagtgagctgagatcgcgccactgcactccagcctgggagacagagcgagactccgtctcaaaaaaataataataatactgctaagagatattagcccaaagtagagtatttattcttctaatactgcctcattcttttctacatttctatgtttattgtgctatggttaaaagtacaggtttaaatcccatctctaccacttgccctgaaactttggacaaagtcttaactgccataaaggaaggaaaaataaaatacctcttcatggggctggctgtggtgagacagccaagtaaaaatggctccccggcagaacccccgactggcctgcgcactgggaggagcgtgcactggggtggagcctcaggaggttcacaccgtttgcagaggtgaggagcctggcctctcctgttccggggtggtatttgggactcaacttgtgaggcaggaaactggctagcaggactgtcattttgctgagagtccctgtttcccttttttttccccttttagcccgataaattccagttttctcaccgttcaaagtgtctgtgagcctaatctttcatggctgtgtaacaagagcccagcttttaggtgaactaaggagaaagtcctacaacattgggatcaaatcagtcaatacctatataaacacttcgaatggcttttggcactaagttctccgtaactgttagtcattactacacattgatggtaatgacaataaaattgtcttctttaggactgctaaggtacttttagataaatatcaatttcattttactataagtggatcccagtgtcacaaaatggctaactttcagaagtgaatcacttaacccacatttggagtgagaaaactatggctttttcgtgctaaattattaatagaaagtcacattgtattaagatagtctggctcaaaagtgtttcagctctatagccaaaaaaaatgtaatgatatttaagaaatagtatataattctaataataataatagtcaaactttactgattccttgtaatgaagagattgggcactgtggtagacagaataatgctcccccagagatgccacatcccaattcctagaacctgtgaatattctgctttacatactttacgtggtaaaagggatgttgcagatgtgattgaagtaaaaattttgagatgaagagactatcctggattattcaggtgagcccaatgtaatcacaagggtctttataagcagaagagggagataagagagtatgtgtcagggtcatgaactgtgagaaaaactcaatggaccattgcttgttttgaagatggaaagagccacaagccaaggaatgcaggaagccctagaagctagaaaaagcaagagaatagattgtcccatagagtctgcagaaggaacacctaaattttgcccagtgagacctattttgaacttcttaactctaagataataaatttgtactatctttttaagctaccaagtttgtggtaatttgttacaggagcaataaaaaattaatacaagcaccttgctaagttccctcactataggcatcaactgagttaaccttccaataatcctataaaacagataatataattaatcgtttgacagagttttagagagatggaaactgaagtttatgagagtgaattagcttgctcaagatttgagttgggacatggcaaatagacatatacatatacacacacttttcattctggacaaaacatacaggttttaaaagtcaaccattatgtgcttgcagaatttatcttcctataatgtgattttaaaattaatttcttagctttgtatctttagccatgtgaaacacatttactttgcattttctatgtgccaagaacttcatacttactctgctgagaacacaatatttagtaagaggtccttactatcaagatgtttatagattagttgagggagacgggcaggcaatctaaaaaatattaatataaactatggtacaagtgctttgagaatgatatgcctaggacaatctggtagcaaaaagtagagagatagtcctcattccatttgaaaaagtcaggaaagcctgtttagagacgagtatcctaaatgtgaatcttaaaagatgattagggattttctaggtttaagcaaagtatttgtggggaggagagtggcgtggcaagaggaagtgaaacattttctagataaagccaagggaaaaacatatgaaaaggcccagcagcaagtaatttaaaaacatggctagtacacaggagcctggtaagagaaaagactgaaaagggaagagacaccagacaggataggtcttgtacaaggcttggaatttaccttgtgatagaaaattttagaaaggtcttaaatagggtgaaacatattagaatgatcactttggcagcagggtgacgtttaaaagtttagagggtagttagaaggctattgtaatactccaagtgagaaaagagtaaggccttagccaacgcaaaaaccctatggacaaagggaacattaggagaaagctccaaagatgcaaaatcatatgaacatgagagaaaggtcccttcgaggtctctggtttgaataatgtagtaaacaaacatatccccaactgaattggtgtcatatcgttagtgttgttcatcaaatatttccagttctctctccttctactggggcataagctgagcattgcattctctggcctcttgagtgaggccttgcttcaagttcaaggctataagcaaaactaaaaagtgttgcttctaggcagaagcatttaattgctgatgtaagagccttcagagctctgacacaatcatcacaaaggctcaagatggtggctagttcatcaatttggaccctgaaggacctcgatgagcacaggccccctgccatcttgcaaaggacatgtagtattgtaataaattaactattgttgtttgtaaatcaccagtattgggggatttgctgttgttacatgacagagtctagccaatcttgactaaaacaatagataacagagaatgaaaaatagatttgtagaagcctgttgttgttgttgttgttgttgttacactttattgaatataaagggcctgtgaaacattcaggggggaaaaagcccaaatctgaagcaatctgatgatttcctccagatgcctcaccagactcccccacaatgctgtccctcctttgtgttcccagagcacgcactggttatattgtagcacatatgcactcaagtggaactgtctgtcccatgcatctatacatcaatccccgagcagaacacctagcaccagtgtagggctccataaatattcgttgaacgtatgaatgatgaatggactaatggaaatggctgatattgccaagaggggtatcagtgtaaagtgagaagacagctgaggacagacagctctttttaatgccatttaatggacagttaaagaaaggttagcttaaggaaaatgagaaacagcaggcagagatactgaaggataatcagaggtgacaatatgaaggcatagttgaagagcataatgagatgaaagtagtactcaacactgaggaagatcatatgcgcatagcacatctggggagaagaaagcattgctggcaccaactaacaatgaacattcttaccatgaattgatgtacacagacacagagagaaacataggttcttcatttcaaagtctcgttcaaatacacattggtttccaatgcagcacattggataaaaagacactggtgggcttgctaagtacagatataggagtatgaaaagaagtgaaagagatgatcagaaggggactgatagaggtataggaatcatctggggtggttcttgttagaattcaaattcagcaggtttggagtggggactgagattctggattctgcattttacacaaacttccaagtgatgctgatgctgctcgtccatgggccacacttgagaacaaggctttagactaccatttcaaaaagctttagacataacatataacctcgggcctcagtagttaaagaaaaaaaattgtcatgcttgagaatcctccgctggtgaatctgcaacagaaagccagatttattcaaagaatttgaagtcttaagtaatgtggagtcaggtcatgaaagatcatagagaatcttaaattttgggtgtgaagaaacaagaatttgggaggttttctatttttaagtgatactaagaatacattataagttaggaagttaagattcttttaactccaaattcttgtaaaagccacaaactgctgagaaatttgctaagagaaaactgtatttaaattcaatgatctccagttcatctagcatttttgaggagaaaggtcatttctgaagagaaatatttttatcgaattcaagaaaaatgaatggtttattaaactttctatagtctacataccactataatttttcttttttcctcatttactcaaaaaattaagaagccacacatacattttccatcatattaagaaaactagaaatgtaattttaagctagttttcataagcttatggctaaaataaatttgttttagatatatatggatgagtgaataagcagatgaatatttaaaaccaagtcttcgacaggctgagaaagaaaaagtcaggagaattctaatgagaatttttggaacataacttgggtgaataaattgagatgaagaatagtttgaaaaaactaattcagaccataccccatacatttataggactccctgccacatactcagctgtaaccctttctccatacagctgccaatgacaccttttaaagctgaaacgctttctccatacagctgccaatgacaccttttaaaagtcccaaccaagataatcatttccaagaccttgaaagagcttttttttccgatgttttcttctaggagttttatggtttccagttttatgttttagtctttaatccattttgacttgattttggtatgatggtataagataagggtcccatttcatccttttggatgtggatatgcaattttcctaacaccatttgtcaaagagagtattctttccccctcgtgtactcttcacacctttgttgaagatccaatgaccatatacatgtggatttatttctgggctctatattctgttccattggtctatatgtctgtttctattctagtgctatactgctttgattgctgtagcctcataatatagtttgaaatcagcacatttgatgcctctatctttgtcgtttctgctcaaaatcgctttgggtatttgggatcttttgtggctccaaatgaattttaggattgttttatctgaaaaatgccactgggatttagctagggactgcattgaatctatagatcactctgggtagtatggacattttaacaatattaattcctccagtcaatgaatattaaatgtcttttcatttatttgtgtctgatttaatttcttttatcagcattttatagttttcagtgtaaaaatatttcccttccttagttatgtttattcccaagtacttattcttgttaatcctattaacaaggatttcttagacatgacataaaaagcactggcaacaaagaaaaaaaaaagaccagcagtgttacatcaaactgaaaactttgcacagcaaaacaatcaacagaggttgagtggacctaaaaaatgagagaaattatttgtaaaccacatatttgatcaagagttaatattcaaaatatgtaaaaataagaaactcacaaatcaatagcaaaaaaaaaggtaacctgatttttttaacaggcaacggatctgaatagacatttctccaaagaagacacatacgcagagccagtagccagtaagtatatgagatggtgctcaaatcactagtcattagcgaaatgcaaatcaaaatgataaagagatgtcacatcatggttgttatgatggctattaccaaaaacaaaagataacagatgttggtgataatgtgaagaaattgaaacccttgtacactgttagtaggaatgtaaattgatgcagccactatggaaaacagaatggaaggtccttcaaaaaaattaaaaatagaactatcgcatgatccagcaatcccacttctgggtatacatccaaaaaattgaaatcaggatctcctatctgcactcccatgttccgtgcagcattattcacaatagccaagacatggaagcagcctaaatgtccactgatagatgaataaattttaaaaatgtggcatacacacaatggtatatcatttggccttaaaaaagaagaaaatcttatcacttgtggcaacatggatgaacctgggggccattatgctaaggacaaatactacatgatcacactcatatgagaaatctaaaatagattcatagaagcagaaagcagaatggcgattgccagaggggaagaggaaataaggcgatatccaagggtataaagtttcagtaatataagataaataagttctagagatgactatacaacatagtgactatggttaatacttctttgggtacttaaacatttgttaaaagggcagatcttatgcaaaatgttcttatcatggaaaaaaataataaagatgtgaggaaacttttggaggtgatggatatgtttattgcagaaattgtggtgatgatttcacaggtatatacttgtttccaaactcatcaagttgtgatacattaaatatgtgcagctttttgtatgccaatcatacctcattaaaagggcttaatgaatgaataaataaacaaataaataaataaatgctacaaccagaccctgtcactctcttatatcaacatccttattgtggatttcatgtttaaagtactacttactccctagggaatcttccctcatctcagcccagtttctgtccctgtcgtaagttctcttagcaccttgtctcttcccacatagcagtaaactctgttgtaattacttaatgaagtgatcatttgtttcatgccttcttccctcactgtggagtccctgagggtaggctttattcactgctgtccccaatacctatagcacactgtgttgcatataacagacactcaatacatatttgttaaaggggtgaatagtattacattatagctaattttgtttcttttaaatgtttctcaacatatcaaaataattttactttaaatgttgcatgatgatgtatatttataatatataatataatatataattataatacataatattgtgaatttataatatagtaaataattatatatgtatatgtaaaatttgaggaaggtatcagttcaatctcaaagtactctatggcataaagtgacacttgttgtcacatgaaggcagcacaaaccattgcaggtttagttcttataagaaagaaattagtctctgaaagtaaatctcaggcctaagaataaaaggcctgtcaaacttgccatcacgttacaaatccaactgttggtcaactttatttcttcctagctacttttaggcaattcaaatatcttgcagcaacagcctgattctagggctatggggttatggatcatggggttactatgacaacaggtcatagcacaaaggttttaattcttatggacagagttaatgtgagacaaaatgcatgtttagttaattgttacttgggtataatatgactatttattaaaataattatctgatgataattattcataatcaaataaaacaaattctttactactataatgaacttatcacttataaaaacactttcacaaacatttcatttgacttccataacaattctgtgatacaaaaaagaattatctcatgtagaaaataaagcatcttacctaaactcccatgtctagtaaatggaagagtaaaaccctaaagccagactttctagtgccaagttgcatgctctttcttctttgtcatatggaccatcagtatcagactataactaatgaaataaaaatctacatataatttaactttcttatttttcaatttctctttgaagaacctgagtccttgttttagagtccaaatctttggaaccatatggacaactcagactatctgccgagttgagaaatacaaaactaaacaacctttgtagctctagcttcagtttagtggttgggttgaaaaacaatttactactgctttcttctatagcctgctgctaatacaattatttgacaacccacctctcgtatcttcagaaatcgttttaccatcttgactttttgcatgagggaaaccacaacagacaaaattagagacacgtagtacatctgtgtttgttagcataaggcttttatcttttctaatcaataatcttctcattattatctccttggcttttgaagctagagctcctgttatttatacaccactgatatctcagcatcccttagcaaccctaatgtacacagaaataactacaaaactttgtatgagcacaaagttataaactcaaaccaaacagagcattttttaaagtaagcaatttaatgaggtttttaaaacaaagatataaaatgcttgtattgctcattacaacaacaaacatctcagttacaaaataaggaatatttatttggacagatattacttcaatatggctatattaaatcatctggtacagaatttattaaaagaatgtttttaatttttttctcttttttataaatttcaacttttattttggattcaggtacatgtgcaagttgtaacatgtgtatattatgtgatgctgaggattgggatacaaatgatcccatcacccaagtaatgagcatagtagccaacagtttttcaacccttgccctcctccatagtccccagttgtctattgttcccatctttatgaccatgagactctagtagtagactctagtagtccccagtgtctattgttcccatctttatgaccatgagcactcaatgtttagctccttcttataagtgagaacatgtggtatttggttctctgttcctgtgataatttgcttaagctaatggcctcccgctacatccattttgctgcaaaggacatgatttcattcttttttatggctgcatagtatcccatggggtgtgtgtgtgtgtgtgtgtgtgtgtgtgtgtgtgtgtgtatgtctcccatgttttctttatccaatctaccactgatggacacctaggctgaatccgtgtctttgttattgtgaatagtgctgccatgaatatatgagtgtgtgtgtctttttggtggaatgatttattttcttttggctatatccccagtgatgagactgctgggtcaaatggtagttccatttgaagttctttgagaaatctcaaaagttttttccacagtgactgaagtaatttacatttccaccaacagcataccttttctcaacagcatctgttgttttttgactttttcgtaatagccattctgattggtgtgagatggtatctcactgtggttttgatttgtatctctctgatgattagtgatgttgagcattttttcatatgtttgttggacacttgtatgtttattttgagaagcatctgttcatgtattttgcccactttataatgaggttatttgttttctgcatcttgaattgttaaaagaatgattttgaagatgcgtgggaaaacccccacttcctaaagtttgcctacatataaacaaaatagcatataggagcagttacataagtgacacaaaattccactcttggtatatacccaagagaagtgaaaatgtatgtccccacaaaaacatacacacaaatattcataacaggattatagataatagccaaaaggtggaaataacccaaatgtctatcaattgacaaatggataaactatggtatatccatacaatgaaatattgttcagccattaaaaggaatgaagtattaatatgtgctacaatgtgagtaaaccttaaaaacatatgctaagggaaagaagccagtcacaaaataccacatatggtcatacagaatgtctagaataggtacatctacagtgaaagaaaatagattagtggctgcttggggctaggggtgaggagatggggagagattgcgtggtagctaaagggtacagagttttgttttgagatgacaaaaatgtcctaaaacagactgcagtgatggttacattatctatgaatatactaaaaactactgaattgtagactttaaatggttggattgaatggtatattatattaataagaataaattattaattaactaataattaattaattaaattaataagaataacccacttaaagcaaagcattcctcctttgccctctcctcagaggcctctaagcacagacgtacttaaatgtacttacattttatattagcattagaccctgagaatgaaaggaagtgttcctcaaagcatgtgagccaatgaacatagtctcatgacagactttttaaaatgacagtggtatagctgaggaagctcctaccagacagatctgtccagggataataactataaactctggacaaaacacaaaaagacaactactgaagggcgctggagagggaggagaagcaggccaggtctggaagggtgttgactcttaagaagagagtggcagagacgagtttcaggacggtttactgtcttagcctgagagcaggccacagttgacaccacagagcaagaagcgactaaatctcccacagaaaaccctcagtcttcctgggctggggcactcgttctgtcttcctcttacttggtcaccctctgacctctggcatctgtgaaagccagcatttctgggttcctttccttctctgactattcttcctgtatctctttttccctcctgtttgtcttccccttaaacactagcatcctccagagcattgccctcagcttctgcttaatgcattttctcttcagagttcatcgactcctgctgcttcaactgccactgagactgccgcatgcatggcagacctcccttctcaacctccctcctggatcccctagcttcagtcctatgccaatgacttggaagttaaattttaaagtcagtgctgctctgtcacagaagccaaacatcatatttggtcacaatttctcttgaaactccttaggaaagcaacatgttggatttctcatttttctccatttcttgacctgctttcactgttgaattcaactatgattccattgtatttggttgtcccataagtatctctaatacacaaatcaaccttccaatctttatttcatctgcctgtatcagactcctgcacctttacttcctatgttaacaggtagtatcaaaactaacctggttagatacaggaggcagagcaagaggcctgatagaagtctatagcattggtcccccaccccaaaggaacagcaaattttaacaattaactacacacaaaaggcactaatacaagaatcaaaaatcaggtgagcaatcacaatacctggttttaacttcatatcactgaagaagacagtaaagagggcaagaaagatagtcttgaatgctgacaccatcctctcccatcccccagcagtagccatgcagcttggagaatgtgggcacttgggagagggagagtgcagcaattatgaggctttgcattgagctcagtgctgccctgtcacagcagaaagcagagggaacatttggacaggcccaggccaaagggtaattgcccatcccagtggtgagagcttgagttccagcgagcctcaccactgcaggctggaatgctctgggactttaaatgaacttgagggacagcctaggccacaaggactgcaattcctaggcaagccctagtgctgagctgggttcagagccggtggactgggagacacatgacctactgagacacaagctaggtggctaagggagtgcttgtgccacctctccttcatcctccagcagtgggtgtgtggcatggagaaatcggtgtgcttggtaaagggagagcacagcaactgggggactttacattgaactcagtgctgatctgtcacagcagagacctggcaggagtcagcacttgctgaccaaagagccccatggccctgaatacccaacagcaatacccagagccttgggctctgagatgtgctggcttcagatgtgacctcgcacattcctagctgtggtggctatggtgaaagactctttctattaaaagcaggggaaaaaagtaaaggggactctctctggcacctgaggtgactgcttggcctcggtggggtagggcaccaaccaggctcttagggtccctgagtctaggcctaggctcttggttagcatttctggacctgccctgggccagagaggagtccactgtcctgaagagtgagtcccaggcctggaagcatgcatcattaaccaactgaagggcctttgggctctaagtgaacatcagtggtggcctggcaaaagcccccatgggttggtggttgtggtggccacagggagagactccttggccaatggaaatgggagggaagagtgggaaggactttgtcttgtggttcgagtaccagcttagctgcagtagaatagaacaccagctaaagttctaaggttttttacttcaatccgtggctccaagacagcatctctggacccacctgaggcctgggggagctcactgccctgaagagagggacacaaacctggctggctttgccacctgctgattgtagactctaaagctttgagtgaacttaggtggtagccaagtagtggttatagcaggccttgggtaagactcagtgttgtgctggcttcaagtctcaactagcacagtcccagtggtagtggccatggggatgttgtgttcctgccccagttccagaaggctcagcacagggagagagagagactctgtttgtttgggagaaagtaaggaaaaagaacgagagtctcggcctggcaattcagagaattcttccagactttaaccaggaccaccaaggcagtacctttctctagaagtcttcaagaattgcagcattatagggtcgcaggcccaagtcccttagaagacctgaaacaccttcccaagaaaaatggacacaaatgggcccagactttaaattaatgtaactgaagtagtgaaagatctttataatgaaaactaaaaactgatgaaaaaaactgaagaggacaccaaaaaatggcaagatatttgatgttcatggattggaagaatcaatattgttaacatttccatagtactcaaagcaatctgcagattccatgcaatccctatccaaataccaaagacattcttcatagaaatagaaaaaacaattctaaaatttatatggaaccacaaaagacccagtatagcccaagctatcctatgcaaaaagaatgaaactggaagaatcacattacctgacttcaaataatactacagagctatagtaaacaaaacagcatgatactggcatacaaacagacacacagactgatggaacagaatagagaacccagaaacaaattcacacacctacatagacctcattttcaataaagatgccaagaacatacattgcggaaagaacagtctcttcaataaattgtgcttaaaaaactggatatccacatgcagaagaataaaactagactgctatctctcgctatattcaaaaatcaaatcaaaatggattaaagacttaaatataagacttcaaactatgaaaatgctaaaagaaaacattggggaaactttaggacattggtctgagcaaaaatttcttgagtcataccacacaagcacaggcaaccaaagcaaaaatgaacagctgggatcccatcaagttacaaagctcctgcacagcaaaggaaacagtcaacaaagtgaagagacaacccacagaatgagagaaaatattttcaaactacccatctgacaagagattcataatcagaatttataaggagctcaaacaactttcttttaaaaaatcgaataatcccacttaaaaatgggcaaaagatttgaatagacatttttcaaaataaggcatacaaatggcaaataagcatatgaaaaggggctcaacatcactgaccatcagagaaatgcaaatcaaaactacaatgagatattacctcaccccagctaaaatggtttatatccaaaagacaggcaataacaaatgctggtaaggatatggagaaaagggaagcattgtacactgttgatgggaatgtaaattagtacaaccactataaagaacagtttggacattcctcaaaaaaactaaaattgagctatcatataatccagcaatcccactgctgggtatatgcccaaaagaaaggaaatctgtacatcaaatagatatctgcatttccatgtttgttgcagcactgatcacactcgtcaatatttggaagcaacctaaatgtccatcaacagatgattggataaagaaaatatggtgcatatatacaatggagtactatgcagccataaaaaggattagatactgtcattttgcaacaaaatgaatggaactggaggttattatgttaaatgaaataagtcagacatagaaagacaaacttcacatgttctcacttattttaggggctaaaaatcaaaacaattgaactcatggagacagagaatagatggatggttatcagaggctgaggctgggaaggatggtggggggtggggagggggggggttgttaatgggtacaaaaattatgtatagttagaaagaatgaataagatattatttgattgcacaacaggatgactatagtaaatagaagtttaattgtacatttaaaaataatagagtataattggattataaaaatataagatttttgggaggccgagacgggtggatcacgcggtcaggagatcgagaccatcctgactaacacagtgaaaccctgtttctactaaaaatacaaaagaatagccgggcgtggtggcgggcgcctgtagtcccagctacttggtaggctgaggcaggagaatggcgtgaacccaggaggcagagcttgcagtgagccgagatcgcgccactgcactccagcctgggcaacacagcgagactccatctcaaaaaaaaaaaaaaataataataataataataataatagagtataattggattataaaaaaaatagagtataattggattattgtgacaaagtataaatgcttgaggggatggaaagcccatttttcatgatgtggttattgcttattacatgcctgtaggaaagtatgtaacatacctcataaatatatacacccactatgtacccacaaacattttttttaaaaaacctggttacccaagccagaaatccaggagtcagccttgactcctctctccctcacaccaaaatccaatcagtcttgatttctgttgattttaatgcatccaatgccttatttcaaacactcatcaccttttacttagaccagagtcagagccccgaactggtctccctctgccttcatttctttctgcctccagtactctgtagtgtatccagttctaccgccttttgcaaatgtaaaataatcagagttctcctttcttggaaagatcctccagtggtaatccaccacccatagcagtgttttgtaatcatttttatagcagatcaatgttattttcaaataaatatcataaaaagcctaatatctattaatagatatgagctgaattttattgtggttaacttactttataagatctaagtgtgtaacttctataaaccagtaagaaaataatagggaggtttggcaaaacttaaaaattcaaaatcattggcaatgcaattagatcagcatcgtcttgatatttatttctctgttttatttgattgcacatattttttgaaatcctgattcatatcattaggtagccaccagtgataatagtttattgctttttccaaaaagttcacttttcaaactttaagtatcattcacttagaaaaagatagcaagatgcaactaatgagctaactaatgagttaacctgtcagcacatattacttggtttctggtttttacttggttaaaaatgtggtatgtaatatttagtttgagtgtgtttttaagatttttttttttaatgaaagtcaaagcaaacatttgtgcaatccttaagtctcctccttagaaccttgttaccatggaatagagtttgaaaaccagtgatctaaaagctaaagcccaaattccttagtatttagtatgaaaatgtaagatgctgtttaatttggactttattgatctagctgcatttcccaccactgccaaattttcacccagttttctaaatctatgttcatctttcaaggggttatagttttgcagtagttattttctctgccaaatgtgactcctgaactactgtcttctaacctaaatttctattaacttaattccgaagttaacacattaactctccatgatgctttctttgaatgtgcccatgggaccttgtctatacacttctatcttaaacacgtgttgccttgtgtgataatcatcacttcctctcaactgtgagctcctaagaaaggactaatttaaccatcctggagttctcaggaactttcaaaatgcctgcaacctagtaatcattccttaaatgttttaaattcataaactcattcattaatattaataataataaccagtagagtggttacagtagctgaaactgcagatttgcataacgtcatcaaaagataatcctctcattgactgacactttgggttaaataagtactaagtagaaatcactcttctagatcatgctaattttcactttaacttcatttttatttaataatggcctcacccaccaacataggaaagcaggatcaccagcaagagaacgagagcacagatacatggaatcaggaccagcaataggaaccggaggaggttagcagtcgccagcttctgagagcagccattgcccatgttattgtcatcagctctcaagacctaaagtaaaagaggaaaatgcaacatggttttagttttacaatacatggtatgaaattttaggttacagctatccatttagaacagcacattccaaaaagattttacagtttgtggtttagggtatgaaatgagcttagtcaacaaatcatgccaataaaggaacagataactgtacatctacattcagggaagagcaaactatctatttctgaaacatttttcggaagtacataggcttttaacaatatcccattttgcttttttaaaacatatttgtcaatttggtatgattccaaagggctatgaatgaccatggcaaaaccttaccctggcccaaagctatgacagaagtgaaggctgcctaatacagtgataaaaaattggtaagtaggtgtagacagaatattatccagacttcattcttttttgtctcattagtctaaaccaaatgtgaatgaatctggataaaataagtttttggccattaataattcagccaggctcactgttactgaccatgcatttagtgacaagttgaaatataaggaggagcctgcctgattgccaattaaacgctaacaactctgaggacatcctcggctgcccatgctacccctgcagcccatcctgtgtgagaggatgtcaaagtgcaacaacgacggttcagataaagttcttgtcttcaaatgcttcaaattttgcttagttcaatctcttgccagaaatgatatctggaaattcatttattacagatggctagcttaaagcagtgacttcaaaaaaacatctgagatggtactaaaagggctttgaataactacaagaaactctccgagtctccttaatgaaggcatttctcatgattctctcttggacttctgactgcattttctcctctgacagtttcagaacttgaactataacctcagtgtaactacctcctgaatctctcttgcatcctgtactcctttcagagttacactacatatttccaatgcctggtgggtagcagcgtctctttttaacaagtccaaaattaagacgaaccttctctctctctatcttcaaactagttcttctcctgactttcatatttatgtttacagaaattcctccattccaatatggggagtggagtccaaagactccccatttcatcatccccctatgccgtacatcaccaggttttgttggttcttcctcttaataaataccaaactttttttaaaaaaatgaatgacctttgagaaagagccttataataatcaagaagttgttctaacacaatggccctgtaatattctcaggacttcctgacgagtatttgattatttcccgtggatgcaaaggcaattttgaagggttcttctgaattgcaaggcatatgtgattcccatttctgctttattctctctataagggaatataggttcactaacccatattgcaagcagtgttcactacataatatgatgacaccttctgtaattttaagaattctccatgagagacattatttgaagtaacttgtgttgttaacttgagaagaacttcatttcctaggttaatgtcttactgatccattgtacctggattaagctaccagccaatgtgttataatttatagttaatttacaactgatcttcaagaagacaattgatcttcaagaagataagtgtacaacacttacctacaaaaaaatcaatcaataaataaaagtgtgggactacaggccaacaaagttagtggcagaaacaagttgatacttgtttattttacttagttattgaatacctactaattataataatagtgatggatacgacaatgacttcaaaccactgtctctcaaaagctcacagtcttgtaggagagatgaaatgtacatgactatattgcaaggtagcaaatgataagcaccatgacacttatagctaaagtgatataagaattcaaaagatagaaatacgatttcttgctggaagatcacgtaagacattgtagagagagcaaccctgaatcagccataattctgagaaaagtacccctgaacaagtctgttacgagttaaaaaaagttgcaaagtatttaacttctacaacagtgaagaagcttccttgctaaggtgatcacagaagcattataggaataaccttggctcattgccatctggactcctggagccagatacatctcatttagcatttataagtaaagagtcagtggagaaaatgctagaggcccattttaatatgtcatctaagtagatatcaagtactggacctccaaaaacaatattcatgattagaccaaatattttcttcagtgacaagagaattgattgcttttttttttttttttttttttttttgagatagagtctcgttctgttgcccaggctggagtgcagtggcacaatcttggctcactgcaacctccgccttccaggttcatgcgattctcctacctcagcctcctgaatagctgagattataggcacacaccaccactcccggctaattttttgtgcatttttaatagagacagagtttcactatgttggccagactggtctcgaactcctgaccccgtgatccacccgcctcggcctcctaaagtgctgggatcacaggtgtaagccaccacgcccagccagagaattgattgcttttttcaaagggagaggaggaagaaataggtaggagaaattcaatacttcaacactttcttcttgaataacttgcataactttcctcttgcactcatggccacttaggactgttgcaaatgctacattatgcacaggcccttggaggttcctctgaacacaaggcaactctcagacttcactgttgagtaaatgccaggtgaaataaacaaccagaatcatccttaagctttgtttcaatggactctaaacaatcctcccttcaaatggcatccctcttccacaagcaccttcctcagccttgaaactaagctgagcacaggcacagcattccatggcaagggtagggaacgatgcatctgattggacctgcacatatttgtaaagcatgtcattcttttgtgttttgtttgttgttgtttttatttttggttttggttttgggcttttgtttgtttgtttgtttttggtgttttgttttgttttgagacagggtctcactctgtcgcccaggctggagtgcagtggcatgatctcggctcattgcaacctctgcctcctgggctcaagtgattctcctgcctcagtcttctgagtgactgggacaacaggtatgcaccaaacatcacgcccagctaatttttttgtagagacaggatttcaccatggtgctctggctgatctcaaacttctgggctcaagtgatccacccacctcaagcttccaaatgttcttatgttttactaatcttgttactgaaaatgtgtttcttctatcttaagaactacatttattttaaaaactgtcatgttgttttatataatgtacactggcacagtgtaccattgtaccacaagtgtatgctatcttggtatcatttgagaggtcaaaatttcagatagccagttcctccttcttgaagcactttcttcctttggcttctctttctcctacctctctggtcattccttctctttctgtaggctcaattctcacattcactcgctccccaggcaatgtcacccacacatttaacttcaattagcagccctccataggtgactcgcatctttaaataacaaccatagatctttcctctgatctccagaggaagattgcattatatgcaactgaccacttgacatctcctcattggaggttgtaaaagtagctcaaactcaacaagtctggaaccaaataaacaattttcatccccatatctggtattcttccagggtttgtgatctcaaaaaaggtaattgcacaactatcatgtgtcaggcattgtttgggcacttgggatatattaatatgcaaaacgaaactctctagtctcatagatgctacattatagtaaaaataaacatatctctcctgaaatactgcaaatacctcctcctatctggtttacctatatttatccatgcactccctaacctgttctccacactatagccagagtaagaaagaggctgtattatctttgcatgatgagaaaaaacaacgtgaaaaatgaccccaaagctgaactaattcaagaatgcagagcctggaaccagagctgatcatgagaaccatgcacccagaggttctggggagggctttggatttacattagggtgtacgaggttttgagtccattttatcaagtttgcaaaggtcaaggagattatagttgacatttcaagtacataagtctttaccctcttttaccttcaggcagcatttgactttgtcaacacatggtgcattcctgagggcacatccacatctgcgaatggcagacaatatttgagagcttgtttggaggttctagctggggggtgcacctacttgaatacccctgaccaaaggtgagtcctcatctatcagggatggttgtcctttcaaatattcctgcctcctaaagtgctgagatcacaggcttgagccaccgcgcccagccgaggattattttctaattggttggattaccttttgggataaattttacatcttaaatatatagaacagggatcagaaaactagtctatggaccaaactcagcacacctagtatttttgtacatacagttttattggatacagccatgttcatttgtttatattctgtctatactgctctgctgctactacaacaacattgagtagttgcaacagagatcatatggtactcaaagcctaaaatctttactatctgatactttatagaaaaagtatgtgagcccctgatgtagtgtatcagtgtatatctgcatatatgtgtatttttaaatttgcatgtttaatttgataatcaaactaaaatataaattcttttaagaaaattgtattttaatctcttcatcagggcttttaatgaaatatgatataattgtacagggggtaaattagcagacaaaactatttgttgctgtagtgcaaagttactccagaaaaggttgaaagataaaaataatcttcaaagtagaaaaaaaattatcaacactatatatgtggctgggcacaatggctcatacctataacaccagcactttgggaggctgaggcaggaggattatttgagcccaggagttcaaggtcaaactggacaatatagtgagacctcattctctacaaaaagaaaaaaaattaatgttagccaagcatggtggttgttgcctgtagtcccagctacttaggaagctgaggtgggaggactgcttgaacccatgagactgaggttgcagtgagccaagatcgtaccactgcactgcagcctgggagacagaacgagaccctgggtccaataaataaataaataaatactatatgcactacattaggagaaaggaaagcactagtttcagaaacattcaagctgaaagagtaccacaacatgcatcatagactataggaaccaacaaatactcataagattttagagctagaaagtacaaatttattcctgcttctttaaaaacacaatcatagcagaagtcataccaattcagtctatttcttgctatatatgcaaatattgcccttttctcatcagtgaatgctctgtatctagaacagtacctgaacacggtcaggagttagtggataaacacttactgaataaatgaattaattaaatttcctaaataaaaattactttgtacataattatgcaaataactacttcttacagagtctattcctaaatcatccaaaaatccttcaagtagaaaatgtatttggcaagaagtaaaaatataaataataaccacaattgcatactaatatgatgtgtacacctgttgactaccgcacaactccttacaccttggaatcagatcagacaccaccacccctcattgcctgctccacatggattctttcatagcacaacttttgcatagcaaccgccaagaacccagctttgtggagacaggacaatatcaaaaggaatatagcacaatctaatgttgaaactgtgagctacctcaagctagtatttcatgtgatgaccaataaatgtcaagtatcgctgcatttgcctcaaaaactaaaaatatccagcaaagtcccttgagtcactgcagcaacctggaatacaacagcacacagtttggaaaccatagtccaagtccttgcttatttatttctcccaatacctaatttaaaaacaaacaaaacaaaacctatcccttgaccattccaaggttttgccaaacatatgctgtctttagctctgaaagcaataatatgcactcagagaaattgtctacaaagagattaacatcagcctgctatttcttaaggtacagcatcagacatagagatatgttgatatttttattttaaacaagatttgtttaattgccatcaaagatcaggcaaacttgaggcagaatttaaactgtttctgataagcagaatattttgaaatgtgaagattaattctgtctgcctaatgtgacattataccatggattttattaaataccaaaattattcttaccaaaattaaataccaaaatgttcttaaataaactatgtagacttagttaatacatgatggttagtcaacacagtctgtgaactttatttagatgtacaaacagtacttgctagaggttatcctaattcatatgccaatctggtggatttagctaaaattctatttattgtttgaagtttctgatattaccaagccaaaatgtcaaactgttctcaaaccaaaatgagaatgttcattttaatagatgggattgtatgcaaaattatggcagaattcaatgaccatttgtcttatcacaaaatatttgcttacaatgttaaaaacaaacaactaaaaagaaaaaaatcatccaaaatcaacactatgtattggcttgagacaaatttagtaccttaattctttaggtaggaagatgataaactgcaaatatactcttccatttcagcaaagcaaggaccagcctcaaggataataaagtgactcctactggtgtgtcctaaacaggacacagaagctccctctaaacactgtgggggcattacagtgtcacatattaatatactcacgaatctaaagaaatgcagacactgagactctacttgcggctagatattcaacttggaactttgtcctgcacaatcattatgccaaaatgtgatttgtgttcttttttcagtcatagagatggagtttttccaacccatctccactctgtccgtagagcaaaaattagtcaattgttaccccctcatttaagatgaaaaatggacagtgctagatgcttcccactctgttcttaagaaattatgaaagtgaccttcacatgaattaaaagtagatttgttgagtaacagattaataatgtggatagttctcaagccaggcatctgcaattctctgcaataatagctctcactcaaccaacaagcaaaatgcctccaaaatcatcatgtcttttggtgtgatgtttgtttttaatatcccaggaagcataaagaacacgcatctggttttcagtaagtcttttcatcccattttctggcatgtagttgaagcatatgaagtttaaataactcatgcagtctctcaaaatgaaattactcagttcataccagaacacatggtactgcaagccaactctgcccacattttccctttgaaagttaacaaaataacagcaccagatagtcctctcccaaatttcagaatcacatatcccagaatgtagattcaatatggagactaaataccaacaaaatatgtatcctatcaaggagactagataataataacccagtacgcaggcaccatataacattagtgtttctgttttgaggatacattgtttagctgaagtctgaactgtgagagacgagattggaatgtttcaaaggcaacttgtacaatactttctcagccactgaaaatctacgtaaccttataaagtcatcttccattcttaaccgtatctccgtatctgcaaataaggcataaaaaggtctttctccaaccacaaataccccaaaagtaaagtgaaattagtaaagcaaaagaaaaatgaaaaaaaaatgtttctttcaagttcagaaagctcaagagtcctgatttttttttaacacatagttcagagcttgctcaatttagtttccctggaggaaagttattatctttatttaaatgaggagatatcttcagaggcaacaggagaatagtttagccttttaggtaaatcctattttcttcagagcactgtaggagggtcatatttctgtaatagttatagaagatgattttgggaagaaacagtaggctctcattatccagacaagatagataaataggatcctgtgtcctttttggagatgactttgccctcaatctcaaacttgccaatactatcattttatgaaagacacaaagtttaaagtaataaagtttccttttaggtatatacaatatcagaactctttctgcatatattggagagtcttaaaggtcagtttttcagcctatattttttaaaacaatagagaatacggggggaaagagagttgggttatccatttcttgggaaattaaatatttgatatttattgataaaaatgttctaaatttcacatcttgattattcgttactacatctctaagaaagctatggcaaaatccaaaggagtcaaacagttaacataaagccaaacccacatttcatttagcgctaaggaggctcctgaatttgtgcaaatcttagaaacttaattgactcactaatcctataacaatggaaatgttgtgacttttaaaaattgaaacagattgtcaaagtgagtagcgaattaaaagattgactttctacagctgaaaataatcagggaaagcatagaagacaaagtggattttatgctctacaacaattcatttcaggcatttcaatgcaaagtaaaacataaacagatgttgaaaacaattaacctactgaacctacctgctgaaaaggaatcctgcagtgaaaaaatacaagtaatgatgttatgcattagatgaagcagcaatttctttctgaatacctaaagcaaaagatgaattccaaacttaacattcatcatatgttttgctatagttccatgaatattctagttgaaaaatgagaaattctgtgttgaggtttccattacaaaacacgtctatgtgacatgttaaaatcccagtaatttggtttattccacaaatgcttatgtaacatctattctgtgttatagggctataaagatgaagaaaacatagtccctgtcctcaaggagttaacagcctacctccaagaagatatacagcttcacaggtgacttcaataccctatgactagggtaatgcagacatgtaaaaagtacaacaacaaatcaaccataggtgcagtgtgaacttttgcactgaaacaacagtatttcttgagcgtttattccaatgagcctcaaagcacatgtctgttggttgaaggaggaggggggccaaagagaagcaatgtaattgatattccgagaaggacaatttttcactgatggactctctcacatattgcaggatatttggcatccctggccaccacctaataaatgccagccatagcacaagcacacacacacgtgcacacacacacacacactcacacactcattgtgaccaacaaatagctcctactttatttccaaatgttctttagagtactgccttccctagttgagaaccacttgggccattcagcaatcatctattgagcaatacggtgtggtcagcttgactctctggatacaaggcacagccctaagtaagcaaactgttacccttcctataggcattaataaacactagctctttaggtaagtactaaatcttatgccttttttccacagaggtatgggacatttaaaaaataataatcattatgtctcttaattgtgtgtgatcatcaccctacctggaacacaaagaacacagaatttgaatgtcaacatcaatcgaatatcaatcaaaaagaagtggcagaatgtattaagtcctttaaaacatatactactaactatatatatataacaaaatatatatatatataatatataactaacatatactactcttgaaccaggagtcttgagagagtatggagtggtactagggtagaacaacacacatggagtgattatttcttgatctggcacagcatgaggctttaagccttggtggacccataccaaacatggtccatgtaggactttagactttggacagtctctgcagcctatgccagttcccagtgtttcagctgtggctgaggtaggatcaagtttttagcttctggaggtgaacaggacaaaaggtgctgcctggaaactacaaaacagctgagattctttggttctcaagaagtagatgtgagcttctagttttgactatttgtgccagtcttaaaataagtattaaactgaagaaaggctgccccaaattctattcctccttatgttgttttaagctacattcagggccatggaaagaaacagagaaggggagatctcaatccttaagatgcacagaatttgttcacaggttctagccaccctctatcacatgatcctaagttcactctggatttgttaaacaaataatctctgacccggtctctagatttcatagacctaattcatggattcagctgtagatttacccttctacagctggtagatttacccttctacagctggtagatttcatttgaaaacaaaaatatacaaggctttatcatcatgtattccttcttcttggggtgaagtaggaacacaactcaataaaacttttgcaaatgcaaaggctaaaaaggcaattcaaaggcctgtgcattaaacatcctgtctctacagaatgtttatctcaggaggtcaaaaaatatctggaatggtttgaaaaacatagttcagtcttactttcagaaaaagtgttgactaaactactaaattagaggaagacataagtttccttaagagaagggttgagttttgagcaggtaggctgagcagataagaaggaaaaagtgagactctgaaggtctgtgtggatagatatagacgagcaaggagttgcacccaggtctaatacgcttaaagagtttattggaaagagagagatgcttctgataactactagacaataaagtatggctggaacccaaagaaatcaaacagaggaagaaagacaagttctcagaaaacaaatgaattgtctgtccccaaaaggtcaaggatgtgataaattactaaaaggcagttttttaaaagctgcagatagacatttgattgtaaaaacaactgaggaaccatgcctaaaagattggacaactggtcagacaaggtggctcacacctgtaatcccagcactttgggaggccaaggaatgtggatcacttgagctcaggagttttcaagactaccctgggcaacatggcaaaaactcgtctctaacaaaaatgcaaaaattagccagacgtggtggtgcactcctgtggtcccagctacctgggaggctgaggtgggaggatcactggagcccaggaagtcaaggctgcagtgaaatgtaatcataccactgcactccagcctaagtgacagagaaagattctgtcaaaaacagaaaaaaaaaaaaaaaaaagattggacaactatgccaagcagcttttgaaaatctggatatattgaacagggtaagatctggaaaatcaacataaaattatccaataattcttacgtatcaagtttcagcctgacacagttattataggtgagtacataagtactgtgtgtgtaatataatagaaaatttatggaattaggaaaaagagaagacatagcaaaaatgaaaaatatttaaaagggagctgggcaacccataatagattgagtccaagcctaggttagatgcggatttgagaggagaacaccttctgggtaggaattagccaactcaggaggataatggtagacaagatttacttgaacatgaaagcattcagcagacccaaaatctactcatatttctcactatgggagacttcacaaaggaagtctagaagagcaagttggcaaagatcatggccagaagacaaagagaaactaaaagcaaactgagcaaaaattactgaacctacagaaaatatagataggaaatgactaaattaagaaggaagttaaactcttgcaaactcaacagggccttcctagaggaagaggggacagagacaaaaatagccagggaaagacaatctctttacgaggagtaataaaggctaatatgaggaaccaaccattcctatgcaaaaaagcaggagacagaagcagcgagagacatgaagggaatcagagtctcccaaaaatgggaaggataacgggagaggagaaatgatcccattagccttaactggataagggtttcacaagatcctgattcagaatcagagatcagaggcatcctgcatctcatctgtgtaccttgatgcccataattccattaattcccaccagccttctacctccaaattctacctccaaattctagtccctgctttcctgcccttaggatctgtgagacatcaaataagccaaagataaaatccccttcgtcagtttagccagttctaagaggttttcataacctataatcatcagaatgctaccaaatacagaatgctcccaataattttatagaccatccagggggatcctaattgaaactgctattacaatcctgaagccagacaagcagccccatctcccagggtttgggaaatgtccggagtataaaagtgcctgactccggaaagtgtcactttcctcccctcccgacacattcttctttcaaatggaaccatccatggtttcaactattgttcatgccagtttaaatacatagtggcagtcaaaagaaagagagaggaatttctaggagcaagaaaagaaagggaaactgaaagccagaacagtaaaagttgaggctaagacatcctggaaattagggttagagggaaataatgagggtgaggggagaaattttcttggacgtcagactaggagcttgggtctggggtttgaatgccaagaaagagacctgagaaaaggcctaggttaggagctggaaatgagaacctcaaataaatccaggactttcacaatgctacactgtcagtgaaaaggaagttagaaagctccacttagcccaaggaaaggactaaaaaagagcatccctgtaaaagtgaaaacaataaaaagctcttatgagaaatgaaaaatttgctgtacaaatttacattgtacagcaagtgtagaattcccaagctgtgaaattaatataaaagtagatctcagactggtaattctactagggtgcctatcagaagcaaaccaaaaccactctgcacttccgaaactgccccctgcccgaaaaatgagctcacaataaaaaatgtaaaacacatgagaaagtgatctgataaactgtgctaagaggtagaaatagaatatagacaagtcagtagtccctgtccttatggaatacacgaactatcaagggaaaaatagagtcaattgttacacaaatattcatttaattactattgtgattaatgctatagattgagtcatactttttatgattaaaaaatgctatagaaagtacagcataaataatttatggcaatgtgaaaaatgaactcatggctgggtgtggtggctcacgcctgtcatcccagctctttgggaggatgaggcaggcggatcatgaggttaggagttcaagcccagcctggccaatatggtgaaatcccgtctctgctaaaaatacaaaaattagccagatgtggtgacgtgtgcttgtagtaccagctgctcgggaggctgaggcagaagaatcgcttgaacccgggaggcagaggtttcagtgagccaagatcatgccactgcactccagcctagacgacagagcgagaccccatctcaaaaaaaaaacaaaatgaacttacaaactgacctcaacctttttattaaaatatgttcaatttaactacaacagagagcagtctcatgttgaaaatacttcaatgattaggaatattaattaatatttattataggtacttatatatatataatattagaattattatttcagtcataatcaaataatttaccttccccgcttctttccactgatggttttaaatattttaaataatatgttaatacatacttataaaaaaaactgtctgaatgtttaatatttatgatcggagttcaaggtattaagaattatgtaacattttctaaaattataagaagttgataaaaagaaaagaaggcttttgagagtgtagatcccattgttccatccatcacatttttaaattttgttttgacgtctttccacagttggtattcccaagcaagaaaatattttttaaatgattgtctcatttcttcccagcgctaaagttatctgtactttgagacaaaaccaaacatagaaatgataaatgttttaaactatgtatattatagatgcacctaatttgcttatgaaaagacaaacctccagatccaaatgagaacagactaaactaatttaaaagagttctataaatgtttaatacttgcctagctttcatgtatcaacttttatccttttcaaaggaaacacaattaagaattgtggatgtgaattaagggattataaataatcctattttcaattgaagaagttaggggaaagatatttcatttaagattaagttgtatattaacagtatactaaattgttcactactttcaaaaagaaaaaatgtccatgactacaaataaagtttgtcttagggtagattttttaaaaatgcaaaagtgaaatatctcctgaaattattaaacaaaatgtatttacttttttcctttttaaaaaatttaaaacacacatgtttacagaagagttgaaggtacagtataaggaactgacccattttcttctgacttttcttctgacccgtttgatactcagttgctaaccagatgcctcactgctccagaatatattaatggatatttcctataaacaaggacattctcctgcctaaacacaacacagccattaaaatgagaagattacattgatatattgcaaccacctaattctcagaccccactggtttttccattagtctcaataataccccttctaccaaaaggatctaatttagaatcacaattacatttggttttcacgtctctttagtcttcttcagtcttctcttatcttttatgactttcacagttttgtaaattacaggccagttgttttgtagaatgttcctcagttgtggtttaggattaaattcagacatctttgggagaaataacacaaaagtgatgttgcatttttctcattgaatcctatcaatttgtccttttattgatgacagtcatatccaacacatgatactgttgggatgggtcaagcctccccattgtaacattattttgtggagaggtactttgaaaccatgttaatataccatctcttcaaactttccatttcttttttttttttttgagagggagtctcgctctgatgccaggctggagtgcagtggtgcgatatcggctcactgcaacctccacctcccgggttcaagcgattctcctgtctcagcctcccaagtacctgggactacaggcgcgtgccaacatgcccggctaatttctgtatttttagtagagacgggcttcaccatattggccaggatggtctcaatctcttgacctcatgatctgtccgcctcggcctcccaaagtgctgggattacaggcgtgagccaccgtacccggccccatttctttttttattcgcttacataagcatggactactgttttcctatttcattcaatggtttataatttgttactatcataatttacttagatcctcaatttgccctccatttggccaatggaagttcattaaagctggctgctgtgtccttgtgacatgccccatcattctttgagcacttccttgctttttggaacaagatgctttgaattcatctgctactagccttgcatcacccttggaatcagccatttctccaaggatcctggttcctttttgtagaaaatgacatttaaaaaacaagatctgagggccccttggtatgcatatgatgtgctcattgttcctggggtggtgttgttcccagtttctctcagcagaaagagctatatggaaaaatgtatttatattgtgtgtgcattcacatatgtacacatacacataggcctctgtatttatttctatatctatctttacacattgaaaaccagatatttatacacatatctccagtttcaatcccatatcacagaggtccagatctactatactttctatacttttaaccccttttccaacagggagaaagctggtttattgttaatacatttaattgcttgatcaatcccccagtctgtaactaatttcccatgtcccagccccagctgccatgtgggcgccatgctcaccctgtcccagacgccgtgctcattctgccctggctctcctatgcatggacaccttcctcctcctactcagaccctgaaccccatcttaggttgacctccacacacaccatccttaccctgcttaggcaccaacatactctgctggccacctgtccttgttgatgtggctgacgtgctgctgtccctccccacactttagaacccaccttactctgtccactgaaccattcaggactcagttgttcaccaaggagcaaggaataggaaaatccaaagttttgaaatctatggaaagcaatcaatgctattccttttttttttttttttactccttttttctcctaaagcatatataaaggagaataacaatacaagagcatttttaggagtggctgacatgaaatgatttgagaatattgttaggaatatatgtttcttattcaaagagcatttttgttcctcttatttgcattcagttaatagaggtagtgttaaacaacaacagaaaaaaaaaaaaaaaaatacacacacagtgctaccaggaggccaaacaggtaagctgagcttgtcataaaacaactcggaccactgaccaaggcacacccaggtgagatcttgcaggtcctttgttggggccacttcacgttctcaccaggatgccttaggaaaagcttttctttctttctttttttgctttgtagagacagagtctcagtatgttgcccaggctggtcttaaactcctggcctcaagcaatcctctcccttcagcctcccaaagtgctgggattacagccatgagccaccatgccccaggttcaccttctttgttttaatttcaaacaggatggaaactcaattctattgttatgattctattgttctgcagaagagggcagaataaaaagcaccacaggccagattagagctgtgtatccaagtctagattttgaattcaaaaaaccacaaaggccaaggggaaagagaacgctaaactctcaagtttgtcctaacctctttagggaatgaaactggacacagccagacagtccttcagtcattcctagcttgaaagatccctccccactctgccttgcttacccaacgtgggcagctgagtgtgacagctttgaggggcctccccagggctatttttaacctggtgttatctgcttacagactttccaccagggcagccgcaggtccagggagtcactccacctgggaaatgtgagcacaccgctggcctgtggcaaatgaggtatttttaactgagacttgagaagctcagaattgtcatctgcttcaggcctcagggtgcgagacacaaaacagagccaagcaagagaggctgtgtgcggactctccagttccttagcaaccaattgctgggcttgttgctggaggagggctctgtaagtgtccggatcagcgatggaaagccagcctcagagtctttcctggcaattatgtggccccctccccatagaagtgaggcctgggagtcccccttgcaggcgaggtattctgccgggctttcccacaccacacctatctgcggctaattagcatcacctgggacttgttagacacatgaattcttgggtctcaacccagacctgttaaattagaaactgacaatgggacccagcgatccatgttggatcagaccctccaggtaattctcatgcacactaaagttctaggatcactggcctaatcacacattcgctaacattcatagataaagacgtaagagtaacacttgaatcccaccaagcccacattgcagtaattcttttaaatgaataacttttagaacatttttacacttaccagaaaaaaaaagtgagcagatagtaaaaatcaccagtaactttttcaaaccactgcttttttttttttttttttttttagatggagtctcactctgtcacccaggctggagtgcagtggcgtgatctcggctcactgcaacctctgcctcccaggctcaaatgattctgctgcctcagcctgccaactagcttactagattacaggtgcccaccaccatgtctggtcaatttttgtatttttagtagagacagggattcaccgtgttgtccggactggtctcgaactcctgacctcagcaatctgccagcctcatcctcccaaagtgctaggattacaggtgtgagccactgaatccagccaaccattgcttttttctgctgctcactgtaccctaataagaaaacctccttcctctgttcgtccttaaaggcagtgataagacaccaactgagtttttgccatcaaaggcggcaattgggtcagagaaagaaatagaccccagcgctaagggaagatagcagtaatgcacaaaaaccctaggaatgactgcaaatgcctaccccagcacaagctgagatgaacaactgtgattgtctaagactctgcagccagggcaacaccttcacaaaacacgcttggaaatgatgtgaatatttgtgtatcagttatatagttgtttcttcttgctgctgtaacaaattaccatacacttagtagtttaaagcaacacaaatttattgtctcacagttctggaggttggaagtctgaaatcagtttcactggactaaagtcaaggtgttatcaaggctgcttccttctgaaggctctcaggggaaaatctgtgtctttttcagcttatagtggctgtgtctattccctggcttgtggccccttcctgtatcttcaaagcacatttctcctcccatctctacatccaccatcactaattgtcacatgtgattctgacctttctgcctctctaagggctttgtgatcacatcaggacctcccacataattcaagataatctccccatctcaaaatcctttatttaattacatttgcaaagtcccttttgacatagaaaataatattcacaggtctcaggcattagtatgtgggtttatctagggggtcattgttcggaacatctcgctccataaagccctgtaccctctaatgccatagacactcgctatgtgttgtcattgagcacctgcaatgcagctcatttgaactgagaaatgctataagggtagtgaaatttaaagacttgttatgaaaaaaaggtaaaagatttcattaataatttttatgttgattacatattaaaattataaaatcttggatatattgagttaaataagctatcttattaagattaaattcatctgtttctttttgctttttcaagtgcagctactagacaattttaaattacatctgtggctaacattatatttctattggagcagtcctactacagaccataaaggaggcagggtgacattaactttcagttgttttatttttgccttacttataagagagcccagactttggaagcaacatttcttctttctctagagagagccactaaattcctgcaattaagatgtcaattcaagagagatattttattagggatatgcacaactagataagcgtaacaataaaaaaaatacatttatccagcaacatgcattctaataaagcattttcattaatacattctttcattaagtcctcattacagccttgtaagagatgtattattccaacttttcagagaagaaaatggagcctaagggaaattaacttgctggaggagcacccagtcagtaagtgataagctagaacttgagcccatgtctatgcacctctgcacccaaggctgcctgactgatttcctggtttgggtttagtggtttaatcaggctcactctacttcctgagtggttttactttccaccctcctaaatttcagagatctcaggattttccctttctaccttaaagttctgctcttttgctattctgagcacatttttattatgtttttttaaaaattatttcttaactttgaaggcataggggcatatttcccacccagttatttaaagaagattttctcctgtgtcacacttcctcagcacccagaggcacacctggcacccagcttgatcctgggccatctggtggaagagccctgataccaatgactgtctctcctcgttctgttcaccacccatagctgcatacataggtaagatgttcggatctgacctctagccagagtagataccctcagagaaaccagagctatggtagtttaaactgcctcccagctttcctctgatcagtcttttggggttgaacaggcaatttttcactttggcagagggtcactgtaagaagaattagcaaatgcccactaagagggaagtggacactaaggtcatgtaggatgccccttacccaggcagcactcctatggcataatcagaagtatgtgtttgttttttttcccaattcctgacacaggactccttaaatcccttggaatatcctgagtgataagagtgataagagcaccttttgttctaacttttgttctaacgaggtgattcttggattcttgaaaactcctagctagcttcaggataggggctggtctccagaaaaaccaaactttgattagaagcctagagttttcagccctactccccaacctcctgggaggagagagggctagacattgaattaataaccacatactcatgcctgtgtgatgaacaaaatctccataaaaacccctaagtgtcagggcttagagtttctgaattggtgaacacatctacattctgggagcactccaactccatggggacagaagctcctgcactttctaagggcattgtgatcacatcaggacctcccagataatccaagataatctccccatctcaaaatccttaatttaattacatttgcaaagtcccttttgacaattttgacatataaaataatattcacaggtctcagggattaagatgtgggtttattccaggggtcattgttcagaccatctcacaccatataaccctgtattctctcataccgcagacatttgctacatgtcgttattgagcatgtgcagtgtagctcatttgaatggagaaatgctgtaagggtagtgaaatttaaagacttgttatgaaaaaaaaaggtaggcccggcgcggtggctcatgcctgtaatctcagcactttgggaggccgaggcggacggatcacgaggtcaggagatcgagaccatcttggctaacacggtgaaaccccgtctccactaaaaatacaaaaaattagccgggcatggtggtgggcgcctgtagtcccagctactcaggaggctgaggcaggagaatagcgtgaacccgggaggcggagcttgcagtgagccgagatcgcgccactgcactccagcctgggtgacagggcgagactccgtctcaaaaaaaaaaaaaaaaaaaaaaaaaaaaggtgaaatatttcattaatttttatgttgattacatattaaaattatgaaatcttggatacattgagttaagctatcttattaagttcaaatttatctgtttctttttgctttttcagtgcagctactagacaatctaaaattacatctgtggctaacattatatttctactggggcaggacccttctggaccttctggaccttctggaccttggcctaggcacctcttcatctggctgttcattcgtatcctttatcataaaccagtgaatgtgagttaagtgttgtcctgagttctgtgagccatcagggcaaattatcaaacctgaagagggagggagttatgggaacccctgattcatggccaatcagtcagaagtgcaggtggcccagaacttgcaactgtcatctaaagtgggggcagtcttgtgggatctggcactaactccaggtagatagtgtcagaattgagttgaattattggacacccagttggtgtcagagagttgcagcagtggtgtcaggaaagataccatgcatctggtgtcaggaaggaaaaaacacaccacttgtcagctatcagaaagggaagagagaaacaataaagtaaaatgggacagtgtcctgctcattttctgctgccacataaaaattatagcctttagattgaaaaaggccctgaaagagtaaatagtccaactacctcattttacacaagtaaaccaggatctaaaaggttaactgacttctgtaaaatctcagcaacctaataccaacttcttattgaactcccctttctgatgatgcttgacttggacaaaactgttttaaaggatgacagagaaatagtaaataaaacaatatagctttgatttccaaaccacactacagagaagtagcatcttgctcccagaataaggctctaaaataggcacatgaagatgaaaatcatgtactgtcaaactaatccctgaaaagccttaagagagtgtcacattggagaccaatgtaacttccaacaataaatcccacatggtgtttgttttttttttgtttcagagctggaacaggctcatcggttgagtaccagattaattaattggcttgaggttagggaataaaatggcacaatctttaaacccaggatcacacgtggaactgcaaaaaggatacacataaaaggcaccaggttctgaaactaatggcagattcctttctctcatcttttgctcttactccaggacactgaatagaatgactcatattaattaaacattcatctctcctccctgcactcatggtttagggtttattgcttagttagaaaccaagcttcacaagtgcatgaatccctgttttgttcatagatgtctcctaagtgcctaataatatacctgtcacataaatgtttgttaaataaggagatgaatgtattctttttgtccagcctgtatagttgaattctcatacattaaagctatttaggtctagctatggctttcacttcttgggaagttgtggtgctattaccagaaaaattcaaacagaactatgcataaaaagatttttcaccattcaggaggttcttggagtctcagattaagatttcctggtactgtcaatctctatctatgacacttcagcagaatgacacttttgtggcttcagagacactgacacctactttcatagctgcataggactttaaaactcccccaaagtgctacaaacaaaaagtactcttcaagtgctgtcaacctaaaggttaacaggttgaagggaccctgggctaaggaagcacaagctggagacaccaaaatggtcttcgcaactcgcctctatattttctgccctgctcctaagccagcctgttggccgactggcccttctccacagatgtcatcttgagcctcttacagagtttcagcactgacattaatgacaagatggatcacctacaggacaaccttggatcctcaaccagcctgattaagcattgacactgcatttgtcaccaccagctctgatggtttggacatgtagaaatgtattgcaggagaatatgcaaacagctgctgtaaggtgagctgatcgggacaactgccagcaggcagaagggaaggcataattaatgggcacccttcagcagagctcagagcagaccaaacgccaatgcagaaggctcaagaaagaggcaaacagactagccactgctccaggatgactgtggctctttatgagtgaagagaaagggtggagactgaagacagaactggggacagtgacaggcttggggaagaacagctgattcagcagtcccaaggtgagtcatcccatgtgttccacacccaggtagaaagcgctcattagcagaacataatctcccaacctgcatgatgatcgtctgtccatgagaataataaacattacagattgtgcttgcactaaagcagatttagtaaagcctcaggaacagaatatacttcatggggtaagaaatccagctagggaaaagactgacctatctatgcatctgtaatgggttgaatagtgtctccaaaatatatgttcaccgagaacctcaaaatgtgtccttcctttgcatatagggtctttgcagttgaagttagttaggacaaggtcatactggattagggtgaagcctaaatccaatatgactgatgttcttataataagagaacacacagaaacacacaccaggaaggccatggaagtaaaatatatagtttgtcaaatgaggatgagttcaagaaggggtcctacgtagtgaggtggagtattagtttttaagcctgattaaattaaacacttggtggatctttcccccaaacattgtacttagtattatagtgctttcattcttgtaaaaaatggtacaacatgtaggagtacatatggagggagaagagcctccttctgttgtattagtttctgctgtaaaaccaggaaaatcatcggccataaagctcatagggagggaaaagaacaatacataagcaaaatcatcaaggctgaaggggagaactcagaggattatgtgactaatactcacttgtcagtgatttatacatcaatctggccatttactattcaacaaatgcctaggccacgtaagagacctcaacaaacggaagtgattctgctataggaaaccacttcttaaaagaaaaagaagcaaatagaggtgctttacaggaaaactttttcttttcttttctttctttctttcttttcttttctttttttttttttttttgagatggagtctcgctctatcacccaggccggagtgcactgggatgatctcggctcactgcagcctctgcctcccggatttaagcaattctcttgcctcagcctcccaagtagctgggactacaggcaggtgccatcacgccctggtaatttttttgtatttttagtagagatggtgttttgccatgttggccaagctggtctcgaactcctgacctcaggtgatccatctggctcagcctccagtaatcccagtgagccactgtgccttggcctaggaaaatttttatcatcctaaaatcttatatcatcactcaagcaaaagaaagctctagaactgcctgagagaacagcctgcaacgaaggagatcatgtatctgtgctgcccaatacagttgccaccagctttataaaataactgagcacttaaaatgtgcccaaggagactgaagaaataaatttttaatttgatttaatgttgattaaatttaaacaaccacaattggctaagagctactccattgcatcacatggctctagagtcacagaaagctgcctgtggaaaaagtcttgagacatttctcaccaagtctaggatgagactggatcctcaagtaaaaacagattaggaaacaaatcaccaaagcaattacgagcaagaaaaaaaaaagctagaggtatcatacgtcatgatttcaaaatatattacaaagctacactaatcaaaacagtatggtactcatatgaaaacagccatatggccaaacagaagagagatcccagaaataaactcatacatacatagttgacaaggatgccaagaatatacaatggaggaaagatatgtcttcaacaaatggtgctgggaaaactggctacacatatgcaaaagaataacattggaactttatctcatgccatgcacaaaaatcaagttaaaatggattaaagacttaaccataagacctgaaactgtaaaatttctgaaagaaaacataaaggaaaatcttgacattgatctcggcgataatttcttggatacgacaccaaaagcataggcaaaaaaaaaaaaaaaaaagcaataataaccaaataagattatgctaaactaaaaagcttctgcatagcaaacgatatgatcaacaaaatgaaaaggcaatctataaagtgggagaaaatatttgcgaatcatatatctgataaaggattaatatccaacatatataaggaactccttcaattcagtagccaaaaagctaatagcctgattttaaaatgggaaaaagacctaaatagacattactccaaagaagacataaaaatggccagtaagtatatgaaagatgctcaacatcaccaatcaacagagaattacaaatcaaaaccacaaagagatttcagccctttgccactgttaatgtgatcaaaaaacaaaagataacaagtgttggatgccaagaaaatgcatctcttgtatatggttcatgggaatgtaaattggtgcaaccattatgggaaagagtatggaagttcctcaaaaaaattaaaaatagaactatcatatgatccagcatatgataccagcatacagtatagaactaacatatgatcccatttctagatatgtaaccaaagaatttaaaattgggatcttgaaaagacatctgcattcccatgtgcattgcagcattattcacaatagcaaaaacataggagcagcctaatgtccactgatagatgaatggataaagaaaaatggggtatatataaacagtatgtatatatacatacagtacaatattactcagccttaacaaagaaacaaatcctaccatttctgacagcagagatgaacctagaggacactatgctaagtgaaataagccagacacagaaggacaaatactacatgatcccacttaattgaggaatcttaaaacagtcaaactcatagaagcagagagtggaatggtggtttcccagaggaggaggaaatggggaggtattggaccaagggtataaagtttcagtaatgcaagataaataagtcctagaaatctactacacagcatggcttctgtagttaagaatactatattctatacttaaaaatttgctaggtgggtagatcttatgttaagtgtccttataacaaaataataataacaataataaagatggcagaagggaacttttgaagatgatggataggtttgtgacattaattgtggtgacggttttatagatgtatacttgtttccaaacctatcacattgtttacattaaatatatacaggtttttgctcgccaatacttcaataaagtagttttttaaaaaaaggttagggaaccttcaccagaatataccactattacataaagtacttctagtacgtattccacagtctgcagtgtccttaccagtggtcagtagtaccatctacattttctgaccaaggaaactgaggcccagcaagattatttgacttgcccagagccttgcggttcttaaggggcagagtcagaggtctgacaccaaagctcctactcttcccaccaaggcaggtcatctacagcaccttctactcttaaggggtctgccatttccaccctctctgaacagacataaaacaaacaagtgtattatgtctgtgtgtgtctttatgtgagtgtgtagactctgaggaacaggtaagtcttggaatcccttgagtgtttagtgtgaacctagtatgtttagccagccagtatcaggtcagtaccctttagccagccagcctcattttccatttggtccagcaaaatggaatgccaagaatagtgatggggctaacaggatgcatgaatccatacttgttgaataacttattaggtagaagtagcaggtcaaacaaacctttccccctcagatacgctcagcaacaattcagtgttgcggctctcctgctcctcagagagctcttattaccccagcagtggggacactcagaaaccctaagaccacaagtctttgtgttgaaagaggctacaagtgcggaaaagaggaaaaataaggaaaggagtacctcattaacagtatggagatttgaaagtacaggcttttgaaagtgactctctgaagctcctgggccactcagcttctcctctaacttcctgtctgcccccaacagtgggggaggtcaacagaggggctggccagtcaatagaactagcaactgctgaaatccacatgaagctatggtggagaatgtgacccttccaaaaggaaaccacagctggttgtggaatgcaagatgcggaagcactgatgcctgccttctatgctgttgctattgtgatttctgcagcattatgaggaaggtttctgatggaatgaattttgcatcttttaagaaagtgtctctgtacctggatatgtgcttgataaggttaatagagcaattcttggtgtgtctttttaacccacaggaaggttaacagaggctttcatcgttggtcctgtaagcctaccctgaaaggaactttctggaaagagtcccctcccccttaaaaaatgccttatagaatcttggggttttgaggttgatgtgtttccacacccaaataaccccaaaatagttcatcctattgaaattcttggtgtcctggaaagcattctatggaaaacctgcctggtcagccaagcccacacgtgagtctatgcagacatctcctctaacctcgcaagccccaggaacctcctctaacctctcaagtcccaggatctgaggaccaatttttagcacaatctcacacaacaaacctattgggcacctaataatagaaacaagctaatgaatgttttgactgtgacaaaaaaaaatggtttaataactttttataaatgcattgtttcttctcattgtctcagggttatgccaaaattaatttcaaaactatctgcttaaatgtgtccttggacaataatcaccagtaagtcctgacttcaccccctttctggtagcggtctgacgttcctttgcagagtttcgcttccatcgataagttactttaaataaaaagttaaaataaaaactagaagccacaattgtgcctatgtcagtcatcgaagtcttgtacaggagtccgtcttcgcagcgcatcgttctcagaagtttcccgcgggaggaaagctccactttatgaattactcgaacagcttccctgggaatgcccagccccgaagcttccctgctgaattcaaagtcagagctcccagggctcggtcccaggaaccgggagccgtgcaaaaagcgcgtacactgccatccactggccccgagcaggtagtagcaggagtgaggcgcctgccacgggagctcaggaactgggtcccagtaagatccgacaagacaccacctcccttccgcccgcacagcctgccctctctgcctgcagctagcgtcaccggtcggtccccgattcggagcagctgggaccctcgcggtagcaagcggattccggggccctaatgacaccgaaggagaggggcagccgcaaattagaccttcttcctgggggctcaggccagtagggactgtccgtggtgcccttccctttctttctcctcctgaacgagagccaacgctgccccttcccaggactggatctgagccaaccaaatcctacagcgcagagcctgcgcccccggcggccagccctcctgtgcctaggcaggttcacgccggagaaagtttgcacgcagggacctacaagttcccagcactctgcaagagggccagttctgggatgccagcacttaggacgggcgagtgatccccaggcaccaactgggggccggggaaccaagcgcgagcccgggctgtggagggaccgacacccaggcgctcgcagctggggaagggggcttacgtctggggcaggcaagactgctgcacagtccctccagccacccggcgcccgagacgccggcgcagacaggaagctgtagatccccgaggggctggctccgacagctccacctgcagcctcccctgccgccagtgtgcagccaagtccactagatgcttggagggcaccgtgcggaggagggactctgcaggaaaggtggcatcacccccggcatggagaccggggtctccggatcgagccgactcgaacactgaaggaaaccctgcccatgaccctgggagggtctcggacgccgggcgaccggggtggtggtcgggaccagggccgtgcgcctgggaactgggtgcagggcgctgagcgcggaactgtcagagcgggagctcaccggcggctggggaaggaggtggcatcgggcggaggagaggacgggggcgggaggggctgaccctgaattcaccgggactaagaggccatcacacctggctgcggtaggacagcgaatcatcgatcttaccggctttggggacccggctctgcggcagcgctcttccggagcgagggcaggagactgtttcatggataaaaagtctcgcttattcttctgtccacttttatcttggtcgcttttctctcctctacgtgtcccccggggaggcactacggatgattt

SEQ ID NO: 2149 - DNA, 30948 bp, Homo sapiens
atgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 2150 - DNA, 30948 bp, Homo sapiens; identical to SEQ ID NO: 2149

SEQ ID NO: 2151 - DNA, 30948 bp, Homo sapiens; identical to SEQ ID NO: 2149

SEQ ID NO: 2152 - DNA, 30948 bp, Homo sapiens; identical to SEQ ID NO: 2149

SEQ ID NO: 2153 - DNA, 30948 bp, Homo sapiens; identical to SEQ ID NO: 2149

SEQ ID NO: 2154 - DNA, 53086 bp, Homo sapiens
taaaggcttaaacacaatggaagtttatttctcaataacggaaagtccaaatccatgatgctttaagtcagggacccaggttcctcccatcgatgcctcccaatctgccattgctaacctggggcttccacgatggtcacactccttggaagtgagaagagcagacagaggacatgtgggaggtttgagggacaggcctggaagcagcatgtgtcactccagtgcagagtccattggcctgcgccggctccaatggctacctctcactgcaggggcagcggggaaatacagcctggctgtctacccaggaggaagagtagccagtttctgccacagtgataaggttagaaaatgttcagtcgggtgtggagtgattatttctcctgtgtacacagcaggtggagaggggaaggtgccctagatattggacaagaaaactaaagtcattggaagtttgtcttttgctctaaacttaaggccttggctctctcatttgtaaatcaggctcttggtgaatttggttagcatgaattcattctccagcaccaacttattccaaagtgagctagacttgatgagcttctccagactaagcacgagatcttcagctcatgagtctatcacgtgcagtcttctgagtcccagctgcatcccccagctcaccttcttcatttcttggtatgaaaataaatctgattagagagtccactgaaaacaacgtcctccacagtagcagcttcagttggaagagatctttgtacacatctagtctgatccctgccccattagaggtcccataagtgatgatctaagccagcagtgagcttatcacctcaaaatttattctctttgggatagatctaattgtgaaaatctgtttttctttatatactgagctgaaatttttcagtttgtaagttcatttctctagagctacacagggtaaatgtacttcagccacaggaaaaccttttgaaacattacacttgcaggaattataaacaaaatgtaaacattccttacaatgaatttctccttttcttaaccatgtaaggactgttcaatttaagacaagaatatgattgagtgacttttgtattgtaggcagaggaatgaggctgactggaacaagagctgagcttgtcttttaatcttctattacacggtgactatcaggagctgtgaaggttctgaaatttgaccttatttgcaaagttaacaagtgagtctgccatagtttcaggatgctggcagaagatgtgagattcctgggttagagataaagggtggttaattactcatagcaatagcagtagcctgagcaccatcattttcttgtgctggttccccaagtcccaattcatgggagacaagcagagccaggtgacaactccatatacagggtgtgttacaggagaggagccctgagtttaggaaaccccaatcttttattatgggccataagtaaacctgctgagctttgcctaggggaaaacatgatctttattgtaccgaacagcaaacaaaccagtcatttcctccggagggagacactacctctgttttccaaggctgatctcatgcaaacatccttgaaaagattatccagagcaaagacagccagctctgctgcttgtaatatgtgcagaaacaagaggcccctggagaaatgtctcccattagcattcacgtttgacttcatttcaactctttcataaaatatgcaaatcacctaaacctgtgcacttatttttctaaacctcccaccaaaccaaaattccatgctaaaagatacaggagctattacagaaaaaggaaaagggaaggtgggagctacattatctcattatttccctactcaattttatttacaagtttctctattcttttcattcacatccaagagagtgcttttcctccaaataatgcagatagaagaaactgattggtagcaatgcatgaattcaactgaaactttatatagattatataaaaactggaagctttggtggagggatcatgacagacgagaggcaggactagattgcagctccaaacagagcagcatgcgaaggcttgcattgtgaattttagctccagattgactgcaagaacagactagcaatcctgagaggacccacagaccctctgaaagaagcagactgctcctgtaggacccaggagaccctcaaatactgtgagtgccccaatgtggaagtgggaaagggagaccctcctctcccgaacacacacccctcactggagaagtttctgactttacctggaggtgagtcaagttagagagctgagccaagcaaaatacaagggtagaggaagcagcagaaaggcgctgggagctcgctggatacccaagcagcccattcctgcctggtaccacagggatccatcaggagggtggcagaggagcaggagataaaactccataggaaggaggacttctctagctgaactttgttacaatttgcacggggcaagaagcctcctggccagaactcggggaagggcgtgaatccggcttgcagacttcacagacgggggaagaactaaagcccttttctttggcagctgggaggtggaaagcctggggcaagttttcaagtccgacttgccctccacccggaaacagactcagggctgttcgtggtggggcatggtgggagtgagaccaacccttcagtttgttctagggcccctgcccaccactggtcccttgccacactagtacagctgatgctttctggaaaatgccacctcttggcagaaggccaaccatcacaaaaatagagtattaaatccccaaagctaaggtccttcacagagtccactgcaccctccgccacctccactgaaacaggcgctggtatccacggctgagaaacccatacatggttcacatcacaggactctgtgcagacaacccccagtgccagcccggagctgggtagactcactgagtggctagacccagaagagaggaaacaatcactgcagttcagctcacaggaagccacatccacaggaaaagagggagagtactacatcaagggaacaccctgtgggacaaaaaagtctgaacaataaccatcagccctagactttccctctgacacaggctacccaaatgagaaggaaccagaaaaacaaccctggtaatatgaaaaaacaaggctgatcaacccccctccaaaattcccactagttcagcagcaatggatccaaaccaagaagaaatccctgatttacctgaaaaagaattcaggaagttagttattaagctaatcaaggagagaccagagaaaggcgaaggccaatgtaaggaaatccaaaaaatgatacaagaagtgaagggagaaatattcaaggaaatagatagcttaaagaaaaaacaataaaaaaaattcaggaaactttggacacacttttagaaatgcaaaatgctctggaacatctcagcaatagaattgaacaagtagaagaaagaaattcagagctcgaagacaaggtatttaaattaacccaatccatcaaagacaaagaaatagaataagtaaatatgaacaaagcctccaagaccgcctggtattatgttaaatgaccaaacctaagaataatcagtgttcctgaggaagaagacaattttaaatgcttgggaaacatatttgagggaataattgaggaaaacttccctggcctttctagagacctagacatgcaaatacaagaagcacaaatttgggaaattcattgcaaaaagatcttcacctaaccacattgtcatcaggttacccaaagttaagatgaaggaaagaatcttaagagctatgagacagaagcaccaggtaacctaatctataaaggaaagcctatcagattaacagcagatttttcagcagaaaccctataagctaaaagggattgaggccctatcttcagcctccccaaacaattatcagccaagaattttgtatccagtgaaactaagcatcatacgtcaaggaaagatacagtcgttttcagacaaacaaatgctgagagaatttgtccttaccaagccatcactacaagaactgctaaaaggagctctaaatcttgaaacaaatcctggaaacacatcaaaacagaacctctttaaagcataaatcacaaaggccctataaaacaaaaatacaagttaaaaagcaaaaacaaaaaaacaaaaataaacaaagtaggcaggcaacaaagagcacgatgaatgcaacagtacctcacatttcaatactaacattgaatggaaatggcctaaatgctccacttaaaagatacagaaccacagaatgcataaaaactcaccaaccaactacctgctgccttcaggagactcatctaacacgaggactcacataaacttaaagtaaaggcgtggaaaaatgcatttcatgcaaatggacaccaaaagcaagcaggggttgctattcttatatcagacaaaacaaactttaaagcaacagcagttaaaggagacaaagagggacattatataatggtaaaaggccttgtccaataggaaaatatcacaatcctaaacatatatgaacctaacactggagctcccaaatttattaaacaattacaaacagacctaagaaatgagataaacagcaacacaataatagtgggggacttcaatactccactgacagcagtagacaggtcatcaagacagaaaatcaacaaagaaacaatggatttaaactgtatcttggaacaaatggacttaacagatctatacataacatttcatccaacgaccacagaatacacattctattcaacagcaatggaactttttccaagatagaccatatgataggtcataaaatgagcctcaataaatttaagaaaattgaaattatatcaagcactctctcagatcacagtggaataaaactggaaatcaaccccaaaaggtacctttgaaaccacgtaaatacatggcaattaaataacctactcctcaatgaacattgggtcaaaaatgaaaacaagatggaaatttaaaaattcttcgaactaaataacaataatgacacaacctatcaaaagctctgggatacagctaaggcggtgctaagaggaaagttcacagccctaaatgcctacatcaaaaagcccgaaagagcacaaacagacgatctaaggttacacgtcaaggaactagagaaacaaggacaaaccaaacccaaacccagaagaagaaaggaaataaccaagatcataccagaactaaatgaaattgaaataaacaacaacaacaaaaaatatctctactttgatgattttttttttttttttctgagatggagtcttgctctgtcacccaggctggggtgcagtggtgcgatctcggctcactgcaagctccgcctcccgggttcacgccattctcctgactcagcctcctgagtagctgggactacaggcgcccgccaccacgcctggcctcctttgatgattttaggtcgtatccctgggctatggattcctgttaatctgcccgaggcttgggctgccacacctgctttgcattttgtgaaacttcttctaacttagcttactcatcacgtccatagagccttaggcatgataatttttgctactgtttccttggtcacactaatgtcttctgttgtgatgtcctatgtagctttgcatattgctattcaaacagctcagtatgtggagaactggacacacacagccaaccaagcgtggctacttcagaatggaattaacactgagctacaaactgaagtggcagtgttgaaatccatggttctatggttaagggaacaagcacaaagcttgcagttgcagcagcaattgcattgtccttttaatcacactcatatttgtgtaaccaacttagaatacaaccgaagtgagtatccgtgggaccttgtgaaagcccatttgcagggagctttcacatccaacgtcacctttgatattggtgaattacaaaacaacattattaatttaaatgggcaaacataagactttcagccttctttagaagactggaccgaattccagcaaggcctggagagcctcaacccttggacctatctaaggcaccacattaacatcttatatgtaggtcctggaataatgttttgtctctgtcttctgttcatagtctgtaaaatcagatggaccatcaatcggaaaatgagagctgcccagtctggccttacattctttcaattaatacataaacacaaaggtgagatgttgggagccaaaaaggccaaagtgattgtgaccaactcaccattccactggaggctatatgatcaaacagcaaactgtttatcatgaatgcaggatgtgagcaaactcacattgtgcccgctgccaaaaggtttgctgagggcctcactccctggtgccgggctccttgaagttatctactgggaaatctagcacctattgttcaaagaatgcagtcttgcaagcctgctgtgaatctaaccgccagctgaaaaccagcccccgacttctcgctatctcttttgtctaataaatatggagggctgtgtaaagctcagggctcttgtccactagaggcaaggtgccccctgactccttcttctaaacatattctttcgtctttgtcttttattcctgcattcgcccccatttgttcagttcccccaaggtctgggcaggttacaaatcgccactaaagaacttactcatgtaaccaaataccacctgtaccccaataacttatggtaaaataaaataaaataataaaaattgaaaaaaaaactagaagttttatatgacaaaagataaaatgaaggactgcattagaagtcaggtgagagacttggataaaacatttgcgactttttaaatagaccaaagattaatatccaggctattgctcctaactgtcccccatctgcaaaaaaataccgacaagcccatagaaaaaggacagagaatctgaattagtaattcctaaaaagggaaatggaatgggctgataatctttgaagacgtgtttaacctcaagcattcagcaggtagaagcacatttagggaatgagatagcctcaatatattggtaaaaatgtaaaaggctgataatagctggccttggtgaggttagaaataagcactttcaatgtgagggatggtaatataaattgacacaacctttttggaggtcagcttcttagttgaatctcatgagaatgctactttaatatttctggtaatagtaaaatattggaaataatgtaagtagccatcaataggtagatagttaaatagactatgatatgtccatattataaaatatagctatacagctatttttctttttttcttacatttcctctgaccagctttaaaatatatatgtaaattccctttataatttattttattacaatttatttttttttttagagacaaggtctcgctctgttgcccagactgaagtacagtgacctaatcatagctcactgtcacctcaaactcctggtctcaaactgccttcccacctcagcctctaaaatagctgggattacaggtgctcaccaccatgtctggataatatttttatttttttgtagagttgggggagtctcacaatgttgcccaggctggtttcaaactcctggcttcaaacaattctctcacctcagcctcccaaagcactgagattatattaaataggtgtgagccaccacacctagcctatgcagctttaaaaagaatggagagtctatttatagattttaaaatatccccaagaaatgatactaattaataaaatgaagttgccaagcaatacttgtagtatgatcttattttttcttaagaaatccaaaacatattttttttttgagagactctgtcgcccaggctggagtacagtggcacaatctcggctcactgcaagctccgcctcccaggttcatgccattctcctgcctcagtctcctgagtagctgggactacaggcgcccaccaccatgcctggctaattttttgtatttttagtagagacggggtttcactgtgttagccaggatggcctcgatctcctgacctcgtgatctgcccgcctcggcctcccaaagtgctgggattacaggcgtgagccaccgtgcccggcctaagaaatccaaaacatatttctacatgtaaatgccaaggtatgtacacacatataacaggcacagaagattacacaccagccgccaatgttcactagctctgaggaggagtgtaacaagcccctcagggaccagcggtgtaactccagatgaagaaacaggtagaattttagaacaaccacatgggagagaaaagtaggattttcatgaaatcctcccatttttgcacagcacagaactaactggctttctgagactagggcttcctaatgacaaagagagagaaacatactgaaatcaagaaagagatcaaagatgattaagagaacacagtaattctggagattgaagaagccagcatacatattatagagatgctctagattctcggtgacctgggaattaaggtgtcacaaaacacctgctcaaggaagacttaccagaggttcccaaagtatggtcctggacaggtggtgtcatcgccaggaaagttagaaatgttataatgcaaattcacagaccctgacccagacttattgaatcagaaacttgggtgtggggcccagcaaggttttaacgagccttgcagggatttgatgttcacttaggtttgacaaacacaacttcagacgggtgcttctaaagttaaacacatgcgaatcacctgggagagtgtgaaacagcgcgttccgattcagcaggaaagccggggagcctgaggttccgcattctcacaaactcccaggtgatcctgctgctgctgcttctcagccgcacgctgagtcacttttgaaagaagatggagtgagcatttaatgactggaaggcttcacaaggaaatagtccaggaaaacacaaatagcagcatcagtttatctccactggcatttcgaagaataggagcaaaaaaaatgccgctctctttcagtggcgtgttgcctggtgttctgtggatgctttcaccaacagcaatatctgtgcatgtctataactgaaagctgcaagcattacttgctacccctaatttttgttaaccacttctctttgcagatgcagaagctgaggctagcacacagacctatttttgttccaatgtcacagaggccttggacagactgagttggcaagtctcctgactgcgtggctggagcgcttctgcagggcccttgaggctgttttcgtcaagccacagtgggaagtagtgacagagcacatgagattgacattgctgtggctcagtcatcaaaactggaccagctcagtctccaggctcactggtgaataataggaatctttgtcgtcctttccatcagaaagcatattacttaaaaccccttgctaactcacagggtgagctgtcctgtcacacatcatcatatggaatggaaactagcaactgaatatagcaacactcagactgataacttgctccacggataacttgtttgtttaccgactctggggatggagaaagacacattactcaaataacaaatgccatttcccctgcacaccctggaaagagtgctgcacctgcagcctgtggtttaactgtagcaatgcaggtgagcaactcaagtgcatttctgtgatggcaaacagcaaggtgggcatagtgagtagtgagtttcctggcttatggggagcaatcagaattatggcctgaatgcaacactcagcaaactcagactgagatgtttacaggccagcccagcccaggaggaggaaggggcttttattcctaaatcaagaagtgtccagaaaaagggaaataaggcttaggtgtgttatgctgaattttgggcacctgtccccaccaataacttggcatcctgaaaatgctacagcaggactccaagggccaagaatgcctgttctctacacagctgagggatggccagtggcctcattgcagagctgccactcaaaaactgaaagatgccaaaagggaagagcttgctccatggataacttgtttgtttaccgactctggggatggagagagacacattactcaaataacaaatgccatttcccctgcacaccctggaaagagtgctgcacctgcagcctgtggtttaactgtagcaatgcaggtgagcaactcaagtgcatttctgtgatggcaaacagcaaggtgggcatagtgagtagtgagtttcctggcttatggggagcaatcagaattatggcctgaatgcattggcacaactctgcctgcagtccaggaagcttttctgttgtaaaggtctcctttctagaccacctttgaagtcataaattagctgaagtggagttggtgtgcacttgctggatctggtggtgtgtgcttggatgcctaaacaagaggagttgccactactcattttagccaaagactcagccagaatcctatgctttagtgggactgggaatgtgatggtgagagggaggtaagaggatgagtcttgcacaagctagactcattagtcacatctttcccaacctttgatgtgcctggtaaatgatgtccgcccaagtgctgtgagggcttgtcttcaacaggagcccagatctgctgctgcaggaggggagatgaggagccttgcagccctaagggaaggtgctgaataccactctctctctctctctctctctctctctctctctctctctctctgtgtgtgtgtgtgtgtgtgtgtgtgtgtgtgtgtgtgaaagcacccactgttcagattcagataaacacgtttcagctctagcacacccacgagtacctgttctcctcccttgcacaacagcagcttacagaacagagaacaaaacttgaactgtcataaactgtgctctgaggggaggaaaaggctggctgacagtgggagctactcctgctcagaaatgaaggggagggactctgttttcttctgaatataaaaccctagtgaatttccaataatgctgggtgatgacaggaaggcatcaaagccctaaaggctggtaaccgagctgccaagccaggctctccacatgccgacattaagagcagtggcaaggcattagcatctatcctgcccctgccaggccctgtctttatctccactttcctcccttccctttttctgctgcttcctcttctctcttgtttcctctcccctttctagacctaaaagcaaagagtgtcaccctccagatgtcccttggctacaccgtggccctgggttaaggaggtaactggttctccacagctcacaagaaatgggccagggccaacacgcatgtggccttgagcctaatgccagcctgaccactgtgcgggttgttgtctattttcagtgcctggattctcctctaaagatgaggataatggtccctccctcccacaccttcacaaggatgattccaaggacaagcaagattgttcttcagagcacgcctcagaggaagggcatggtgtgagtgctgggcattgttaggattgttcgtttaccttccagggtccctcgctggaagtgacaggggtgtgcacttacaaaatcattcttgacccaaagtacctcttttaaagatgcttgcctttaaaagaagacaagtagtttttgctcccatgatatctcaagtggcacttagattgccgggggcctgttgtccagtaagtaatgtcacctagcgggattatgactggtttggagtctgggtctgagaactggggtaaaccacttcttcatgtcttagtcccctcatgcataaaacagagggatcgcacagggtgatcactaaaggaccttccaatgttaagatttaaagggtaaacggctctttgataaagacagatcatagaaaagtaagaaccacacagcttaaccttccaggggacaattaagatgctttaatgtgaagtgaatgacgatgtggtagagtatgatgtgaatgtaatagcataggaaggccggagggcatgggggcctctcaacctcatactctgtactagatgcggcatctggagcatctcaagaggggctaagagattcagtcctcaccccagctctgaagatgtctcaactgtgaaaaagagacagggagtccctgactctctgtctgctccttcactggttactcccatgttggaaggcaggggaggaggaaggccccagcatcttccatcactgctgcagacaccaaccaaccctccttcctcccactcctctgcttcaactctcacctgagtccccaccccaaacagccctctgctagccattaggtgttagctgcacttcacctgcaaaaggccttcctttgccagtttttgtcaaaaatgttagcatagtgtttgcataaatttgcaggtttgattcaagaagccctgattccaatagtgtaggagaaaatacactgactgcacctggagtcaaggaggctttcaggagggcacacttgattcaccacacagggctcgaagaggcactcagtatgtgaggctgggatgcccagacagaagcttcccccacgatccaggaaatcaaaacgttttcaatgttggcttgaaatcatggctaataggaataaaaaagctcttctcaccctggggaagactggggaggtagggaggggaagagttcccaactattccatccaagagggggcaaggaaggacagtggcaagcccaagtctggagctatttcctcccaatagtgaatgtctggtaactttacccagaagttctgatttttctcgttagtcaaacaggactctgacttccaagattaggctaaatccagagcagtttggggaatgaaggaatctggctgaacaatggaagttggaatcattgccctaccatcagcaactccttaacagaaacaaactcctctgcccactcgtcatatccacaaactattttcatagaagagaatgtcccagctagaaatgcaagtggacgagtgccaacccaatgaggctaatgatttgcaagtggagacctctgagcaacttggtaaagaaagcagggcttggccttcgcccgggaggcttgggacccctgaccaccccctaccccatcaccaataaacctctcagaaggaggaattctgtgacagccctcagaagagagtggctatccactggccacagcgatgactaaagcgaggttcatgccacagaagaacacaaaggtcaccaaagctgtctaaagcagacactgaatttattattcgccgaagaaggggagacactcatttcgttaagaaaggtcagaacagctctccaaactgaaggtgaataggacagatacactgtggaaaagaggacattttgttcaaaggtctgattggctcaaaaagcaagttgtaaactctcttctgggactgactgcttttctgactttgtgtcacagaggcatgagaacagctcgtgggagattctggatggatctgacctgtggtgcacggccctggcagcctggtgtctgtgcctcctctcgaggtgagatttttctctggcacccacttgggttaaggtgaggaaccctggagcccatgggcctgctgcatggctctgcacccatcacccggctctctgatcctcactgcctaggatggagagatatgcagccctcctggctgcaggtatgaggaaaccacatgaaagctgttccagaaatttgttggcatgtggccatcatatcttctaaccaggaaaactgagtcacagagctccaagccccagtaagttggaggatacattactaaaatgctcctgaataggcaaaaaataaaaaaaaattaaaaaaataaagaaaagaaaaagaaaaaaaaaggcaaactggaaagagctaaccccaaattaatcatgtctaaatcccagtggtaggtttgcaggagatttctaacttctcttctgtattgattttctgtattaatcttttctgtgttggtgttctgtattctccaaattctttactatgtgtggttttgaaatcatatttttttaaaatttgatttttaaaggatgagctccaggtcaaggttgctattaagtcaaaggtatgcatagttctggcacagtgactcaagcctgcaatctcagaactttgggaagctgaggcaggcagatcgctggaggccaggagtttgagaccagcctgggcaacatagagagactccatttctactaaaaacttaaaaagttagctgggcatggtggcatgcatgtgcagccctagctactcaggagactgaggcaggaggattgctggagcctgggagtttgaggttacagtgaactatgatccctctactgtattccagcctgggtgacagagggagatcttgtctctattgaaaaatgataataaaaaaaaagatctgtgctcagcaaagtcaggatattatcccagaatcggagttgagaattcagagctggtggctacgtctggcagccctatgctggctagagcccagggctccatctccagcatcccagtccaattaccctcttcctccttagcaatgagtaatacaccacctcttgaagccgcaggctggtgtctcctccttgacaatttcttgtgcttgctgttctccgccttgttacccagtggccctgtgccacatcaaggacttaggctttctatttcctcctaggaccctccctgagtcccctcagcctcttcacttgcttctccatggcccatcccatcagttacttcagcaatccctcatccccttgacctcaccgtctgcccctggggacaatcacaggaggactccccttgactcagtccagctgccaccttctctgtcctgtgtggggcggctgagcgctgctgagaccacatggcctcatggatctagacgggtatgagctcctggcctctgcttcgtccttggtgctgcccgtaagtcctgtggtctctggccagctttatgtcctactcccccaatggctatgacagaccctcgccggtctcctgaagctttctttcctactgactcgcccctcgccagccccagctcccagcgaccttgccctctgcttcaaggaagatgaaaagtttcttatgtgggaggaatgtttgcactttctagactccctctgcagagaccctcttcctggcaacctctccttctacagccatgggcggtgctgaccaggagaggagccactgggagtcctgcagaaggcctcctggcagccacggcctccccactgtccccagcagcagcagtgcatcttcaggcagctctgactgctggaccctgcagactcagacccccacccctctgcagcaggaagtttactgcttctgggaacccacaggatgtgagagaaaacaactccatggggctgggagccttgggtttgaaagttggacctggcacccactggcttcactttcttgagagtagagtggaaggcaatcccgcccaacctcccacacaccatgacaagtgcccgtgggtaataaatggaaaagtgctttgtaaaatgctccccctatgtgaaggatttatgctataaatccttagaatgactcatctgagctcttaacctactttcttagcccttaaatgtttgcttttcaacagggattcctgagccctggcttgttcttgaatttgcaggagccacagacccttcaccccatgccaactgaccagaggcctgatgctcctgccctcttctctccctgccactccaaccagaagacctctggccagttgccatccagggacctggcatgacctccccagcctttgaggcagtgatctggatgcccagagagtcaaatacagagaaccagggactggcaccccagctgtgggttctcagagtgggctcatgtgaaggagtgagaaacaaggagcacaggaacctctctctggcagcccacccctctgtgcccacggaacccgctactgagggctcagcatgaggactgtgtgcagcctctcctgagaccctcactcaccaggtacttgcagatttcctccaggacctacatgcatgtggtcgctgagcgtggcacgcagcaatggctggatgagtgaggaccagccaatcatgtcagcccacaccgccagagcctttccccaggcctatgggatggagagaagggaggcctcaacctcactcctgtgactctccagccaaggggctgagtggaagcccttccgtcataaagagagggcagatatgttcagagccacccagaggacaatgtcaaagaggtgaatgtagagcctacaggcaaggctgggctcatggaaatggccacagggaaggggccctgctctcaaggaaaggggacacatatcaggcctggcagtggccagacaagtgacagccagtgtacctggagcacttccatgttattttcctgaatgctgagcaccaatgatatcagaagtgtgaaaaaattttggggggtgatgcctccaggcttacatgtttttagttgctgcagcatgtggcccacagcagaggtggctgagatcctcaccttctcctgctcctgccaggaagcgcaaagtggagatgagaggcagtggcttccctggccctgcctggcctggcttccgtccttccacatcttggtctctgtgtgcaaggggccccagctgtactgtgcttagctgatgcatagacaacatgatgtgtgtatgtgaggggttctctctagagaccaagagctaagaagcccgttgatgaaggcacagtgctaggaaataaggtcatcgtttcagttctaccgtggactatatccgcagcttgtgacattgtttccaaagtgttcaagcaattctcctggctcagcctcctgagtagctgggattataggcacctgccaccacacctggctaatttttgtatttttagtggagacagggtttcaccatgttggtcaggcttgtctcaaacccctgacctcaagtgatctgcctcccaaagtgttctgattacaggtatgagccacagcgcccagccctgcacacctttagaccaagtattcatgtcatctacctgcctgtccatccacacacttgggtacttaccttcctgacactggcttaatctgctattttattttcttggctacctactacctatgagtaggtttccttgccttcccttggcacgcatgtcttctgacctagacctctgaggtaccagggaatttccaaagttgcttccacaacttcttcccaccttcctgatggtttactcacagcttcagaagaagctctgtgctccagaaactggtccccaccctcaccctgacatataagccagagacttcacagactaagaacaggtcccttcctcttctcctcttgtcctcttgcaccctctagagagctctttccctccatcactgggaaggtgtatgttggacggggtgggaggttgaggtaagtgagtccctgccctcctgataggagagaatcacttaatgaccaaagctcattcgcagatgcctggggacttttcttggggatgagccttggaaccttctctttccaaaagccacaaggagaactggaggagatttgtaccttggtcctaatgactgtgaggtagaacaacccacaaagggtcatcaggaagctgtgggttaaatcacatctctacaaactgcctccaaggagcttccaggtggcagtggagaaacatatcacctgccagggtacagatgcctgagatggaagcattagtttgatcagagaacaagggcagcagtgggtgggagtgctctatggattcttcattctcctaattcttctcactggacagcaccacttatgggcctggtgtggtggctcacgcctgtaatcatagcactttgggaggctgaggtgggaggatcacttgagccagggaggtctatgctgcagtgagccatgattgcgccactgcactgcagcctgggggacagagtgagaccctgtctcaaaaataaaaaggagattatgcagagggtctgaaacgaaaaagtttagctctagaggtagacaatagagcatggcaattggaagactgaatgtgctgagccaccctgtacacaagtccctataaaaatcagaagatgtcatggcaggtgtgcccaaggacgtgtagttttctcctcacgaaaagaatgtcttaagcactgtaaagaggtcagtgcaggggtgaacaacaccaatttaagcattgacatgtgttggggtttgtgacggctgtgagagatgcaaccatgactggaattcctcactattcccagaaagctagtgtgtagaaggagaggatacagctgagatttggaatgacatgtggtagggagaagggggatgtatgcacgggtacaggaggtcagtggggaggggcttgggttagaggtgaggcaagggacaagggaggcttcttgagaaagggatgtctgcactgcattttgaagaatgagtgggaatttggagactgagtgtgagaggcactgcaggcagtgaagaacctgcataacatcctctgccatatgcagggcagggacaccaagccactcttctgcagtattgccaggcagctgcatccactgattaatgatgtatgtgcccaggtccctaggatcagttggacacaatatgggcttagcttaggatactgggttagggcaaggcaccgtggtgcgaggcctaggtcaccaagggacagaagaaaggagacttggctacttgaagctgagcataggacatgtcccaaatgcattacttactccatgcaatggagcacacactcctccactgactcaccagaattttctggaggagccactggtacccaaataagaaaccaactgactgatatgaagatggttctgactcgaaggatcttattctgcagactccactcatggagtgaagcggggagagaacaagtggctctacccccctcccaaatcatacagaagccttaggatcccagggtcctcatggcaagagaaacgtaagactcagaaagttgaactgaccagacctgtcccactccttctcacatctcatcttccttgcaggtgacacaagtttagagctgggaaggacctgacatccctgagacacaggtttatgggactccagctctggcatctataactctctcaacttgtgagccttggatttcaactatttttgtattggtctcatctcctctatgactttggacacctgctggtggcaaggccaatgtcagactcacctatctttctgttatgtttaaaatttaccatgtgtactatacttgacttaactaagtctgaagataatatctttttccttcctccaaatgatacaatccatggatctttgaatgcttgaattctgatcacagcctcccacatgatatactaatgttgcccagtattaaaatactgggctaaagctccacctttgtatttaacctgtaaatttgctctttatgtcatcatcttcatgactgtcatgattttgtacagttaatactggtttagatctacccatatgcttacaaatttcttggcttatatttctttcttccagctctttcctcccttttagatttattttgtttttccttcctttgtggttccttcagtgagggtctcttagtagtaaacatttttagtctttgaaaatgtctttatttggccttatatttgtctctgctttcagcagtctgtgatgtttctaggcatacatttccttggttttagtctgtttgaggttcactgagcaactttaatctctaaattgatacctttcaccaaacttggaaagtttttactattatttctagaattgttgttcagccccaccatgctctttctcttcttttaggactctcacgacacaaatgttacaccttttgttatggtctcaggtcacaagatacttttggttttgaatcatttttctctctgttcagagtggataatttttattgatctgttttcaagttcactgattctttcctttggcatctccattttactatggagcctacccaagcttatatttttcagttctaaagctttccacggtttttctgtatgtcttctatttctttgctgagactatttctgttatttcaagagtgttcaccgtggctttttggaacactttgcacagtaaccgctttaaagtttttattacataattccaatctctttccccttgacttcagggcatgttcattttcttcccatgtgagttgaaatgttcctggtcctttgcatgctgagtgattatggattgaatcatagacattatgaatatgatattatgtgactgtgggtcttccaagagtgtcctggtaattttagcaggcaattgacctatttaccttcaggctgccaatcctgtcagccgtccgcgggttgtgattccaatgccagttcttggttcgaagcctctgctattgtgcatttgggccaccagccagcctgggacctggatagtagtccatcctgtagttcagttctcattgtctatgacgtgctggtcagggtcagacctgggtatgtaatgagctcgggagttcataaacacctttataggatcactttcctcctctctgccacctccctggtactttacagttccctggggctccccttcttcagtggccagaaagctggggcttttgttgctccacagtgccaggcacttctgtgactgtccccacatctggtgctaagtggcaagcggcagagaagaaataaagcaatgggaattttcctcatcctcttgggcccacagtgactgcaaatggagaggagggcttccctccctcagttttgttttctgcaggttcccatggggcctgcttggaggctgaggcttgagagaccgagagaaaaagaaacgagggatttcttcacttcctttgagcattgtgaagtgtttctggctccttgggtgttacctagagggattctctcagagctctctctgtatcccggtgcatacacctccgtttctggttgtgtggcttgcaggctgtggatcccaggagatattacaacccatgccctggggggttattgggaccagtgatgccctccaacccctagtaggtggagtgtcagcaaactttttgtttttggtccctagagatttctcttactctcctgcaagctcagctatgcatatatataatattttatctagtatatcaaggtgtttagagtaagaaggttgttatcttccatattgctgaatttggaagtcaggagctatagtccaagtgagaagtactaagtggccatcacctacacagaggccacctggggaaatggtaagagctgcaccacagggcccctcagatgtgggtgctgggtgctgctttgccattcacccagtcatgtggagggaggcagggcactgaggcaaagcttactggtctcatcatctgtgaaactttcttctactattttggttcacatgccctcttttctcttctgtctgttccatttttggaatttacttggatttattctctatgtttcttaatttctcttccatatttcccatttctttgtctactttggaagaatttctgggctgattcacttttaacgaattcaccctttagttgtggttattctgctattcaacccacctattgaattttcatttaactttttgtttttctaatgcagaaggtactctatatttttctcttctggatgatgttgtggtatcttgatagttatttcattattctgtggcgatattgcctgaccagtgcctgtattgatttatttattgatttatatataacttcaaattttgaatttctaagcactttaggaactgaactcaatatcttttaagaaaaagtttctggggattcaatagtactttctctaaagttttgttcagattttattgttaactccatccttggatggtgggttttcttttggttttgcttgcttgaaacagggtctggatctgtcacccaggctggactgcagtggcaggatcatgactcacggcggccttaacctcccaggctcgtgatcctcccacctcagcctcccagctggtactacaggcacatgtcaccatgcctggctaattttgcatttttttgtagagatggggatcaccatgttgcacagtctggtcttgaactcctgggctcaagcaatactgtgcctctgcctccaaaagtgctgggataataggtgtgagccactgtgcccggctggatgctgggtgttgtgtttcttgaacgtttcctttcatctgtagtgctggttttcctaaatgtatatcgatccttggtagtgacttctggcatttttatactagaatttcttggctggccctgtgtgaaagcaacacccgtgactgcagatgaatctttaggattcacagtcaaatgggtgaacatccaccagatccacgatgaggatatgcagctgatatgggatggtgagtctgggccttgcacctgggttctgggtgacactagggggcggggtgagagagaatgggggatgaagacatttcttaagaacatggttcatcattttatttttaccattatcaatgtcatatagaaaagtggaaaatggagaaaagtatttggaacgaataaattatacattgtcccactagtgagataaaaagactgctaatattttggggatctccccttccagtccatgaacatttataatgtgctataggtgcttacagtgaaatggtgttcaagacagacacatccctgctcttcataaacttgcagttttttgttttttattgcactgaactcttctaacattaatttatatttacagaagaaaatgcacaaatacagtgtctttacaaaagagtagaaatgtgaccaacaagggtaaagttgcactcaccccactccacctcgctcctctgccctcctcccctgcctgtttgctgtagagtcctgtgttctttgtctttatatacattctataaatacacatatacaaatataatttttatttattagtagtatttcaatagttttgggggaacaggctgtttgcttagatggatacattctttagtggtgatttctgagattttggtgcactcatcacccaagcagtgtacactgcattgaatgtatagtcttttatccctcaccaccctcccaccccttcccaagtctccagagttcagtgtatctttcttatgcctttgcatcctcatagcttagctcccacttataagtgagaacatatggtgtttggttttccattcctgagttacttcacttagaataatggtctccaactgcatccaggttgctgcaaatgccattattttgttacttttttatggctgagtagtattttatgttgtgtgtgtgtatatatatatatacaccacaattcctttactcactcgttggttgatggacatttaggctggttccatatttttgcaattgtgaattgtgctgctataaacacatgtgtgcaagtgtctttttcatataatgacttcttttgggaaggcagatacccagtagtgggattgctgggtcaaacggtaattctacttttagttctttaaggaacctccgtaaggttttccatcatggttgtactagtttacatttccaccggcagtgtaaaagtgtttcctttccaccacatccacaccaacatctattgttttttgatttttaaattttggacattcttgcagaaggaaggtggtatctgtggttttgatttgcatttccctgatagtgatattgagcattttctcacatgtttgatggccatttgtacatcttcttttgagaattgtctattcatgtccttagccctctttttgatggaattgtttttttcttgctggtttgagttcctggtagattctacatattagtcctttgttggatgcatagtttgcaaatattttcttccactctgtgggttgtttactctgctgattatttctttttctgtgcagaaggttttttagtttaattaagtctcatctatttatatttgtttttgttgtatttgcttttaagtttttggtgatgaaccctttgcctaggccaatgtctggaagaattcttctgttagcttccagaatttttatggtttcaggtcttagatataagtctttgatccatcttgagttgatttttgtgtaaggtgagagatgaggatccagtttcattcttctacatgcggcttgccaattatctcagcaccatttattggttagggtgtcctttccccactttatgttgttgtttactttgttgaagatcagttggctgtatttggctttatttctgggttttattctgttccattggtctatgcacctgtttttatactagtatcatgcttttttggtaactatagccttatagtatagtttgatgttgggtaatgtgatatttccagatttgttgtttttgtttagtcttgctttgactatgcaggctctttttttgttccatatgaactttaggattgttttctctagttctgtgaagaatgatgctggtatttggatggagaaaataatttggatggagcattgaatttatagattgcttttggaagtatggtcattttcacaatatttattctacctatgcatgagcatgggatgcgtttccatttgtttgtgtcatctatgatttttttcaggggtgttttgtagtttgcattgcagagatctttcacctctttgattaggtatattcctaagttttttttttaagctgttgtaaaaggggttgagttcttgatttgattctcagcttagtcactgttggtgtatagcagtgctactgatttgtgtacattgatcttgtattctgaaacttcactgaattcatttatcagataaaggagctttttggatgagtctttagggttttctaggtatacgatcatatcatcaacaaacagcaacagtttgacttcctctttaccaattgggatgccctttatttcattctcttgtctcattgctctggctaggacttccagtactaagctgaatagaagtggtaaaagtgggcatccttatattgctccagttctcaaaggaaatgctttccacttttccctgttcagtataatgttggctatgggtctgtcatagatggcttctattaccttaagatttgtcccttccatgctaattttgctgagggtcttaataataaagaaatgctggatttgtatcaaatgctttttctgtgtctattgagatgatcacatgatttttgcttttacttctgtttatgtggtgtatcacatttattaactcatatatttttcaggggttggggacagagtcttgctctgtcacccagtctggagtataatggcatgatcttggctcattgcaacctccacctcccgggttcaaaggatattcatacctcagcctcacaagtagcagggatttcaggtgtgtgtcaccatgcccaactaatttatttgtattttttagtagagtcagggttttgccatgttggccaggctggtctcaaactcctggccttaagtgatccaaccaccatggcttcccaatgtgctagattacaggtgtaagccactgtgcccggcctgacttgtgtatgttaaaccaaccctgaatccctggtatggagcccacttgatcacggtgtattatctttttgatacgctgttgaatttggttagctagtattttgttgaggatttttgcattgatgttcataagggatatttataaatatgtgtatgaaaagtttcagacacttgtttgtttcccactgaaatgttggttccaacagatctactgcattcccagtagtgttccgtggtattgatattctagagtttagaaatcatttcccatgtagatgaacactgaagttgttcccaggatgttactattcaagcaatactagcatgaacttttttttattgttatattaaattctggggcgcatgtgcaggatgtgtaagtttgttaaataggtaaatgtgtgccatggtggtttgctgcacctatcaacccatcatctaggtattaagcccagcatgcattagttatttttcctgatgctgttcctcccactgtccccagaacgtttttaaatatgcctccttatacacaattgtgaagggttctccgggctaggtaccaaaaagtagacttttatcatgcattctaaacttaacagagtgtgaagtaaaaccacattataaccttctgtcctgtcttgacactcattccaatcactgtccttcccaattacaggcttttgatggccattattttagttctatctagcccagaaattagaggctgtattagttcgttctcacacggctatgaagagactgggtaatttattcaggaaagaggtttaattgactcacagttctgcatggctggggaggcaggaaacttacaatcatgatggaaggtgaagaggaagcaaggcgccttcttcgcaaggcagcaggtggaagaattgctagcaagagcagggaaatctcccttataaaaccttgagacctcgtgagaactcactatcatgaggacggcatggaggaaaccacccccatgatccaattacctccacctgatctctcccttgacacctggcattagggggattacaattcaagatgagattttgggtggggacacagccaaaccattatcagaggctatgactgccatcattttatacaaactgtttagatttacatacattcttacatttcttttgcatgtctgaccttcctttgaggcccatccacttctcttcattgcagagtcagcttttaaaagtttctttagtgctcttaagtgagctcccttagtttttgtttgaaatgttatttactgtcattcttgaaagaccactgtactgatgactcaattctagagtgacaattgttttcccttggcactttgaagatattatatagtatagttttctggctttctttgtcggtgtgaagaagcctggggtcattctaatttttgttcctttgtaggtgatcttttttctctaggtggtttaagattttccttttttttcgtttatttattcacttttattttaagttcattggtgcatgtgtaagcttgttatctaggtgaacatgtgtcatgggggttggttgtacagattatttcatcacccaggtactaagcctactactcaatagttattcttcctggtcctctttctccttccaccctccaccacttgataggccccagtgtgtgttgttcccctctatgtgtccatgtgttctcattatttagctcccacttataagtgagatcaagcagtatttggttttctgttcctgtgttagtttgctaaatataatcgacactagttccatccatgtccctgaaaaatacatgatcttgtttttttattttatggctgcaaagattttcagttgtgttttcagtgctctacagaagtatagagaatggtatcacaaactcccatgtgcccattccccagccacagcaactcacgccacccgtgtttttctgtctccttacttacactgtctccctgccaggattattgtgaatcagatcccagacttcttattgtttcatctataactattttggtgcatatttctaaaatcatattattttaaaattgaaacatttttaaaaattgtagtgggcaaattatagagtaaagtgcaagctaggcacaaatttctaagataaaagagatcccaagattgtgtagaatagagaggccctgagcaattcatccagacaccagagattgccagctcactctcatttacccatcctgacatccaaccctacccattacagaggctaagccatttgtccaaggtcacatagagaatgactgggagaatcagtagaattccaattcagggctcttcccacagcccgtgttccctacattgttcttgaatcttcccaaagtcctgagaaagaaaagaggtagggagtgggagttgtggctacggagaaagaggagttgatatttccaatgtatatcagaagcaaacttgaactcacctttcacagccttccttagcaccaacagccaaacacaaatacctgtgttttatacagaatgcacttctgccaactcccacccttgctgtttacacaaatttgtttcttaattattgaaaacctcctgtgtgccaggtgattctctaagccctggggatgctgcactgaattaagctgatgtccctggcttcatgcaacttacattctagtcaaggagaggaagcaagccctcaacaagggcatacatgtcagggaagcaccatggagaaaataaagcaaggggaggggctgagcagtgtatgagggtgaggtgacagaaatgtcctctccaataaggaggcacttcaccagagacccctgttaaactaaaggacgcaagaaggtcagaatttaccttaaatagagttgatttaggcacaaacgttgaggacaggcctgtgtgggaagcccagattccacagaatggaagtctgtattccaaagtgaagtttgggatcctttatacagaggaagcttgggaaagcctagcagaatttcaacatctttctgtgtaaggtttaatgcatcatttaaatgatctaattagtccaggtggtctttttctttgtggaaaggtagatttaacattcctcactgaagatttaacagtcttggcatctcgggtgtcatctggtcttagcaaggtacacgacaataaaggagtcagttaacctataacaaagatctgggttcggtagtgggcaaggcctggtctctggtctctcctactcattcacagaagaggaacaatggggaagagagttctcctttaatctgagaagcagaattggaaaccggtggtgcgactcagtcttgggtcttaatatccttctgggtgtaataaacttggagggtgctgaaacagtattttctttgacaccttgaaggaagggagaaagggagctctatggctctctaagggaagagtccttggcatgttcaaggatcaagaagccagtatgatgatcatggagggagcagaaggaagagcaggagatgagatgagagaagagtagtggggccagaatcctcttgggtcttctaggcacagtcaagattgagggttttactttgagtgggatgggagctcactgaagcacagtttttaacttctctaagaaggaagagaggggtgaacagtgcttgtgatagggtgtgaggatagtcagtccattctaggaccaagcagaaataggttataaattacttgttcctgttttccatgtaacaatttccttcctttgatgtggagacaaaacagaaagaatgtttgctttggtagatcatcttcagcatccctctgtgcttaaggaggcgtatgcacattggaatgtcctgacatgagtgtccagggtgctgttgttgccttttttgttgcaaactcttgtccttgaggtgtttgccttctgatttgaacctaatcagggtattgaatactgtggctgctaagagatcatattttgcataagctgcttttgagagaacggtgaatgattgactcctcagagaaaatgcctagcagacctctgcagatggagaattccttatttcccatatgtgtcattcccagttctttgtctagagagtcaagtattgaactaaacgatatttcagggtcctctctctcctcctagtcagtggtgaaatggaaaagcaggggctccagaaccagccagatcagtttccataccagctctatgagtcaggaccctgcagacttgggcacgtgacttcatctctaggcctttcttcatctgtgtcatgagagtaacagcgctgatcttgaacatcgttgtcattattgaataaaaatgcacataatgtgctgagctttgctgggcacatagatgtcccacaagacaatttcattgccttgattcgggtgtctaggtgcgggcgggggatgatatggagggtggcaggtagggagcgtccttatagctgtagtcagggaaaactgaaatagtcagttgcttctccgagagcagccgtgccacctctgaagcacgagtaactggcagggctgtctgtcccctttgggctgcaacctggcttcaattctgaccctgacattgtgtgcttctgaagccttctcctcttgttttgacacctgaagtccccctgtatatcctagacttctcagtctaccagagcattcaccttactttcttcatcccaccctgcctttgatgatgcctaagtccccgagacaggaggaagtcttccccagaaaggtactatagcagcacttatacccatgtttaatgtcccagaaaccttgtgttcaagtaatgctttctcaagggtcttatgtcttttctgttagagcttcagccccgttcttgtgttctgttctaagtgaatgaaacgaacattatgctgtagacattgatgggtttgaaggcctaaaatgaacaagttttgttgaacaaagattctttctcgtctttatccttttcatgctaaggaatttcctgtctccatttcttttgttcccaccctactctacaccctcatgattccctaacgggaccactttaacagcctcccaacaccctcttcctcttctctatacgattctgctcttagcagccagattctctttagaacatgcatgctggaacatgccactccttgctttaaacccctcagcagctccctactgctcttagggtctcagtctgctcccatattctcactcacccgactcagaatgtcctgacctctgaggcctctcacccttagcctacaccacttcctgcccctctgggaactgcagtcacactggtactttctatgacacaaagagaccccccacacacaccacgtggaagtcttctgcccttgccctgtgtgttcgtaggctggctttcaacttcgggtctgagctggagcatcaccttctcagagaaacatcccctgatgggcctaagggctcctcccccgtcatttggtctcagaactcccctcagcttcctcccttttacttaatttgcatttaactgctgatttgtctttcccccaccagaatgctaacttctcaagggtgggaatctgtttttcttgtcctcccctggatccccagcccctagcagtgcctggtaatagtaagtcctcaatatatagttgctgaatgaatttatgattactttttataacactgaaagattgcaaagaatctaattattcagaaatagggtattcaccaaaaaaattatgatagaattagtcagatgtggtggctcacacctatagtcccaatgactcaggaggctgaggtaggaggatcacctgagcccagaaggttgaggctgcagtgagatatgatcacgccattatactttagcctgggtgactggttgaggccctgtttttttttttttaaaaaagttatggtagaatcatgtgattgcctgttatgctgtatagaggaatatattatggaatgaaaaaaattactagtcctattttgtgaaaaaaaaatctatcaacattcggttgttttttgttgttgtttgtttgtttgtttttttggttgctgttttaaaaaaagactgcaaggacagctaccaaatattagcagtgttatctctggggtgagtgatttttcttcttttccttaaaaaaaattgtgtattaagtatttcctacagtgaaacaagtattgcttttatagtggaaacatgattctaagcagagctgtgcaatgctgacctggcatggggtgggaagaagggggttagggaggcggtgcttagggtccagagtctgagttggcctcattctggtttcagctctggaaggagtgaagaatgagtcactggagcccatccagtccctcatggatgacatactgagggctcaggaagatgcccccttgcaacctgcctcagcttccaggctgagtcacctaagcagcttctttcagaaagcctttcacaggcacactcaggaagaagtacatcttcaattgaacaagaaataatatgaataaaaaatgtaaagaataaaaaatgcactgccacactggtggggcaggagggtgaaagtcgtgcccctcacaataggtaatgtctataaaaggacaaccgaggccatcaccaagtccacctacagaaggcgggtctgtctcaaccccagctgtcagtcactgtgaacctttagaactggggctgaagcttcttccagttgcttgctcagatgtcagtgagaccgctccacaacagataaggggagctgtgtgtcaggaaagtcccagccaccaggacaagctgcactccaggcagacgtttctgttcttgtgcaaagaacagcgcaatccattcaagttcacaggggcaggtggcacttgaaaatctcagggtcaacttgcagggcagaagttagcagggaagtcttcctgggggagtgggagagcccagcagagtttaggaggagggaagggcgatatcggggcaatcctctgagtctctctttcctcttcaggaactgttcaggaagaccctgcagtctctctgctggctcatgggagctcccagaactgaagcaacatacagatccaggccactctaagctctgcctgcattttcacagggcacattcttgtgtatatgtgtgtgtgtgtgtgtttggtgcatgtgtgtctgtgtgtgtgttctcttcttaataaaaccagcaatcactggactaggtagggcccactctaatccactgagctccccttaccttggtaacatctgcaaagaccctattttcaaacaaggtcacattccgggttctgagtggacatgaactttttcaacccagtacatctgggaacaggcagtcaagggtagaagagatcaacctgaggatgaggtttggatgcagagttttgagagaagggtgatcagagctagggtctaagcaacattggtctgctcccttggaggagaattttccctttttccttctgccctttagccagtgctgcagccacctcctctctcatagctggcatttaaaagccaaatggatgccacaaccttctaaggcatctagatatgcaactaaaatattaaaaaaattccagcaaggtcaaaataatctcaggcctagatttgccaccagtgccctcttctgggcagctttattttacagtagtgtcacgaaacacttgtttgtcaatatatgtatttgtgcactaagtgtcaccagaaaatacatttatgtctgttggttacagcctaaaaagtttaagaaaccatgtttagatgttttcccagtcaggaaaggccaaactaaaaagggctgtgtgtgtgtgtgcgtgtgcgcgtgtgtgtgtgtgtgaaaaagagagatgggggcccccattccactaagaagatgacagaggctgtgcaggttttttctctgtgatctcccctcctcctacaaatcatgcccagaggagggatcttgaggacctgcccctgcctccccagacccatctccacacccaggccatcctgggcagaggacagcagagctcacatctctgtggagagcagactgggctcactgcaggcctctgtgtcattgttcatcttcacttcataagtctcattctgagacctctcctgacacaccatggctatctggctctcctgggaaaagcacttacaacattcaagatagagaaaatcatcagcagctgccaaccctcctcctcttccctcagcaagtaaggcatcacgcatgcacatatgcacacgtgcacaaacacatgaacttgtgtacacacacacaggcacacacacacatgaacatgcatgcaatttctgtggcctcattttcttgtgatggctgatgaagccatgacgccatggaagtgttaagattagggagagggttccatgtgggaggatgtctggtgtggatccaaggagatctgagtcctgactccaattcacttaccctctggcccaagtcacttagcccaccccatgcctcagtttctctttctatgaaataggagtgacatatgccctgcctgactcagaggcctgttgtgagttacaaataaagcaacagataagacggcgctttgagactgggaaaagtcagctttgacctaagggtcctgggctgtgccataaagggcagggtgggcctgtgaggaggcctacctgtgagggcctgccctcccacccctacctgcaatagctgagcctttgggcattagtttggcacagctgagatgtctgtggcatcctattttgatggtgcccttgattctgacacaagctccctgcagtaaaggcacagaaaggaaacctcacctaggagggtttgctctcccaagcagagggcagtgagccggagtccctactgagcctgaatccttcctgaactccagacctgcctgtaccagaacatgtctttccctatggggacacagtcctctgctcactgggtcctgtcttcttcagctctgagccatgagctcttccttttcctgtttgtgctcagctcagtgcctctctccatctttatcctcagaccccagaaggcattaagggaagatcccagtccatcttcttggagctgagagctggatcagtgcccctggctttgaggcagggtaggggcagttctctctcagggaggcctgcagatcgccacctgccccacggtgggaaggaaagatgacaggtgggagctccaggtggattgggaggggagggagatggagtgggctttggcaaggcatggggggataagcttgagatgcagagtggcagcaggcaggcaacaacatttctggagaccaccaggcacaggacatgctggcctgtcctcaggacaagcaatgccagggcctgagctgcccttacccttcaggacgaggcctgggaactggaatgtgggctatgcttttcttcaccaaactgaagcttggcaccctgagtgttgtttgtaccaactgcagtaggcagacggggaaccaacacttcatgagcactgactgtgtgctgtgcactgtattgcgtgctttctgtttgtttgtttcatggagagatgtatctctggggagagggaaatcccctgagaatcccccctctcctctaaagcccccgccaccccaggttctctaaaaatccctctccccttatgtcacagagaataaagcttcacaggaaaatgcccttagaaagggggatttaattcactctgagatgctaaagatggccacggagacctccttaagcagaggctttcaggagaccgacagagaagaaggcagtgcagggacccagcgtgtcctcaactttggctaaataaacctgtaatcgattgaaacatgtcgcagtcactttttggttaacaaggtcaacggaggcacaagcaccaaagtccacctgaagaagttgggtctatctacgaaccacttgtgagtcactgtgaatatttagaaccgggggctaaagcttattccagttgtctgtctggatgtcagtgaggccactccatagtagattctcccacctttggtttaatgggatggacaactttggattaggactaaggaggtagatttgatcttggaagataccttaggcttcttgtctcttatctccctaggaaactgttggctgtcagtatctatactaggggtaagcccaagtgacagaacagttctggaagcatctccttgagttttcaggaaaggtttcactgacacaagaagagagtagggtggcagagcagcatcgggtttggttttcaattcccttttctatctccacacgtgttgggtgaaattcacagggttgccacactctcgtgggtatatttggattacggatgagagcataggaaggtgggctgtgggatacatacagtggagtgctgctgactatagcccccgtcatgtaagaaagcacgtcagattgccatagaacaagttatgctattgttggaataactgaagttcattctaatttagtttttaaaatcattctgaaactttgtcccccctaccgcatagtagttgaagggtactccgttttccctttttctgtcctaaccaagaaacagagcgtgcctcaactgttctgtgaccccatcagctgcacaatttgcccggcaggctggaacccaaggttacgctttgaacactcccaggcacctacaaaggtgtttaggttgttgccccaaacactgagaggaactggccaggccctgagccaaatgccttaatctctcaccaactccattccctgatcctcatgctgcagacctcactaggtagagcacctctttccctaactgcctatctggaggaaatggtgaaacccagtttctacctaagttctcataataaatgctttgatctgatcaccctggcgtctagtgcttctttctttgggattccaactggtcccatcttgggatggcttggggtactcccttgtgggaactcccctgatgccagcagtggcaccccagatgccactgctgaggtgactccagctgtgaattcactggaaaagaacacaggtattcctgattagttctttatgctccctcaaaggtcagagctcaatttccttgcacctgatttctcatccacaaaatggtatttataacacctctgtggaactgtcctccaatacccttcttcctttttaaaaaaccatgcatttggccacctggaatggagaacatgttttccaccccccttgcagctaggtgtggccacgtaactaagttctgaccaagcagtggaaggtagagtcccatatggcactttcaagaagtattcttaaagagcaagggcacatgcatttctatcctgcctgtcttcttcgtgactagaatgaaacacgatgcctggggctaaacagtgatcttaaaccatcaggaggaagtgatatattaaaaggcggaagagccaaaagatagaaagaacctagatcacttatgctagcagagctattcatcattttgcacagtttaccttcagactttgttcataagggggcaagggagtgtgagttttctatcacaggcaaacccaatcctgagggattgacttaatctatcaacattgctgtgaggatttaaggagataatataaaatccttagcagtttttctggcatgaagtcagagggcaactttttcttttttctcaaaagtaatgaaatattaaggctattgaaacttggttctgagaacactgaaagatatggaaagaccatagaacctgtttccacattggccagaatggactgacattacatctttgaagtcggtcataatcagaatgtttttcactgcttctaaattgtatgcactattggataaaactggaacagtacatggccaggcacagtggctcatgcctgtaatcccagcactctgggaggccaaggcaggcggatcacgaggtcaggagatcgagaccatcctggctaacacagtgaaaccctgtttctactaaaaatacaaaaaaaaaatgagccgggcatgatggcgggtgcctgtagtcccagctactcgggaggctgaggtaaaagaatggcgtgaacccaggaggcagagcttgcagtgagcagagatcacgccactgcactccagcctgggcaacagagagagactctgaatcaaaaaaaaaaaaaaaaccaaaaaaacaaaaaactataacagtactgactccatgttagagaaaagcttgtttgcttgaatacagttattgcttttcctgagactgtagattattcattaaaaacagcctcagaaatacaggatcttcagcagacataaaagaaaaaacactgacaaacaactctgggaatgggctaagtggcttgataagaatagcctgatggtacctgcagaaggtcatacaacattgaccaagaaaacagtgattgcctgcctgcctgcctgagacttcacatgtttcataagaatgctctgatcagccaggtacagtggttcagactggtattcctagcacttcacgaagctgaggtaggaggattgctggaggccaggaggatgaaaccagcctgtgcagaaaagcgagaccctgcctatacacaaacaaaaataataataataataaataataataatagctaggtatggtggtgcatgcctgtcatcttatctactcaggaggatcacttgagtccaggaggtcaaggctgcactgagccaagataacatcactgcactccagcctgggtgacaaagtgagaccctgtgtctaaaaagagagagagaaaaaaagctaaggctattttcaggttaggtcaggcttagtaacaaaaactttttgtgaaatgcttcgatcattgtttgccctgctcctaatttcccttaaaacctcccggatcagacaggtggtctttgaagatgagttcacagcctccctcgagtttttggcttcctgaatgtagctaactttccctttcaccaacatttgtctctagacttttggctttcaagcaacaagtggcctagatctgggtttggttacaaattttggcaagcccagccagaagccgtgtgctctgggctgtttgcaccctgtcagctcccaacagacaaagcaattggtcacagcttcataccaggactaactcatccatattgttgggaggacttcttggttcccaagaggtggagcaattgatggcggcagcaggtcagggctaactcattcacattaccagaggttagcggcaaatgctctgtggcactggctactcatggcagaagggaactgcagagacagccccaaagtctgccaaagagaggctgccaaaactctttctacttcagggaaacttcctcctttcccccattcagtactgactgcctacttttgcttttagttggtgaaaggaaactagctttattttttttattttaattttttttgagatggagtctcgctctgtcacccaagctggtgtgcaggggcgcaatctcggctcactgcaagctctgcctcctgggttcatgccattctcctgcctcagcatcctaggagtagctgggactacaggcgcccgccaccatgcccggctaatttttgtattttcagtagagacggggtttcaccttgttagccaggatggtctccatctcctgacctcgtgatccgcccgccttggcctcccaaagtgctgggaaactagctttttggatgagctgatgagctgtacaaccaggtaagtctactggggtgcaaagtagtagtccactttctttaccatttgggcctttggaccatttgtggtaccactggtagaagaaatgactcatagtgactccataccagtctcttcctttgtgaaagcctgggttggaaaagtgcttcatttgttttggttgtgttttgtttgtgtccaccatgggaagtttttttcatcagtcccctctcagagcccactgtggttcatattggctgactggtaagcctacagtgataaccctacgacaaaaaagataatctactgcaataaggtgtggtcaatgtacgtgatacatgaggaagataggtggccattacatggttctttgaatttaatgttatacagcttgaacatttcaatctgagatcaggaaattgggactgcataccttatattcaagcttttatgttggtacataataagcacgcttcccagaaaggttgctggctgatggtgcaaacaggaccatatcaggtaaaatctcctcactctccattacctgaggaggaaaagaaggagataggataatcttgtcaactataaaccctccacaggcaaatgatgctgaggctttgcaggtgcctgtcccattgcagcctgctctggcacctgtgcaggctcccatggaggccccagctgcagtaccagcacagtaccctgagttgccccatctctgccccctccaccagaggattatccagataatacagacttacagggtgtggtggcccctcctcattttaaaggtagccaagaaataggctccccttttaagacctgacaaggcaactaaatttgaccacagcgtacaccctcatgcggcagaacaatttctgttatgcaaattccccgctggaggattaaatgcacagggccatactcctgggctattttggttattcaccattttctatctttgactaagtaaatggaaaaatattcaagtccatcctatagggatgatccataggagatgactgaaatattcaccagtattttttctattcatcattccacaatagcaggtgtacaagcattattaaattttatgatgaaagggggttatttttagacaagactaatgatggagccagaaggctataccaggaagaccctgctgggtcctccaacatcccagaggcaatttccttagtgaaacgcaaatgaaaccttaataatgaggttatatcttgactgtaggattactcctaagaaagggagtacctaagcagcaaagcctcaataaaaaacatccatgacctctggtaggaggccagtgaaaacccagcagcttggttgaaacaagtgtaacaggcttacagaaaatattcagatattgatccagaggctctggaacatgtttgggtcataaatataactttcatcagccaaagtgcttctgacattaacagaaaattagaaaagcaggaagggactgttggaatgaacccttcccagtttacagatattgcttacaaagacttcaatgctagagaaacaagaaaagctagacaggcaaccattttcatggagactgttcaaaaaggtggaagaatgaggggtgaaatagaaaggaatccctagacaaggaccagtgtgcctacagtggggaaatctggacatgagaagtatgcccccctaagctacagagaaaagatggtaataaaaaagacaagggagaggaaaagggaaatatacgccaaagaaggagatggtggagcaggattgtgactctgatgaagactgatggggcacagggactccgcctgatttaacagagcaacagtaatttccctacaggagccctgggtacaagcgacagtggggaacaaaatgactggcttattggttgatactgtagcaatgtttccagccaaggctggagtcactgggaagttacaacagagactctttcttaagccctaagaatataaattgagggatataagattgaggtatagctttctgtatatgccacattgccctattccattgttgggccaagatttgttatgtaaattaaatgcccaagtcacttttgctcctgagaaacaacatctaagaatccaggtatcacccaaacatgtcctatgcctacaggcactggtgattcagccagagaaaagaactcaagaaccattcctgctggaagtctacaacagagggagttgcactgtttgggaagacaagggaacctgaactagcagtcaaagctcagcctgtgcacgttgaatttaaaaaagcattaattccacataaaaacaacactgcttaaaaggtaaagaattagaagtcatacagggggattacacaggtttctaaagcacagacttattcaatcatgacagtctcaatacaataccactatcttgccagtgaagaaaccaaactccaattagtatcaatttgtgcaaatttgagagctattaatgacatcgttcaagatacccacccaatcgtggctaacccatataccccacttacagctaccccaggggattatggctggttctcagcataggaattaaaggatgcttttgttcagtgtctactaattgaggagaaagcccagttgtttttgcacttgaatggcaagatctggagactagggcaaacttccaaaactgctagactgtactgcccaaatatttaagtattcctttaccatttttgaaaaaaatcttactaaaagatttgagaagcttgcaattaaacaggggaatactattacaatgcatgggtaatttactcattgctagccccacttatgaagactgtttataccagtttttgtttgattgttttgaaacaaggtctcactctgccacccatgctagagtgcagtggtgtgatcatgggtcactgcagccttgccctcctaggctcaagcgagcttcccaccttagcctcccaagtagctgggactgcatgtgtgtgccactgcacatggctaatttttaaaatttatttgttgtagagatggagtctcacagtgttgtccaggctggccttgaacttttgtgcttaagcgatccttcaactgtggcctcccaaagtgtctggattacaggcgtgagccaccgcacctggccaatactagttttaaacagcctggtggaattggatcataaagtatctctttgcaaatatgcaaagagcaggtagtctattcaggggtttgcctgcaataaggtaagcagagtctgatgcctgacaggtaacaagcaatagccactatcaaggctctcaaaaatcagataactaaaaggagtcttaggtatagttggcttttgtcacctttgatccctaattttggtctcctagtaaaggacttatctgaggcatttaaaatgtcagagtcagaacctttatattagacagtggaatgccaacagtcattcaataacattaaagaaaaactaaggaaattctttatgggcccccaagatgtttaccctaagatagttacgttgaatttcaccctgaccatgtaaattgatggcttatcttcacaggcatggaacaagagacataagtcatccctcttctcacctgagacaaatgcatatctgattgctccccctgcctgtttatcttatgtaaaaatgcaggttcattgaactagatgaatgtttaagtgactgttcccctaccctcttacatgtgaaggctaatcaaagactcaaaagaatgcaactgcttgcctcttatctacccatacccttttaaaaatgtatcttcctctttcaatacctggccttttccctttaaatattgggatcccaagaccctctttggaaaaagcatgaaacacaatgtttcctgtggatctacgttctttcctggacatgtcctcaacctcagcaaataaacctaaaatgatcaggactcaccttggtcatttttctttagtttacatttcctaagctacagacctgtgcagcacatgactatactgaatactgtgggcaacttcaacatgatggtatctgtgtctccaaatgtctcaacaaagaaaaggtacagtaaacatatggtttgaaagataaaagtggtatgcctctaaagggcactaaagggcactatagcattatagtatttatatgtctttgtccagggttcctggctcataacttctatggccctcattatagtcttgttatagtgctgggacactttaggctcagaaaacagactctctctgtctctgactttctcctgccctcctttcacctgcccaaggcaggactctgcacatcataagatcctcattccagagagggtcctgcccatccttaggaggtgggaatgctgcacagagaggccaagaatctggataagccttggtgggttttcccatctcagacaactagtgttagatcatcccttctggtccagttgtatttgtacatggttgtcaatcatgtctacccaatgatgtctccattgaaggctcaagaggacagggctcagggagcttctggaaagctgaacacgtggaggctgacaaaactcttccctatgccaggagggtggccacaccccaactccacagaagctcctgggttagggacccctccagactcaccccatgtatctcttcatctggctgtttatttgtatcatgtaaaataccctttgtaataaaccagtaaacataagtgtttccctgagttgtgtgagcactctagcaaattaatcaaacacaaagaagaggtcataggaaccccaacttgaagctggtgggtcagatgttctacagacctggacttgctatcttgggaaggaggggacagtcttgggagaatgagcctacaacctgtgggatctgatgctatctccaggtaggcggtgtcacaattgaactggaggacacctagctggtgtcccctccagaactgcttgtttgcttggtgtgtggggagaaattcccctgtatgtcgtcatagaagtcttccatgttgatggttgctgtggtgtgagagcagaagaaaaacacattggaggtggtttttccacacacaggcacttactatgaatggagcttgcaggactggaagttgctctgggtgagtcagggagtgtgtgttgcgtgcaggtgaaagcctaggacattactgcacactgttgtggactttataaacagtggacacttaggctacactaaatttgttaaaatattgttctttcttcagtaaattaaccttaggtttctgtatctctttcactttataaacgttttaattttttaaactttttgactcttgtaataacgcttaatttaaaacacaactgtacagcttttctttataagcttttttctatttaaaaaaatttcttttaaacttttctgttaaaaattaagacacaaacacacacattagctcaggcctaaacagggtcaggatcatcaatatcactgtcttccacgtgttgtcccactggaaggtcttcaggggcagtaacgcgtatgaagctgccgcgtcttatggtaacaatgcttccttctgggatatttcctgaaggatcttggctgaatctgcttttcagtcagcttcgtttttggaaagcagaggccgggcatggtggctcacacctgtaatccccgtactttgggaggacaaggtagaaggatcacatatagccaggagttcaagacaagtttagacaacagagcaagaacctgtctctacaaaaagtaaagataaaaaaaattagtcgggtgtgatagtgtgcatctgttgtccagctacttgggggactgaggtgagaggatggcatgagcccagttcaacactttagtgagctatgattatgccgctgcagtccagcctaggcaacagagcgagactctgtctcaaaaacagaacaaaactagaaagagtacactctaaaataataataaaagtattgtaaacacataaaccagtaacagtcatttatgatcattatcaagtattgtgtactgtatgtaactctccaagctatactcttatacactggcaactcaggtttgcttataccaggaccaccacaaacatgtgagtcatgcgttgtgctaccatgttatgatagttactatgccactaggtcacagaaattgctcagctctgttataatctatggaaccaccttcctatatgcagtctgttgttggctgaaatatcgttatgcagcccgtgactgtgcattggcatttgtccacttggtcttcagcctagctttgtactttgtctttgacattttggcttccactgcaatttacttcaggcttggactccttgaggatctctccaaacctgccatggtctgtttcttgccaccagtccctagctgcacattcttagggcagctgccccagcttagtctgatttatggggccccttatctcgtaacttttagaatcttgaccaagtcaggctacccggcaggaggaaatgtcaaaggcagaggcaaaagtggccctctcactttatctgtatctccagggtcttcctttgcatggtctcctttccttccaccctcaagtccattcctctcctgtttctctccgcccctccaggtttcctcctttaaccgcatcacctagagtcatcttcaccgtgcaaagtggttttgttcaaactaatgtattaacactcaactcagtgcagttgccctttgaatgatcacacccaggagacttttttctaattagtgttcaccttgactgtactatatttcagtgttgatcattttgtcctttggctcagatagctgtaaactgccttctatttcactgattcatcattctctcatcttcctttcccatcttcaaatgtggatatttcctaaaggtcattctctgttcctcattttttttcaaaaacttttaataaaatatacataatcaaatgtaccttaaccctgttcaaatgtacacttcattcatgttgaacatactggcattgttgtgcgaccagtctccagaacttttcctcttgcaaaactgaaattcttacacccgtaaaacaactccctatttgcccttcccccagcccctgacaatcactcttctactttctgtctctatgaatctgactactctaacaacctcatgtaagtagaataatacagtatttgtcttttgactggctttttcactgagtataatgtgatggttaattttatgtgtcaacttggctgagccaccgtacccatacatttggccaacattattctgggtgtttctgtgaaggtgttttttggatgagattaacatttaaatcaatggactctaagtaaagcagattaccctccgtaatgtgggtggacctcatccaattaggtgaagaccttactagaacaaagactgacttcccctgaacaaggagttgtgccagcagactgcctttggccttgaaccataactcttccctaggtctccagcctgccagccaatacaatcagattttcactcaccagtcctccacaactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaacttccttccaagactgaatcatattccattgtatgtatataccacactttatgcacttatctgtcaatagacacttgggttgcttctaccttttggctgttgcaaataatgttgttataaacacaggtgtgcaaaaatgtcaagacactgcttttacttctgttgtttacaaacccagatgtgaaattgttggatcatatggtaattctatttttaatttttttccatagtgactaccccattttacattcccaccagccatgtacaaaagttctaatttctctatatccttgccatcatttattttttgttttgctccttttgggttgaggttttttctttcttctttttttttgagacagggtcttgctctgtcacccaggctggagtgcagtggtgcaattatagctcactacagccttgaactcccgggctcacacaatcctcctacctcagccttttgggtagctgggactacaggtgtgtgccacgattcccccctaatatttttttaaattttttgcagagatctggtctcactatgttacacaggatggtcttgaacacctgccctcaagttatcctctcgcttcagcttcccaaagtgctggaattgcaagcataagccactgtgcctggctgtgtgtgtgtgtgtgtgtgtgtgtgtaatagtagccatccccatggattgcagtggtacctcatcgtggctttgagttgcattttcccagtgactgggatgtcgagcatcttttcatgtgcctgtgggccatttgcacatcttttacggagaaatatctatttaagtattttgccaatttttttaatcagattgttttcatgttgctgagatatagaagttctttatatattctggttattaaccccttatcagatagatgatttacaaatacttgctcccattctgtaggttgccttttcactctgttgatcctgcccttcaatgcacagaagttgtaacttttgttgttgtccaattcatctatttttatgttattttacaaatccctcaactcatcaccaattttttttgttgcctgtgctttttggtgtcatagccaaggaatcattgccaaatgcaatgtcataaagcttttcccctctgttttcttctaccagttttatagttttatagcttttaactttaatttttaattttaacttcattttaactttagaaaatccatcttaagttaatttggatatattgtataagacaaggatcctacttcattcttttatatgtggatacctccttccttttggaaacttttcctttcagtaatcttactacctccacagctttagtttagatgttttttgttgttgttgttgtttcccaggggtgatcaaatccatatatccagcttttaccaccttcctgagttctagtccccccattttcaaacaccactgaaaatttagtttgactaagtacatcaacctattatgtgaagaaacaccatgtcccacccccactacggtgtggcttaatgagctaaagtaatatatcaagatagacataataatccaagaaactggggttcagagaagtaaatattattagggtgcatcttgcgctgttccagagtgaggcatatagggttttggggacagaacaatctagtctctgataatgttttctcttatagcacaggcacatttcatgagcctttcccactacctaggtgttccagtttggatgtggtttgtttggcctaagtctcatgttgaaatctgatttccagtgttggaggtggcgtctggtgggcaatgtttggaccatgggggtacatccctcatgaaaggcttgctgcccttatggcagaagtgactcagttctcactcttagttcccaagagaattgcttgttgaaaacaaacttgtacctcctacatgctctccttctagaagaggatctaaggaaatttataataaaagcagaggaacgctgaaaccaaacccaattcatatcagtaatagctaccatttgttaagcttccacaatgacaagtaagatgttaagccctttatgttaccaggattatctcatttatctcataagaattctagaacataggtcctattattatctttattttattcgtgagaaaagcagagactcagaaggcttaagtcataggccaaggtcatccagccagttgaatggtggagtggggaatatctggatccaggcagtcagactgtttttttttgtttttttttttttgagacggagtctcgctctgtcacccaggctggagtgcagtgccgtgatctcggctcactgcaagctccgcctcccaggttcacgccattctcctgcctcagcctcccaagtagctgggactacaggcgcccaccaccacgcccggctaattttttttttttttgtatttttagtagagacggggtttcaccatgttagccaggatggtctcgatctccagacctcgtgatctgcccaccaggcagtcagactttattagaacatgcacttaaaattagcaagaaggaatgagaacaacaacaacaaaattaaaaaatgcttgccaaagaaaactaaaacaatgtgcaatatttagccctgagatcactagcagtgaaggcaaagaagaatgcataatgggtttctacagctctcactgtccggttatagaaaatatttctacattagtacaagcacttttcttcctaagccctgagttttgagagtttatcaagaaggcctctgagttcattcaattaatggcatcatctaaggctgtttaataacaaatgcagaggtagtccacataaggaacttttgcctttacctttgagacaaagcccagggcctcacgttaggagtacagctctctaaatataagcctccagggcagaagcgaggggaggatggagggacacaatgcagatttacagcctggtgggtacggcctttgtcctctccatgtctattgtcactcttgaggtccaagcctctactgcactgcctggtttactgcacaacccaacttggctgcttgcttctggtctctccccaccaaaccatccttcacactgcttccagcttaatatttccaagacactgcatttgcaaatccactcctctgtttaaaaatgtttcagtgacttgcaacttgtctacagtgtgaagtataaatttattagcttgttgtttaaagccttctacaaccagaccccgaccgaccttcacgtcctattgagaggtgacagcctgctggcagccctcgcagccctggctcgctcttggcgcctcctcggccttggcacccactctggccgcgcttgaggagcccctcagcccgcagctgcactgtaggagcccctttctgggctggccaaggccggagccagctccctcagcttgcagggaggtgtggagggagaggcgcaggcgggaaccggggctgcgctcggcgcttgcgggccagcgcgagttcccggtgggcgtgggctcggcgggccccgcaatcggagcagccggcccgccagccccgggcagtgaggggtttagtacctgggccagcagctgccgtgctccatttctcgccgggccttagctgcctccccgcggggcagggctcgggacctgcagcccaccatgactgagcagcccgccatgactgagccgcctgccggcgccccagccatgggctcctacgcggccggagcctccccgacgagcgccgccccctaatccgcggtgcccagtcccatcaacccccaaagggctgaggagtgccggtgcacagcgcgggattggcaggcagctccacctgctgcccgctgccgcatccacttggtgaagccagctgagttcctaagtctagtggggacttggagaacctttatgtctagctaagggattgtaaatacaccaatgggcactctgtatctagctcaaggtttgcaaacacaccaatcagcaccctgtgtctagctcagggtttgtgaatgaaccaatcggcactgtgtatctagttaatctggtggggacttggagaacctttgtctagctaagggattgtgaatgcaccaatcggcactctgtatctagctcaaagtttgtaaatgcaccaatcagcactctgtgtctagctcacggtttgtaaatacaccaatcgacactgtgtatctcgctaatctagtggtgacctggagaacttttgtgtctagctcagggattataaacgcaccaatcagcaccctgtcaaaacggctcaatcagctctctgtaaaacagaccaatcagctctctctaaaatggaccaatcagcaggatgtgggtggggccagagaagagaataaacacaggctgccctaagacagcagcagtaactcactaggattttcttaccacagtatggaagctttgttctttttgttttttaggtctgcactgcctttatgagctgtaacactcactgcaaatgtctgcagcttcactcctgaagctagtgagatacacgaacccaccggggtgaactagcaactccagtacatgccgtcttaaaagctgtaacactcaggcgaaggtctgcagcttcactcctgagccagcaagaccacaaacccaccagaaggaaaaaactccaaacccatcggaacatctgagggaacaaactccagacacaccgcctttaaaaactaacaccgcgagggtctgcagcttcagtcttgcgttagtgagaccaagaacccatcaattctggacacactatcaactttgtttctccaagggtgcttcttaaactggatgatgcacaccctaggagtgtgtgtgtaggatggggtttgaagcagtagggtaaaaaacctagcatacattctattccagaggtgtcaatttaccagacaacagttattttaaaacttttttatgcaaaaacatgttatagggtggaatgcaacatttttatgggcctgtgggccatttgtatacatctttggagaaatggctatttaagtactctgcccattaattctaaacttaaaactaagacttcaaagtccctctaaggattttgctgggccacatcccaagaccctgaagggtattacttactcgccctctccaaactgccgaagtcggaagcaggtgacaaaaaagctgaccctggaatcaccttttgtaaatttcccacctccaagcttttcgatagtttgtaacactggctcctctccccaaaagcctttccttcaagtcccagcaactctccctgaccctgctgggaaggcgcaccaattacctgtcattccaggaaagctcatagcataagatgatcccattggtcatctcccagaaccagactttctgaaaagtcctcaaggaccagctagtccaatccctcactgaataaaggagaagcaaagtctagggaggtgaggtgattcgttgtcctcctaattagcaggtgagctcctggcagggctggggtttcatcttctgggctctctgcaaggtcgtgcccggcacgggccaggaacaatttcataaactcgtcatctagacggcctttgactgacaccatctctccgtgtggaggagccgctggggtgcacggggcaggtgtcgtccgtttcaaaggtaaaataacccagctgcagacctccagaggccgactagagccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgc

SEQ ID NO: 2155 - DNA, 95628 bp, Homo sapiens
cacagcattaacatttagtgggagtgcagtgagaattgggtttaacttctggcatttctgggcttgtggcttgtggttgattttttatttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaaggtaagattaaaagagactcttttctgaaaactgtattatgaaacatttgctaatgatgcttttcacaggagtaataaaaatttgatttagaaaatgtgcttaagtattctgtaacttgacaattgagtggcttttgacattgttgagtttaaaaaatgtaagaaccttatttgaatggtatatctaaatattcatcataattatatttaatataaaatagaataaaatgttttaataaacatttctgaaaaactatgatctggaataatcatttcccttgtaattatcataaaatgtaatttacttttttgcttaggagtataaccaaaatgtattatgtgaaagcattaagaaggatgtgaatatacatagtcaataaaagccatcaaatcataatgattagatttatttcaaatatgattttaactcttcctaaataaaaattcatttatcatttacaactgatattgtcatgaccttagaattcttgtagacaagtattacttgtattatcagaataaaaatattatataaatttgaaacccaattgaatatacaatatttgtaacagttaagttgttcaatagagatttttttcctgtagttgtatataacatatattcttgaagagcagtcttttggagtagtgaatatgaatgtaggagtttttttctgacctcagtaagacaatttctggattcataataaaatttaattatatcactgcttcttgatagattaaaaagcttattcttggaggaggtttgctttcctagtttttgataggtaaccagttatgtgatagatatttggtaaacatttttaaactgaatgaattacatattattcataatttctaaaatcttttcacttagtaaagaaattttgattgagtgaccattacatagcctctaggaactgaagaatattagcaaataatacaaatctctgtttcagtcttccaatctagaaaataaaagcagatatattcttatagttatacactttggtaatttaaaaaatattcaaatatgtttaataccttttgaaaggttgaattattttcagttatattttctaatgttattgcttgttctttggcttgtaaactttatatgtagccactttttaaatgaagaaaacaattatttccttgtacatataaatattataattagtattttaaaatgaaacctttttgtatttacaaacagttccagaacaatgtcaatattacctattgtaaaagacatctttttctgtttctttgtgtaaatatttctgtcttttcttactaaatttatgggaatgtttctaacgtttcatacctacatactgtttgctccagttttacatagataccatttgtcatataagggagatttgttttatttctaatctttaaaatcaagaatcaatggcaagtttaataaacagtttaagttattaaaaagttgaatttgaaatattattaaaatagagtacatcaaagtatatgtgataattaaacaatagtgatttaaacatcttatttacataattgattattgctgacttgtttcacttttattttatttttcatcaatgtgtgtttaaatgtggtatcagtttctactggtgaattgaacatcggcactatatatgttatggtgaaaatgatataaatctgattatttcctaaaagataaagcacaactttgtatttaaagcaatgcttaggccagcctcataattttcataaaagcacatgtaatgcaaaagccaatggagaaaaactacatgaattttcagtggatatcagactcctaatttattccttgtttcccaaatactctctgaaactaaactagttcgagatgtccatcagttctattaatctaccatatctaaaaaatttttacttaacagagtagctttgatcatgaaaaatactcacatatatttcaatatttgcttctgtttatattttccacattgaatactgaataccaaattgagaagatagtttgaatactatcacaatctgctttattcaacagcataacattttagcattacttctgctctgttaagagtgaactttcttcaaaaaaaacactattcattactaagaaagaattatagccagcaggaataatttgtaatttcagctttctatttgttttctttttttaatatattgggtactacatagaacctttctaatgcaatatattgtctacaataacatttccaattgtgtaggaacgttaattgcctccttgttttaacagtctggctcagggggtcactgcaggctactaagaattgggtcagatttacaggacaaagtttaaaataacagtttctcaatcgtaccacctaatttcacctttttgaaatatagtatgaccaaggttttgaatatattatgaccaagcagattttttagatttagggtctaacaattgtgtactatatgaaattaggccacagcccagaaattccaagatgattaaagtgaataaattaaaactctactgaaacatgttcaagtaaatactggctgtgttgtttgggagacatgttttttaatcctggagatttagagtgcagaaacgttatttcaggtcccagaagactttatagatcagagattgatggattccattacagtcagagaaaggagaatagtggtctaaaatcctaaattgtatgtttgaatttcagtgtgataaataagaattcccctttgctcccccaaacccccatattttcagagatagtagtatgtgtatttatctatatggtgtgatttaaattgtgcgatggcccaattggcttcaatatctcatctcctcctaaaatactttacgtgttgatattaatattactataatttcaaccaatctgtcatttacatggaatgacaaatacactgaatacatattttaggatagttaaatttagtattattcataatttactttgaattattatcatctgacaacttccctgaaacaatttcagtgggcgggggagggtagaaatggatgttgatgaggataagaatagaacaaagtgattctggaagatggggttttcccaggtaggacagatctgctggttgaagtgctatagtgagtgctataagagaaggggtagagaaaatgcccacagaaatggcacgagcctgagacgtctgccaaggcaagctttgcttattttaaatttaggcatatcctgggaatgcatatgctactcttttgcctacatataatttaaactaaaaatgaaatatctaagtattgctaactaaaattattcttaggtagaagtaagttcccaaatataagttcaaaagcagattggtaaatgttcttcatgtgtggcctttggtttctaagatctgagccagtctacattgacccacttttatttgcttaatcctcgattgtttattctgcagtcttttgccacttttcattcttcccagttatgccttctcctcctccccacacacaccatcccccacctgcctaggcctttgagattctgccacccaatctatcccgtgctcagttaactaacgtgtactttacccatttcttcacaaaaccatagtacatggaaaggggatgatgtaattgacaaaaaagtattgcattttagcttaaaattataaggagtcataaaaagatagctcagaggaaataaagtaactgaacatcaaaaaatgaaacaataaaaaggaaagaaaaaacatttgacagaacacttttatttcttctgacattttaacttagccaagtttttcataaaccttgttaactggaaatgtaatagatagaaaagtgattattcttccaggccgggcatggtggctcacacctgtaatcccaacactttgggaggcccaggtgggtggatcaccatgtcaggagttcgagaccagcctgaccaaaatggtgaaaccccatctctactaaaaatacaaaaattagccaggcgtggtggcgcgtgcctgtaatctcagctactcaggaggctgaggcaggagaattgcttgaatcagggaggcggaggttgcagtgagctgagatcatgccattgcccttcagcttgggcgacagagggagattccatctcaaaaagaaaaaaaaaaaaaagaaagaaagaaagaaagaaaaggaaaaagcaatattctttcagaaactcctgaactgtaacataaatttaagcttaggacacataggtcagatgtacaatggaattacaaatgttagagtttcctgggttcttgcaacagagttttaagtgcactaaacagttatcaccttgtcttctcttatattttctagtcactactgtctactacgctttttccacaggctgtccataatctacagatataatggaaaggcttccagatagtttcattgttactcatctgttctttcgctcattcatttttccatcactttaacttccacaagtactacttagtaatacttggtacaatgtgtgttgcgtttttttttttttttctctattttcagggtcctaattgtactgtctctttgtggctgagttcgttttttgtgactggaacaataactggcattagaaattagctattcaaatacacatttcaagaaagttgtggaatttcaacccatgttctgatagtatcttgttttatctctaattatgacatacttgttattctatccaacttcatgtgactatcgtctattctcctatctgctttttatggttctggaattttcttcttgctcttttcactgttaagttgtttgtttgtttgtttgtttgttttgagacaggatctcgctttgttgcctgaggctggagtgcccacgctggagtgcagtggtgcgatcatagttcactgcagcttccaacacctgggctcaagcaatcctcctgcctcagcctcccacacctagctaaatttttttcttttcttttttctttttctttctcaaatgcctattaagtgtgacataatctctattctgctttgtctctagagtttgtttctttaaacaattctttactctgtttacaaaggtatatatgttacttctgaaatgatctttattctcatgttatttataaaataatttgaatatttcttattttgaaaagctaattagatcatatcgtatatatgcatatagaattgacccttgaccaatatgtgcttgaacttcaggggtctgcttactatgtgaatttgtttcaactaaacctgggtcaaaaatacagtattggtgggttgcaaaacttaagcataggaaaaactgacttttcgtacatgcggtttccagagagccaaatgtagaatttaagtatgtgcagattttggcctgtgtgggagtcctggaatatatatcccctgtgtataccaaagccaaaggattattgaataaatagtattactatagatcagtgagaagataagaaagaaatttaatgcaaaatacctatttttgctatttctgttttgttcatttgctttatttttttccaaattgattttgtaactttgctttataatatattctgatacctactaagtttagaagtaggctatttaaaaaataatatctactgttttttatgcacaaaataattttagaaaaatagaataattgaacaaagagaccaactttagtctaccaaaacaatctagcacaaatttgattaaggatttcccaaatatataattttatcatgatttatttcatttgaataaaaacacttttcaactaacagttaaaagatatattgacattgaaaataagtaattagttctatgtttgtatgtcaataataagtaattagcttggtgtttgtatgtcaataatgcccccttaaaatttgaaagtgaaaaaattaggtaaattaagattattaaaatattaagtaatattgatttttagctttgaccaaaattatataactattttcctcaaattatagtaaaaacattcctactctttaccagtagttaaacgtattcacactcttaattcatgggctaaaaaaaaacttgattttgtttagtattattcttacttttttgagacagggaatcactttgtcacccaggctgcagcgtactggtgcaatcatggctcactgcagcctcgacctcctgggctcaagcagtcctcccacctaagcatcccaagtagcagggattacagccaccttgctcaggtaattttttttttttttttttttttgagatggagtcttgctctgtcgcccaggctggagtgcagtgtcgctatctcggctcactgcaagctccgcctcccgggttcacgccattctcctgcctcagcctcccgagtagctgggactacaggcacccaccaccaagcccggctatttttttgtatttgtagtagagacggagtttcaccgtgttagtgttagtcaggatggtctggatctcctgacctcgtgatctggtgatctgccggccttggcctcccaaagtgctgggattacaggcatgagccaccgcgcccggcctgctcaggtaatttttaaaattttttgtagagacagggtttcaccacgttgcccaggctggtcttgaactcctggggtctattgatcctcttgacttggcatgtcaaagtgctgggattataagcatgacccactgcatccagactaaaactaattttaaattgtaaaataaagccaaatgaattaaagcttcaccaatgtagtgttttgtaaacaaaattaactggcaattaaatgacttgtaaacgtaagatgaagtattcattgtttaaactcaaatacttagatatgatggcttagtctactcattaatctagaatgagaaaaatgagatggctatttcttttagttttaagataaatcacatctcaaaaaaatgtttctgtgcctttcaatttgtatgcatcctatttaataagcccgttgtacatacatgctgagagtttgactacttgggccaaaataaccgtttgttgtctacttgaaggtggttcaactgagcttgaacattcgattgttagtcaattcaggcaaataaaagttatgtcacaagatatacctaattattattagaactcagtgcagtgaatcattaccttaaatacttttgctatggcatgagttgataatgatgtaggacagcaagcccccaaattgggtcttagcctgggaaggttcttggttttgtccagtaaagaattcaagggtgagcctgtggtgttaaacagcaatttttgttgaagtggcagtgtatagcagcctcagaggcacctctccttgctaagcagggctacccataggcagtgtgcccacagtagcagctcagaggcagttctgcactcatatttatatgcacttttaattatatggaaattaagaggtagttaatgctgaaattgccaggaggaggatggtaacttccggttgttgggtcattgctgtggaaagggcctgtaacttctgggtgttgccatggtaatggtaaactgtcatagcacactggtctgtgtgtcttacagggaggggcttccactcagacctgttttggataatcctcaatttggtccagtgtccaagtcccatctcctatctcaataatactcaatacaataatggttagaacaaaagcagacaggaaagtgtatctgaagtgagaagacctagacattaatgaaaattcttccacgaactatgaaaaacattgttcttcaattgtggggagcttacattttgatgtggggagatagatagaaaacctaatgaacaaaaatagttatagcattgtgaaaaattttgtgaaggaggtaaagtagggcctaagagaaaatagagatggggatggtagtatgtagagacattaggtgggcttggtcttggggactagaatgagtggatcactttgaggacagaacatttgagtagaggcctgaaagatgagacaaagccagtcatcagaaatctgtcgtaaaattattctaagaggaggaaataacccgtgtaaaggatctaaggaaaaaataagtttgaaatgctcaacaaaatataaacaaataaatcagcgtgactttgcacagtaaatacatgggagatttaacatgatgagatccgagaaagtggcaagagccagataaggggttcccaaaccaaggaaaggagttagcaatgctggataagtaaaaagtgaagtcatagaagaattttaatcacaggaatgacatgaccagatttgcaagaatcacttgtcactctgtgaatagactgaagtaacaggagagtagaggactggaggctagttagcaggcaagtttcatgaccaaagtgacagatgatgatctgaactaagattttgaagatggtagtaggagcaagggaaaatagaacaggggcggtcatatctttttcttacaagcagaatcaaaagatgccatttaacactgatggaaaaagcaccagaattttaagtactatttgaagagaaaaggtaatcaatatgataattctttatatatagtaaacatattcacagagtaaatattgtgagaagttggtaggaagattttgtggaagagatgtatccttgttttctacatctggttgttaaaagcaatgaactatatttggaaatcaagaattaggggcacaaacgtatcacctggaaatataataataaccagaagggaaagcatttacttctcactaggaagtgagcgggctaaactttttttgtgttaatggattactttacttatttattttttccaataacctgaacatcatcaaatggatctaaattttgaaagtgaaaaacaaacatatcagcttgtaattaatcagttttccttttgtgcggaaggggccggggattgtgttgttatgatagagtattagcaccatctagtggagtagaatatgtttacttaaattataaacatcgaaatagtgcaatgtggaatcacatattatatgagttcactaatacaaatttgcaaaaaggtcaagggaaaattagtgcccataaaaactttcacattattttgtaaaatataattttatatggtgttttctttcttatgaaatattgcaaaatgttttcatatggatttgttccaccatgttaatgggcacttctaaaacttttttctttgggctgctacaacaaaatattattaactgcctagcttataaacaacaggaatgtatttcttacacttctgaatgctagaaagtctaacagcaagatagtaccagcagattcagtgtttggtgaggtctgctctctggttcatagacagtgccttttggctgtgtcctccaatgatgaaagggacaaggcagctctgtggtgcctcttctataaaggcacacatcccaaatcatgacagctccaccttcacgacctaatcacttcccagtgtccccacctcctaatactatcacattggtaattaggtttaaacatataaattgggggttgtggggaggttgcatgtattcagagcatagcatatgccttcttaacttactaaagtctaataataatttatcactcaggattcaatgcgggaagcttaagtagaagtagaagattacctatctatcagtcaattaattgattgacataccaatctcctatctacctacttaaaaagaggttttgttttgtttgttttgttttgttttgttttttaaataaattgcctcaaggaattgtgagcatgagataagcaagtctgaaatccacagggcaggtagtcagaaaaggaagattacagacaggatggaactcacaggaaaggaagctgctttccacagaattccctctctttttcagaggagcctcagccctatgtttcagacctttcaaatgatttgatctggcctatctagattacctagaatgatcagcttgtttaaagtcaactgattgggagtgtatctggcaacatattttctcaccaacatttagattagtttgactcaataactgggaatgctgacttaagcaagatgacttattaagaaaactgtcacagctcattaatacctttctgtttttctggacactgtgaagaacttaaaagacattaattttattaatccttctcacagtttacctactattgtcatgtgttttatgtatatgggtgtatacacatacatgtttgtatttaaaaccatgtaaggtaatatttttattattttatagtcagtattcatttatatttacttgaacatttaccattttctttgtttttcatttcttctttcatcctaagaccttatatttaggatcagtttcagttttctgaaatatatcttttttctctccttaatgtgtatttatagtggcaaattctctcaaattttattaatcagcccgggcacggtggctcactcctgcaatcccagcattttgggaggctaaggtgagtggattgcttgagcccaggagtttgagaccagcctgggcaaaacggcaaaacctcgtctctacaaaaaatacaaaaattagctgagagaggtagtttgtgactgtagtcacagctacttggggggctgaggcaggggaccacttgagcccagggggtcagggtcgcagcgagctaaaatcacaccactgcactccagcctgggcaatagagatcttgtcaaaaaataaaataaaataaattttatgaatcaaaactttattctcaaaaaattatttctgtatatagaattctatatagatagttatttcttcctgaaaatggaagtgattaatacctggtggcgtctgctattgctattgagaagtctttgtaaatctaaccattactgcttttaaattaatatttttctctaacaaggttaagatattttctctttggttttctgcatattccttatgatgcatataggtgtgtttttttactgcttggaattttttaattcttggatatattaattggtatgttccattcattttttaaaattctcttccaacattgctctggcttttctatcctcattgactcttagctcatcttgtgtattttccacacatgtgtgtctccatgttgcatcctgtattatttcttttgacctgccctcctgtccacgaattctttttacaactgtgttatctgctattaagctgtccattgatgattaaaatgggttttttcatttttagaaattatatttggttctttttaaaatctgctactactttgttataatttctttcctcagatatcattagtcaaacttttctcttacatttaaacaacagaattagtattgttgattatagtctgtatatatttattccaatatcaaatatctattttgttccttatgaagtttatggtaactaggtgctttttctcccgtataatgtctttgacatttgtaataataatttggtgcttaagaaaaaaatcttcctcatattaaagttacaacttatcttttctgggtggctagaagaactttcagtgtgagactaccttaagccaaatttgtgctttaaaattccttggtgctctaagcaattcaaagctgggttcctgtaagaagagtgtggtttacttccagttctcccttatcctgtgggtgaattcatttaggtttccaactttgaattttgttgctttagcctaataaggctatcaaaaagcaagcttgtgtcttccccaaatggtgaatgcccacagtgcagaaaaaaattggctgcctgttttcctttctgggttctgattataccaagatatgttatggtaattctttactgtctcgtcagctttctaaatgcctctatgaaagtatttatttcaaaacatatgttttcctgtttttttccccttttgtgacagggtctcaccctgtctctcggctggagtgcggtgacatgatcatagctcactgcatccttaaactcctgggctcaagagaccctcctgtcccagcctctcacatagctgggacaacaagtgtgtgccaccatgggtaactaatttgtttctttaattttttgtagagatgggatcttgctatattgcccagggtggtctcagactcctgggctcaaggggattctcccacctcagcctcccaaaatgttgggattacaggtgtgagccaccatggctggccacctggttttattgtgaaggtgtcctaagtgataagattaatctgaaataatgaatcccaaggcactcaaattttttgtgaaatagccagacaataaatattttagacttcgtgagccataatgtctcgctactcagctcttctattgtaacataaaaggagtcatagacaatatataactatatgagcatagctgtgttctactaaaattttatttacaaaacaagcagcgattggatttggcccacaggttagttttctggcccctgacctaatgtatctcactataacagaaaatatatactgactttccttcttactattataaattttatgcacataattaaatattacccaaaccacaatttttaattcagatgggtgtagcataatttgacaattttcataaatattctaattatatccattattaaaaatgctggaataaacactctgtacctaaatatttcacaaaatctttaattattatttgttacttttaaaaaattgaaattatttgtcaacttacgtatgagtacttttaagattctttattgctaagttgctttttagtgaagtaatagtcatttatatttcagttttatttaataataatatttatattacctaattttccagcaaaattgattatcatctcctttacatttttgtgttaaaattggtcaaaaaataattttcttttaatttttatctcttttaattattggtaatggtcacgttaatgcctgttcttaagtaaatgatctatcctactctaacatttttctttagatagtgtttagtgcttttgttactgcaagaagtgtttgtgttaagaataatttttcagttaaattttctccacattttgtatatatgattttttcacaaatataatttttaattaacaaagttttaatgtgtatatgttctgtttgcaaattgctttatgcattaagccttccttttttgatatttattcatactttttaataaatatatttataaaataaatataattatagatagatggcactaagataatagtaagttaaaatgacatatcatcatatatagcagataattaaaaaattataaaagaatgaaacatatatgtatttattttaaatttgtttaaacctaactctttagtctacctggcatttgtgtgcatgtgtctgtgcaaataaagtaaggattcaaatttatcccatttcatttccagtgggttttattttttatttattattattatatttttttgagacagagctttgctcttgttgcccaggctggagtgcaatggcgtgatcttgggttactgcaatctccgcctctcaggttcaagagattctcctgcctcacgcccccacgtagctgggattacaggcatgtgccacaacagttggctaattttgtatttttagtagagacggggtttcgacatgtttgtcgggctagtctcgaactcctgacctcaggtgatccacccatctcagcctcccaaagtgctgggaatataggcgtgagccaccgcacccggccccagtggattttaattgcaagcctgccagagtgagtttcaatttgaggtagtccaagtttacacagtacgatagacttacccattgccaaggttacttggcttgaaggaaaatacagaataaggataaaggcagtatgcacaagaacagcttgatggagatttcaggcactgaaactcagcttctaatatcttaacccccaccaggataattttgctgatgaaggatgaaagttgatgccagtataggtcacatccatgcccggtaacaacagaattgggtatccttagtttaaatactttagttgtcaccttgaacttggagggtgatttatgtgatcatcactattatttgctgttttctattttctttagatttcatttaatgttttactagtttcttgaattagaaatttggataattgatttccaacagttttttatttctaattcattcgagttatatttttttctctctaatcagtgcttcagcatcagcccacaaattttaacatatatttccattattgtttatttcaaatcatattctcatttatattatatttttctttaactcatgagttatttataagtgttgcttgccaagtgcggtggctcacgcctgtaatctcagcactttgggaggccgaggtgggcggatcacttttgggaggccgaggtcaggagattgagaccatcctggctaacacggtgaaacaccgtttctactaaaaatacaagaaaaaaaaacccaaaaaatagccgggcatggtggcgggcacctgtagttccagctactcagatggctgaggcaggagaatggcgtgaacccaggagtggaggttgtggtgagctgagattgggcactccagcatgggggacagagcgagactccgtctcaaaaaaaaaaaaaaaaaaaaagggttgcttaacttcaaaaattttgtgaattttccacttattttctgttagcaatgtctagtggtcagggagtatacttagagtggctttaattttttgagattggtagagatttgcttggaatgaatatgcatcttgcaattgttgaagacagtgttttattaatataaaaaacttaatttggttaataatgttgcttatatcttgtatatccttatttttctatttcttttctattggatattggaaacagtgtgcttaaatctcaaactatgatggtggattgcttacttcttttatttctgttatattttgaagatgtattaatagttttatgcaaagaggcatgctggtaaatgtaaaacaaccaactattttttaaaaggaaagggaacaaccatgatttgtaaaatttgctgagtttcatggtgtaaattctcacaatatggtcaatttcaagttaccaacgtgtcatcaggagacattgtattagcaaaagatgtgtataattggctcctatgagtcagtatgagccagctccagcaaacattgttcagacacatttgcaattattacatctttctgttaaagtagcctttttattaatatgaaatgactctctttttatctaataatactttctaactaaaattatcatttgcttgatattaatacattaatatcattcttactttggttgatacttttctagcatattggtttttatcatttactctcaatttatatgtacaattttattaaaagtaatcatcatatatttgagttttcttttatgcttttatccagtcagacaatctttgtatgtttagtatggtgatgaatccatttatatttaatgtaattactgatacagttcagtttaagtctagcatattgctacttacttttgcctcaatttttctctcttcttttcctgccttctcttattttaatcaaatagtcttgactatctcattacatcatgtattctagttattttatgtatctcaatattattggtttagtggctaacttagcaattacaacaaaacatgcttaaattattacaatttattctaaattaatatttttaccacatcaagactatggggaaaacatcacaacacttttattttctttaccttttcctgacacttttgctactattgtttcatattatactcttgaatttattaaaaacactattaaacatggtctattgatttaaacagtcaaggctcttttttatttgagtaaaatatacatagcatagggtttatcatgtttcaatagcttttttatttactcttctatttattttcttcagttctgcttattcctttttgtacttctttgcttatattttagatcagtttccttcagcccagagaacttttttagtatttttctatagttgagtctgctcttgttgaattctttctgcttttgtttgcttaagaatgtgtttctatttgctttcatttttgaagtatattttcaccatttatagagttctctgctgacttttaattttcagcactttagtaatgctaagacatatatattcagacttcagtatttacttccacagacttggctgttatttttactattctcctggaaaaaaaatgtttcctctgtctgtgatatggtttggctctgtgtccccacccaaatctcatcttaaattataatctccataatcatcacatgtcaagggaggaactcagtgggaggtgactggatcatgggggttgtttgtcccatgctgttctcatgatagtgagtgagttcttatgagatttaatggtttaagcatctggcatttccccaacttgcacttctctctcctgctaccatatgaagaagatcctctcttcttcttcaccttccactatgattgtaagtttcctgaagcctccccaaccatgtgaaagtatgaatcagtttaaacttctttttttatgaactacccagtctcaggtaattctttatagcagtgcaaaatggactaatacagtaaattggtaccaaggtagtagggcactattataaagatacctcaaaatgtggaagtgactttggaactgggtaatgggcagaggttggaacagtttggaggtctcaaaagaagacaggaagatgtgggaaagcttggaacttcctagagacttgttgaatgctttagaccaaaatgctgatagtgatctggaatatgaagtccaggctgaggtggtctcagatggggacaaggaacttattgggagctggatcaaagatcactctaactgtgttttagcaaagagattggcaacattttgccccttccctagagatctgtggaactttgaactttgagaaagttggtctgaaattggaacttatgtttaaaagggaagcagagcataaaagtttggaaaatttgcagcctgatgatgcaatagaaataaaacccgaattttcttgggaaaaatgcaagcccactggagaaatctgtgtaaggaatgaggagccaaatgttaatcaccatgacaagggaaaaatgtctccagggaatgttagtgatctttaaggcagcctctcccatcacaggcctggttgcctcggaaggaaaaatggttttgcaggcctgggccccactgctgtatgcagtctcaggagttggtggcttgcatcctagctgcaccagctgcagccatgtctaaaaggggccaacatacagcttgggccattgcttcagataatgaaagccctaagccttggcagcttccacatggtgttggtcctgtgggtacacagaatacaaaacctccacctagattcagaaaatgtatataagtgcttagatgtccaggcagaggtgtgctgcaagggaggaaccctcatggagaacctctactagggcaatgagcaagggaaatgtaggattggagcccccacacagaggtcccagtggggcactacctaatggagctgtgagaagagggccacagatcctccagatcccagaatggtagattcactgacaggttgcaccttgtgcctggaaaagccacagagactcaatgccagcagtgaaagtagccagggcagggggccataccttgcaaaaccattggggcaggtctgcccaaggctgtgggagctcacctcttgcatcagtgtgacctgaatgtgagacatggaatcaaaggggactgttttggaactttgagttttaatgacttccctattggatttctgactttcatggagcctttggtccctttgttttagccaattcatcccatttgggatgggagcatttacccaatgcctgtattcccattgtatcttgaaaatgactaattttcttttgattttacaagctcatatgtggaagggacttgccttgtctcagatgagactttggacatggactttagggttaatgctgtagtgagttaagacttggggggactgttgggaaggcatgattatgttttgaaatgtgaggacatgagatttgggaaaggcaaggggcagaataatatggttaggctctgtgtccctacccaaatctcatcttaaattgtaatcaccataatccctgtgtgttgagggaaggacccagtgggacgtgcttggatcatggggcagtttctcctatgctattctcgtgatagtgaatgagttctcatgaggtttgatggttttataagcatctggcatttcccctgtttgcacttctctcttgccatcatgtgaagaggtctttccttccccttccaccatgactgtaactttcctgaggcctccccaaccatgtggaattgtgagtcaattatatctcttttctttataaattacccagtcttgagtatttcttcatagctgtgcaaaaatggactaatacaatctgcttttaagattttgcctttatctttggttttcagcagagtatcagtataggttttcttggtatacagcattttgggggtttttagaaattttgattttgtgagctgatttctttcatcaattttggaaacctttgagctattgtttcttcaaatattgcctatgttcattttcttctctattgttagaattccaattaaacatgttttataacttgactctacaccacacatttttttatactctgttttgtttgttgttgtttatacacttttgtctttctatatttccttttggttatttttacattaaacttcctctaagtttaataagtttgtattgtgctgtgtccatttgattcttaaaaccatctgacaagttgttatttctgatttttgatccaattttaagatagcacatgatttatgagtcaattttattttgaatatcttttttaaattttcatttctatattttctatagttcctttaatgttcctaaaatagctgttataaagacctaacactaattctaacatctgaatctgagtgtctagttctactgaatatttattttctctttttgttcacagttgtttttgcttttttgtgtatcttttaatttttattcaaaatcgtatttttaaacaaaaacatgtaatgacaaaagtttatataacttactctcatcaacaagattgtttgctctttcttgagccactcaaaaatttaactcagagggacctgggtaacacttttagtttgagtcagtcccatttctggtttctagtctcaaagattaaaccctcttgggtttttaaagtcaagaatctggttggtttcttctatctcaaaagactaatacacacacacacacacacacacacacacacacacacacagagtatatacatatacacatatatatacataaatataaatatgtgtatatatatatactatatatgtgtgtacatatattagacttttgagatagaagaagccaacacatatatattatgtatgtgagcatatgatatatatataataaaagccatttatatatatgtttgcttttctgctgttttgactctgttcttatatatatataatcttaaatgctcatatataaatgaaacagcagaaaagtgaacatatatataagagcttttattatatataaataatatatatatgtatacagcttttctgctgttttgacatctgctcttaaatatcatccagagtgactttcaaatatggcatgttttgatgagaatactagttgtgtatttgagtcagatccattttcttattgagactttttttctatgagacaacgggaaagtcagtcttcccgtatgaagctacctagactctagcaaagcaacctgatttggcaaagtttcagaattcttcatgctagatatagcctccttatgtttggttctttcttacctcattaccattcttccattcagactaaatagaggcctgatcttcaatccatatccagagctgacaaacataaccaggtaaaaaatggccagagaccctatatttacttgaaacaggtccttcctacttgtgttttgttcatttaatcctctttgctcccacaacttacctttgaacatacacatgcacacacaatttgttgttgttccaatttggagtagaaacattgttcttttccatcctattctatcttatttggagtgcctgtataattctgtattaacttatcatgctaatttttgtaaatataatttttctacctgtaatgcatattatacatctctttgattacttaataactggcttccctaatagaatggaaatgctttgagaacagatagtttgtttcttcattgttttttctttataacttagaatagtgctcaataaatatttcccaaattaatggaagaatagtagaatgctctccagcaattaagagtaatataacaaaatatatctattgctttgcaaagttttttaggtgtttttccacagtgaacattcttataaaattatgtagatacaaattttataaggtgaaatgtatagttacactacatgcatgaaatgtatgtttactccatagatatggggttaggagagagagagagagagagagaaatttagatagacctgtgactgtctaggcatttttaaaagcaacaattacctaaatatactgtacatttaaatagacactttatgcacttattttgtttttattgtttgtagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagagtaagtacttaatacatttgtgaaatttatgaaaactaggtgtaaaaatacttaagatttaatattgtagcaattatgcctgaattatatcactattgccagtcaaatacaaaataatacataatcttttttttttgttttgagatggagtctggctctgtcacctaggctgcagtgcagtggcgcaattttgagatggagtctccctctatcgcctggctggagtgcagtggcgctatttcggctcactgcaacctctgcctccctggttcaagcaattctcctgcctcaacttcccgagtagctgggactataggcacgtgccaccacgcccggctaatttttgtatttttagtagagatggggtttcaccaatgctgggcaggctggtctcgaactcctggcctcgtgatccacccacctcagcctcccaaagtgctgggattacaggcgtgagccaccgtgcccagccaatacatcatcattttcaaaaaggggtggtcatcctccaaaattaaaaaagcaagcatatagtttaagttcaattatgaaataatggctttgctatgtttaattttccttacattcaatctgtcttcttatataatatcaaatatacttgttcccccactcctacataaaatatattccttgctattacatactaattcataactttttttttcgttttagaaaggccctgtggacatcctggagatactccttttggtacttttacccttacaggaggaaatgtgtttgaatatggtgtaaaagctgtgtatacatgtaatgaggggtatgtagtccatacgaaaagaggtttataattaagatagtaaataggaactctactactttatatatttttaaggttattatatttttctatgagcatttaaaaaagtaatacacaagtacctgaaagtttaactatgatggaaataattaaatctggataccatattatctccttaacattgaaaaatttaaatgaagtataacttctctgatagagtataattatgggagagtgggaaaacagtatgcacatatataagtattcacccaacaagtcttcacgacattctattttgtgcagagtatcatgggagttcaatgtgtcaggaacaataggaattgtaaccaatttatattgtatggtaactgttttgacaggttttataaaatttaaggaaagcaagactttcacctgcttataagttttacttacaactaaggttacttaatgtcccaggtctgcaaattattcttaccacatggattaaaaatactactctttcagaatcattgactctgttccttctaaccaactactgggttttcattgccaaaatcatcactgtatatcctcagtgttattttatcccccttattctctgctagatgaaaaattattttggagaaaaatttatgtatgggaaaaccaggattagatcactataatcgtatacttcataaatataaatgtaaccaaatattacaaatggaataacattattatttccccattttttccttaatttgaagcaataaaatataatagtttaaagcttagtcactggagtaagcctgcctttcaaaactctaccacttaacatttatgggtatttaaaaatatatctcttcactaccatttcctctcctacaaaacagacacattttatgtgcatcatggattggcaggaaaaataaataagacacacatctgcagcccttagaagagaccttgagatatagtagataccaaataagtataatttcttatgaatttattctctccttagtcactacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggcttggatgagcagatttgactcactgggtattctcaggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcaccaagaaggagagaaagataaagggagagagaggttaagagatttttcatctatgaaaattagaggaagaagattaatgttctagagaacgttaagaaatctaagacagagtgaaggaggaggagaaggaggaaggaaaaacaaacaagaaacaagaaacaagaaaatgcatatgctgttcattttccttaatatggagtttctggacactcagaatggcatcgagtttaaaactgcatgtaaacacacattatgtcaacgttctgttattttttggttttcaggtatcaattgctaggtgagattaattaccgtgaatgtgacacagatggatggaccaatgatattcctatatgtgaaggtagacataaaatgtatttacaagtatattgaaataaatatctaagatttaaaaaaagtcttacattaaaatatcttaaagtctctattaaatatttttatttaatgtttttttttctcatacaatgtagagtgggaatctagtctttttattactacattcttggtgtttcaaaagccaaaaacgaatgcagcctgatctgatataataattgaagtattagacattaaggaatctaaaactgatttttatttccttttggattctaatgactagaaacgcatataagcatcattagctaaataaagaccagaattttgcctttattaatgaagaagaactcacccagtaaccacccaaatgcagggatctatggtaacagctgaagtggagaacgtgattgagacctcccactaagggaggttgcctgtggacttacctttactgaaaagaggaataaactaagggcgagctctgttatttctcactggtctgtaaagcaaacagtgaaaatgagaaaatgtagattctgttttcatgttttgagctaataatccaaatctctagtcattatggaaataaaagaaatcaaccagagtagtatttcctaattccacagtgagtggcaagtggagagagatacagaagaaacgtgataatcattcaaaaactgtcaactacagaaaataatggaagattttttcatctatgaaaattggaggaagaagattaatggtctagggaacatctacattgaaatcacctgggatgcttgttaaaaactaaaatctttggttactaaaaaatgacctactgaatcagtatctttggggtgagcatgcaggaagatagccctaaaatttttattttaacaagcatcctgagtcattctatagtacaataaagtttgaccacaactttagagaaattggaaaatattaagtagaatcaaaagaactactcaaattattttaaacacttaggtcgaagaggatggaaaattaacgatgatttctctattgaagttaatgtcataaagtttgcttttacatcttttaggaacacagtgttatattattctagggcataaatgaaaatgtatttaattatctcaagctttatatttcttaattatttaaaaatactagtttgttactacaaaaatacaagctagcattgaaagtagtaattttcattgtccactcccatagaaaagaatcaggaataaacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacatttaaaacatcgttcattctaaggaatatcagcaatattaacaatagctaatgtttattgagcacttactatctgcctgtaattgagctaagttctttgcatgcatcatttcattttaactttcaaaaaactccatgatttacttactcatcactttcattttataatggaagagactggtgcaaagaagttaaatcacatgccctggattatcatggcataaagagtcaagttaggatttaaatgtaggttatctgacaccagagtccatgctttaaccataactccattgtagttgtctcttaggttgaaagagaatgctaagtatttctgctgcaagctgtaagacctctggaatagacatttgtttttattttgaaagccaaagattcattatgtatttccagagatacattagaatgacattcgtttttgaataacacttttaggaagcagacctattttatatttgtactgcaagtttactataaatgttgctgaattgaacagaatccactaaataaattgttgcctcttaaaaaaagttttatagtaaactgtaagccaggatttttttagtcataatactgccaacctgtgcatcatgaccaatcaaagattttggcttctgtgataaacatcgtggttgatttgtttagtagtaccatagttcaagttcattttaccaataattgtttggcagaagtttctggcatatttatattttaatattatctaaaatatctaaattatttttactattaaagtctgttatatcttagatacagataaaagaatttctcttcttaagaacactttgtaacaacaatagttctttatgttaaatctaatatttttattcagcatagcaaatattatgtactttagaagtacatggatggaatttacatccttacaactagattcctgtggttagtgaaaacttcctggaatggctgatgcctacgattaagtcttaaagaaaaaaaacgagattttgtagatgaaaatgagagcaaaagcataccagagttcagggaaagggaagtggaagggcagtgaggctttaaggagcatgaagcaccactgattcttgtccattgttcctaggcaccttagtctaggatgcaagtagggaacgagtcagtgataaatagaaggtgggccaatacatagtgctgaggtgctgcatgcaccatgctgaagaacgcgtcttttattcagattgatttgggaatcaatgaaggatttcaagtggagttacgatgtgtctacctgagaggtcattaagctatacacaaggaaaatggattagaaagtgggagaacagagtttgggaaactacttatgattggcacaatcccaggtaaaaatgtttgagagaagtgggtataaaaggtataaaagatgatggccattttttttttttctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgcaataaacattttggaatttaatcccttttatttagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaaggtaatgttacctttattttctggatctttataaatttatcacatattttaattaattcttttaataaatccacttattttaatcaaaagtagagtgctaatttatgtaaataaactattataaaaaacatatagcattttctgtgttcaaggttcattttgagtacacttcgtacgatacacacactctgaaaacagacataaacagggccagaaaagttcagtagcttattaagtcattggtctatcatcaaaaaccatgtctggatcagagtgaggactataatagacttcctaattctcagtaacatacaattctcaaacaagtagattgctccactaatgcccagaatttatttaaattatatgaatattttaaaatactttaaaagtaacttgtattaataccaggtgaggaaactctcaactgacaatggaattaagttgaaggaagtgaatatttttgttaacaacaggcccagtatgactcaacggtgatgatggtcctggaaaattaccaaaaaaaaaaaaaaaaacctctcaactttcattatggagggatgttacacagagccaaagagttcatctcaactgtgctctttgcccaccaaaaaatatatctggaatagagtgttctacttaacctacttcattttaaacgggaaagtttcaaactatcatggccaagaagagagaatatggacagttgtggacttttaagaaattatgccataagacgtacagtaagaagctacagctatagtgtggtgataacagttttgagatattttcaaacatttataaaataagtgggtttgcttttgatgaggtctgctgcaattagtgaaacaaggaacagtgttaccacatatggtccagaaatctaaaagggtgatactgccatactgtgagagaaagaagagttgaactcttaagagccctctgaactttaaatcccatgattcataaatacatgtttaaactgtgctttagtaatcctcttttacaaaagaatagttaattttgggttaattttatacactaaaaaaattttggtttgagcccacaagtgtctccttggaaaacatatttttcttcacaattgcgtgatctctacttttaggcactgttaagagaatattttagaaagaaattaatgaacatgagacagtaataacccacatcagatccatgtttggctaatggtgtgtggggtccaactatttgtcttcatggcattcgtagttcctaagcaaaggaagtgcatgcacaagtcctttggcattaacttctacctgaagtatattatttccagagcccctctcaaatctatagtgaatttatccatgcagtaatcaaaatgtaacttataaaccacttattttacatcaggaccttgctgtgtattgaagataaacattgcaataaaccatcattccagctttcaatgaattcaaaataagactctgggaatttagttttatttgaatatgtgactctgtagcattactacctcattgtagtcatctgattttttcgtctcttttacttcttcactttgatacctacttaaaactcttccttagcacatatttgttttcacaatgagagatccatctgtttttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgcaggtcctgctttctttaggaaaagagataccaagagaaggcactgggattgggtactccttttcagaagacagttcactaataatcgatataaataaaggaggatttatcccaaattagttaagcatacactctctcaccacgttttattttattgaaatatactttacgctgattagatatagagaagtctttcttaataaaagaattccactctttgtatgccaactaatatagcataaatatgactattttcttggtacaaagcaaggatctacttgctgatataagatgaattcaaaatctatacacatcattttctctgaaatcaggtaacttcaaactctctttgttgcttctaaatctataagaagtttggaattaaataataagataatattaaagtgaaataatctacttaaattttaaatactttaattttcttcaatctggtctatggcacacacatgtcagaggactgatttaaaggtgaattgtcaaaactttggtctctgtgtccaatagggacaatctgtaacagaaagttatttatagaaacaatcaaaggtacgaagaactgctaaaggaaagctatctttgatccgaatctatctcttccctgtacagattggattttctattggttcaaagcatagagtgctaaccttgaattagtattctaacttcaaatgaccaatggttgtttccaatagtaggaaaatatggatagtctcaagtattgttttggataaaggtacaggttcgggcaatgttttaataacatgatgtatttttaaaaagattatgagtgtaggaaattaaggtttatcacaggatttatgtctactgcttgagcataatcaccagaagtctttctattcttaattaacaaaattgttccatattattttattgatttcttagttaaactcttgttttttgcatctcatagcttttgacttcaaaaattggtattaaattgagctatatcataaggaaaaataattgaagatacataaactgaactttaatgggtatatgaaaatatgatagagaagaatgaagtgacagaaaaaaagaaaaaaggaatacatttaggacttatttgaagttagtgtcaacatcaaacactgaagacatatttttacataaaatagtaaaattttaaaatagtaaagctttaaaacttgtatattaagtcacatacatattgtttctcatataattattgctaatctaaatatattatcctgttagctatagagatatattaaagcttattctgtcagaacgaagtataaacttaggagctgaatggacacagtggaagtatggtattgagaagaggaaatatataatgaataattaaaactttataaaattttatgtttgactaatatacaacttatgagaaaggaatggtggtagtatagagaagaagtagaaaaatggcaggagatgagatgtgacaagtatgcagggcccaaaaattaaaaaattaagtaaagtacaagaggagaagcaaaaaatataaagtaaaggaaaataataagatataaaagaaaagcatcacttagacaaagacaaggagaagcaggagaacataaatatataaggtaatggagaacaccaaaaagtatgtaatcaacagagtcaaatattacagagttttatctgttcagttcaataaataattaagaagtccataatatgtaccagtgactggaatatgtgaaatgcaaagcatttctgaatttggacattgggctcattggtagcttttatcagagcaatggcaacaaaatagaggtcagaaactaggtagtagtgagttaaagaataaatgtgagacgggaaagtggagacagcaattataaaatggtattttaaggattttggttttgaaggggaggagaaatgtagtacattagctaaacttgaacaaagggttgagtgaagggactgaaaattggaaaagcttccatatcaatttaagagtgtggttgataaggtaagaaagagggaaggaataaacaatggtttaaaatacaggggaaaatgaaagaattaaagctaacctgaatttgaaagcaacactttaccactgaagactaaactaaagacttaaatcagtatagatacagataatgttgaggagtgctggaaagaagtataggaaactcactactgctggtctcaattgttttgtgtgaatggagacttattatctgttgatgaagaggcaattgtttcaggtggcttgagaaaagagaggagactatggatcatttaccatgggaaatcaaatagtaaataaattgggggtatataaatggatttcaagcaatgctgaatgtttgccacagctttttagtccaaaataaaatatgactccaatagaagtggtcatatagtttttctacaatacttaaaatgcatagtattttatcttaaaacgaattttgcaaatggatccaatattgagatatagcagagttaatggaaaggagtgagaaggtgccttatagattaagatacactgggccaaaggatggcaaactataggctgcaggtaaaatacaacttgccccctttgtgtaaacaaagttttattgaaacacagccaagttcatttgtttatgtattgtttttcattacttttgtactataatggcagagttgagttgttgcagcagagacattttatctggccctttacggaaaaggttttccaaaccctctgctattttatcctattatagtaagaaaaatgtaatgcagtatctcaatgtttaagatattaagactgaagtttattttcattcatgttcactgtcaatgtagatcagaagggactttactcattgtattaattgtaagaatcaagtgacagaaacatcattttttttcatgtccttctttaatcgcggtatctttgggaaagagaacataaaaattcacacaatggcttttaaaacttctctctaaagtggaagatattacttccacttttattatagtctcctacgcaatcacatggccacagttacttcaaagaggaagggttgcgcagtcctatcaattgtccagaagaaagaaacactgaatatttgtaaacaatccttatgagaaccacagaaaccaaagaatagaaggaaagtgaaagtaagaattgaagttatatgtgatgagaacattgccagttatggaaaatcatgaagtatgggatgactttggagaagaagggattaagagcccaggaggtacaaatatgtcagatgagaatatagtgaagggaaaaataagtgatataccagaaaggatactatgatatgttcattttaatgccattttgtattatgctaaggacaaataaataacacccacttttaaatgtttatataaatgattaattttaacggatacttatttctgcattatccatatatcctttttcttttcagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtacctgtaagttccattcatatcttgacccatttcttaattctgaaatttcttttaaacacataaaaaatagggactcaataaaaccaaatatttgtcttattgtatatacaaagtaaggctgttggaagcattctttagttttcgaagttgccgaaactcatattttttgctactcaaaattaaatgtgtatgtgtgtttatgaatgtatgtttccctaattaataaattattccaatatctgaattaaaacactagataaaaataatgtcatctaacacatactatattagttatttattgcattgtaacaaaataccccaaaaacatatttacttaaaacaactaacctttattatcttacagtttctatcggtcagtaatctcaaaatggcttatataagtagttgtgaatcagactgtcttcttgtgttgcaatcaggatcatggcccaggctacagtgatcagaaggcttggctgggaaggaggatctgcttctaacattactgacacacatggctgttgtcaggaggcctcaggtccttaccacataggcctttccatgagttgataaatggcagctttctccagcactgctaatctgagaatagaggaagccacaataccatgtattagtgtgttctcacactactagaaagaactacctgagactggataatttatgaagaaaagaggttaaattgactcacagttccacagcctgtacaggaagcatggctgggaggccttaggaaacttacaatcatggtggaaggtgaaggggaggcaagcacatcttaccatggcagagcaggagagacagagagcaaaggggaaagtgctacacacttttaaacaaccaggtctcatgagaactcactcactatcatgaaaacagcaagggggagatccacctctatgatccaatcacctccctcaacattgggaattacaattcaacatgagatgtgtgtggggacacagagccaaaccatatcaattatctactcacacactgttaacttcagccatatctattctttcgaagtgagacactaagtccagcatatatccaaggggagagaaattaggcaccactatttggagggaggagtgttgaaggactccaagtcttagtcatttcctagtgttggaggtaatttccaaaaatcatcacatgtagcaaaataccactcaagtcaatagagtattttatttctgggatgctcctttacccctttttaatgttttttctatctctacaatcaaatttcttttctttctatctataagtacatagacaagaagtactacacttaaactatatattccatgaaagaaaaatatgatacaaatgattgattaatgacttcaactttaattcctggcataattccaatccctaagagaggaagctattatcagtatgaaacatttcagtgtgcataagaattatgaggaaaatatttaatgattttatggttggcttatgacaatgtagttcagcccaaatgtatctaaaccaactgagacccaactatatttggatttcaattattaatgtttgacaatgaaccatctggagttctcatggacaagatagaggagttgatgagttatatggtttatcagtttttaatttcattaaataaccatatctaattatcagacgcatgactttattctcaggcctgcttcattactcacttgtgtcattgaacagtttaatgatttaggggaagtgcagtacaaattcacaattggaatgatacagaggatgataataaggaatctgcattagggcagttcagcattcaaagagactcttatgtgctaagctgaatctaataagatgaaatttaacaatgttgactctaagatcctggacttgggtcaaataaattacagtatgaatatattagcagcagttataaaaattagtgaatatttttatcaattttaagatctgtttgagccaactttatgatggaaacaccataaatgctgtgaaaccaaaaactacatttgtagaagtgtaacaagtagaatgaagctatttgaagtccttctattctcagcgctgatgagactctctgtgggtactaatatttgcttcaaggaatcaatttgtaaaagggataaaaacagatgtaaatgtgaccaaattagagaatagctaaatagctcgagcctgtggtaatgttatatgtttttaattatgcctcctttttattccttttggaaagaaatctcggtggacaattttattttatgaccttctgggaaataccataataagatggatactcatacttgctttgaaatcaaccacaagctttgaaatctctactctaccatttaatgtgaaattcaattgaggcctttaaggcacagctcccacaaatccaagactcaagctttcccaatgcagaattattgttaaataatacatgtctcaacaaatcatgatgaaatttgtaaaatccaatggtaaatagaaaatattccaaatctttaaaaagtggtgaggaaaaatgtagaatgttacttaaaagaaataagactaagtaaatgttttaatttcaacactgggagcttcagataaatagggaaaaaaatctatcaattataagatatatggattgtaggccaagaaactatactgaaagaagtatcattcactagtctttattagagaaatacatttaagatatacaattattcagtttataatccacataataaatgtagaaactacatgaaaatttctctaatcaaatacaaaagaaaataaatcacagaatttaagaaagatggagatgtaaaagaatatttatatgtgtgtgtgtgtatgtgtgtattgaaattctttttaacctattgcataaggtttattgaaatagaaacatatttcatggaaaacattaataccattttgttattgaaagtactagataatctacaaataatcccatgaaaagagcaaattttctgaaaaatatataaacctgttaatataataaacaagatagcactcaaatgtatttgtcaaaattaatatataataactcagtaaaatgtaattatattgtaccttacttaaatatattttatgacatcaaaattatttttctctccaattaaaattagaaataaacaaaaaagttaatcaaaatcttaactatttggatatgaagaaatatttctagtctgtttctctggttaaatacagactggagaacttggcttaatgaattgtttgaggcatgaattaactatgttatttttctgcgcggtatcatcaaagaaaaatttttgtgtttctctatatttttacgttgtctgcaataaataggaaagagcctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaatagaaaaaaaagaaagaaagaaagaaagaaatacatgagctaagcggtaaaattggcatatttctcaaccgaaaagcttatttaattaaccagggatagggtatgtgtatttaagggaaatatattaaataggtctgtgcatttttctttctggagagccttcatacaaatttacgcatcatgtgatccacaagacataatttcatcttcattaacaaagaccttcttgttacatatctcagtcatctgagttctatcatttgttttgacctagaaaccctaatggaatgtgtaattatactaagaagagaatataattcagtgataaaaatttatctctaatatgagtgtttattacagtaaaatttctttatactttttttaaaatttttattgcaagtgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagtaagtaaacctctgaactgctatatatatgtataaaactttcaaagatcgaagaaaggagagcacataagtgattacacctgtcttatgtaacagaaatagggccaagaaaagagttgttcaagcaaagtgaccaaaatagatcttttctattatgagggtttcttcttgaaaatcacaggagaaataaatatagggactttatgagaatatctatataatttatacatctattaattataaaaactaaagataagtaatattgaatattgatatttctttttgtgcaaacctttgttagtaactttagttcgtcttcagttatacattatttttggatgtttatgcaatcttatttaaatattgtaaaaataattgtaatatactattttgagcaaatttatgtttctcatttactttatttatttatcattgttatggtccttaggaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaatttcttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggacgtggacacacacaaggagtgagtttaggagcacaggtttaataggcaaaagaaagagaaaggagaacagcttcctctcttgtgagagagagcggcacctgaaagtgaatccctgcccctggtggagtgcactggattttataaacggtcttgaggaagcagtgtctgatttacatagggcccaaagattggttaaactaggtgtgacatttacataatatgccaggaagctggccgccccaccctaatcttattaatcaaatgggatctttgcctggccagcgccatgttgctttctccttactgtacacgtggctggcaaagagaaaggaagatgcacctgccatatgaacatgcctagtcccaggtagccttttcctattggcacaactgctggcattcaccttgcaagcttccagcttgcttgtctatgtttgcagttcgattttacaggctcctcttgttagaaaagaaaatgatttgggggctgcctttcattaaaaggaaaaaccttatcaaggactgctgtaccctcattatctgcctaaacaattttttctcaactcctatatcaatattaatatgtacattggaatcaatcatttgactcaaaataattatacaattatagtttaaaatagaaagtaaatacgatgatacccaataattcatatattcaagcagtgatatgacatttttacagtaaagctatttgactttctctagtatatgtaagtacaaatgggtattctgagatcttgtgcatattctactctagaaggtttcctacagtatttattccaacatacatttatatcaacagttacttctttttttacatgttaatgattggtgatgtcacattttaatatttacaaattgaatggctataaaatgttataacattatagtgtaaatttgcatttcttttaccactaactgggtttagaatatatattcacagtttaattggtatttaatgcttctaatctttggaaatgcagtttgattttctttatttacctttttgagagttttggtattattagttggaatcatcttaacaattctgaatataaaatctcttttaattatacgtaatgcaaatgtattctctttgtggctagtatttttctttccttttttctgcattatgaacataagttgctcattctactacataatagtcaatcttttttcatgatgaatgtttcttgtttctatttaaaggaatacttcaaaaacatagagccactatactattctttattctaaaaagttataagttaccttttcttttcatattttaaaaatattttgtgttgattttattcatgataatggctgtatttcatgtttaaatgaaatatggtaaactcaacatttccctaacaatttttatagtacctttctcaaacagtatattttttattgtatattttgtacattgtgtgtgtatacacacacacaataactattactctgagtattctgcactattagtaaacaattttttaaccagcattgcagtaaccctctattgaattttatttatttattttattttgagatagaatctcactctgtcacccaggctggagtgcaatgtcgcgatctcgcctcgctgcaacctccactccctgaattttaattaatataggtttttaataagtatggatatgacttttcaccctaatcatgacctttcacccaaatctttttgcttcatcagtctcttttttgtctcatcattcagtgtcagatgatcccattacttttatttttttcttcacagattaattgaggctaataatatgccttgattagatatgcaatttctcctgatatcaaacaactcaatcaacgtttatgcctcttggtttgattttggagctgattgtagaatcaactacttattttttctctttctttccttccttccttcctttttctttctttctttttctttttctttctttcttctttctttctttttctttctttctttccttctcttccttctttctttttctttctttcattcttttttctttcttcctttctttgtctacgtttctccttctttttcttttttctctttctttctttctctttcccttcctttctttttctttctttctttctttctctttcccttcctttctttttctttctttctttctttctttctttctttctttctttctttctttctttctttctttctttctttctttctttctctttccttctttctttcttccttccctccctcccttccctccctccctctgtcacctccctccctccctccctccctcccttccttccttccttccttccttccttccttctttccttttgtcccaagtttgtctggctcaagttattcttaagaatgttactattttactcttcatgctagaccctgtactttagtcaggttatttagctactttacggttgtcatataattaacaagtcttagcttcatcttcagattgagatatcaacgttatattttcatgtacagtcaattgtcagtgaatcacattgtttttcaatttaataaaatctaaattcctcataaccatgttgtgagaatatgcagaaaaaattaaacatacttgagtgagtacagtagatatatattggagtgtatcctttatgaatgcaaactggctgtagtttcctttaaaatagtcatttaaataaaaaatttgccagataaatcacagaatatcaatttctcttgacttgtaaaacttgaattactagtgccatctgaatgattcttctgaagatagacagagtagtctctacttacctgtgagagaaaaaagctgcactagtccctcttattcatgtgggatatgttccaggctccccagtaaatgcccgaaatgattaatagtataaaacccaagtagactatgtttttccacctgataacttggaatactactaagtgactaacaggctggtgcatacactagacgaagggaggattcatgctctgggcgggatggagctgaatggcataggatttcatcaaagactactaagtgactaacaggcaggtagtataaactgtggatgcactagacaagaaagtattcaggctctggggagaatggggctgaatggcataggatttcatcacactacccagaacacctttttttattgctaagtattattccattatatcatgtatcacggtctgttaatccattcatgtgttgaagggcatttgcattgtttttggcatttgtgaatcatgctgttaagaaaaatattcatctgcagtttttatataaacacaaatttattcctcatggatacatatctaagactgggtttgttagataaatggtgtgtgtgtgtgtgtgtgtgtgtgtgtgtgtgtgttttattattattatactttaagttctgggatatatgtgcagaacgtgcaggtttgttacataagtatacgtgtgccatggtggtttgctgcacccatcaacccgtcatctaggttgtaagccttgcatgaattagctctttgtcctgatgctctctctcccctttccccgcacaccccaacaagccccggtgtgtgatgttcccctccctatgtccatgtgttctcattgatcaactctcacttatgagtgagaatatgtggtgttttgttttctgttcctgtgttagtttgctgaagatgatggtttccagcttcgtccatgtccctgcaaaggacacgaactcattcaatttatggctgcatagtattccatggtgtatatgtgccacattttctttatccagtctatcattgatgggcatttgggttggttccaaatctttgctactgcaaatggtgctgtgataaacatatgtgtgcatgtgcctttatagtagaatgatttatattcctttgggtatatacccagtaatgggattgctgggtcaaatggtatctctggttcttgatctttgaggagttgccacactgtcttccactatggttgaactaatttacactcccaccaacagagtaaaactttcctatttctccgcatcctcgccagcacctgtggtttccagatgttttaatgatcggcattctaactggcgtgaattggtttctcattgtggttttgatttgcatttctctaatgaccagtgacaataagcttgttttcatgtatttgctgactgcataaatgtcttcttttgagaagtgtctgttcatatccttcacctactttttgatggggttgtttgtttctttcttataaatttgtttaagttccttgtagattcttgatattagacctctgtcagatggatagattgcaaaaattttctcccattctgtagattgcctattcactctgatgatagtttcttttgctgtgcagaagctctttagtttaattagatcccatttgtcaattttggcctttgttgccattgcttttggtgttttagtcatgaagtctttgcccatgcctatgtcctgaataacctactgcctaggtttttttctatggtttttatggttttaggtcttacatttaagcctttaatacatcatgagttaatttttatattaggtgtaagggaagggtccagtttcagttttctgcatatggctagccaattttccctgcaccatttattcaatagggaatcttttccctattgcttgtttttgtcaggtttgttgaagatcaaatggttgtagatgtgtggtgttatttctgaggcctctgttctgctccattggcctatatatctgttctggtacaagtaccatgttgttttggttactgtagtcttgtagtatagtttgaaatcaggtagcgtgatgcatcagctttgtgctttttgattaggattgtcttggctagatgggacctttttttggtttcatatgaaatttaaagcagttttcttagttctgtgaagaaagataatgatagctagatgggaatagcattgtatgtatcaactactttgggcaatatggccattttcatgatattgattcttcctatccatgaggatggaatatttttctatttattttggccctctcttatttccctgagcagtggtttgtagttctccttgaagagttccttcgcatcccttgtaagttgtatttctacgtattttattttctttgtggcaattgtgaatgggagttcactcatgatttggctttctgtctattactgatgtataggaatgcttgtgatttttgcatattgattttgcatcctgagactttcctgaagttacttatcagcttaaggagtttctgggttgagacagtggggttttctaaatataccatcatgtcatctgcaaaaagagacaatttgacttcctctcttcctatttgaatactccttatttctttctcttgcctgattgtctggtccaaaactcccaatactatgtccatcctagacagatcaacgagacagaaaattaacaaagatattcccaatttgaactcaactctggaccaactggacctaatagacatctacagaactctccaccagaagtcaagtgttcttcttggcactacatagcacttattctaagatcgaccatataattggaagtaaaacactccccagcaaacgcaaaagaacaaaaaccacaacaaacagtctctcagaccacagtgaaatcaaattagaaatcaggattaagaaactcattcaaaactacacaactacatggaaactgaacaacctgctactgaatgactactgagtaaatattgaaagtaaggcagaagtaaataagttccttgaaaccaatgagaagacagacacaatgtaccagaatatctgggacacagttaaagcagtctttagaggaaaatttatcgcactaaatgcccacatcagaaagtgggaaagatctaaacttgacaccctaacacctcaattaaaagaaatagagcttgatggggatggcattgaatctataaattacctttggcagcatgccatccccatcaagctaccaatgactttctttacagaattggaaaaaactactttaaagtttatatggaaccaagaaagagcccgcattgccaagtcaatcctaagacaaaagaacaaagctggaggcatcatgctacctgacttcaaactatactacaagcccacagtaaccaaaatagcatggtactggtaccaaaacagagatgcagaccaatggaacagaacagagccttcagaaataatgctacatatccacaaccatctgatctttgacaaacctgagaaaaacaagaaatgggaaaaggattccttatttaataaatggtgctgggaaaacaggctagccatatgtagaaagctgaaactggatcccttcgttacaccttatactaaaattaattcaagatggattaaagacttaaatgttagatctaaaaccataaaaaccctagaagaaaacctaggcaataccattcaggacataggcatgggcaaggacttcatgtctaaaataccaaaagcaatggcaacacaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcagcatcactggtcattagagaaatgcaaatcaaaaccacaatgagataccatctcacaccagttagaatggcgatcattaaaaagtcaggaaacaacaggtgccggagaggatgtggagaaataggaacacttttacactgttggtggaactgtaaactagttcaaccattgtggaagtcattgtctagatcctcagggatctataactagaaataccatttgacctagccatcccattactgggtatatacacaaaggattataaatcatgctgctataaagacacatgtacacgtatgtttattgcggcactattcacaatagcaaagacttggaaccaacccaaatgtccaacaatgatagactggattaagaaaatgtggcacatatacaccatagaatactatgcagccataaaaaagaagagttcatgtcctttgtagggacatggatgaagctggaaaccatcattctcagcaaactatggcaatgacaaaaaaccaagcatcgcatgctctcactcataggtgggaattgaacaatgagaacacatggacacaggaaggggaacatcacacaccggggcctgttgtggggtggggggaggggggagggatagcattaggagatatacctaatgttaaatgaagagttaatgggtgcagcacaccaccatggcacatgtatacatatgtaactaacctgcacgtagtgcacatgtaccctaaaacttaaagtataataataataaaaaaagaattagagaagcaagagcaaacaaattcaaaagctagcagaagacaagaaataactaagatcagagcagacctggagatagagacatgaaaacccttcaaaaaatcaatgcacccaggagctggtttttagaaaagattaacaaagtacactactagccatactaataaagaagaaaggacagaagaatcaaatagacacaataaaaatgataaagagggtatcaccactgatcccagagaaatacaaactaccatcagagaatactataaacacctctacacaaataaagtagaaaatctggaagaaatggataaattcctggacacatacacgctcccaacactaaagcagaagaaagaagtcaaaaccctgaataggccaaacacaagttctgaaattgtggtagtaattaatagcctgccaaccaaaaatagcccaggaccagatggatttacagccaaattctaccagaggtactaagaggagttggtaccattcctttggaaactatttcaaacaatagaaaaagaaggtctcctccttaactcattttatggagccagcatcatcctgataccaaaacctggcagagacacaacagaaaaagaaaatttcagtctaatatccctgatgaacatcaatgcgaaaatcctcaataaaatactggcaaagcaaatccagcagcatatctaaaagcttattcaccatgagcaagtcgccattatctctgtgatgcaaggctgtttcaacatatacaaatcaataaatgtaatgacaaaaaacacataattaactcaatagatgcagaaaaggccttcaataaaattcaacaccccttcatggtaaaaacactcaataaactaggtattgatggaacatatctcaaaattataagagctattttttaaaaacccatagcaaatatcatactaaatatgtgttcatttttataagaaatagacaaactgttttcctgagcgatcatacattgtaccttcacatactcagtgtatgtgagatccagttgtttcgcaaccttgccagcctttgagataatgtgtttttttttccattaaattatccattctaatatgtgtgtgatggtattgcattccctagtgactaatgctgcttagcatcttctttgtacttatttaccatctatgtacctcctttggtgaacactgtctaaattttgcccactttccattgagttgtttcttccattacggaattttgagactacatgatatattgtggctacaagcccttcactgagtaaatattttgcaaatatttttcttgcatctgtagctttacttttctctctaatagtctcttttcatgagcaaaagtatgtaattttgatgttatcacatttttcatttatagattacgctctttgtgtcatctaaaatttccttgcctaaaccaaggccatatacagttctagaagttaacattttacacttagttatatgagttaatttttgtatgaggtatgaggaatatgtagagggttattattttgcatttggatgcgttactgttccagtatcacttgtttaaaagactatgttttctttattgaattgcctttgctccttttttaaattgaaaacatcctcaaaaaatttttaaaaacagttaaggaggaaaaagtaaaattcaactaggcttgtaggacaatcaatggtaatcattaggctagctttccattgacccacttccttatagctggtcactgattactagtccaggataacataatctttgtcactagaatctttgttctttttctgttctttagttaaaatttaagacaatatgagatgacaaactttccatttgagtttctcctttaggttctgcatactaacaaaactactgatgccagccattctgaaaggcttgacaagaaactcaacttagggaagaatgtactttccatatcctgatgatttcagcccccttacccgaatcaattgatgacctcaattttccagccactcccccttcaaagattcttgcccagaaagcttcagtgaaatgggtttgagtcttgagaattcttctcatgtccttgtttggtgaccttgcaattggtaaactctctgttgcaaactccactgtcttggtatattctgttgctgcacagcaggcatacaaaccttacaatcttataaaaattcatggcaagcacccagacatgatggctcacacctgtaatcccagcactttaggaggcaaaggagggcagattacttgaggtcaggagctcgagaccaggctggccaacatggtgaaaccctgtctctactagaaatacaaaagttgcccaggcatggtggcacatgcctgtaatcccagttacttgggaggctgaggctggagaatcacttgaacctgggaggcagaggttgcagtgagccaagatcgtgccactgcactccatcctgggagacagattgagattccgtctcaaaaaaaaaaaaaaagaaaagaaaaaaaaattcatggcaagccactctccttgcagtcatttacctacagtccagtgcccccatgccactggggctgacccagagagaagctcaagaagctgcttagttatgatgaactaagggccttagctggggccttctgtgttggcagggcagtgctgactttcagcacacaaccttgtctgcagcagagaaaccatttctggtctcagaagaagtctcaggtgagttttctcagagcagctggcaccccatttccttctgtgtgtgtgtgcctgttttcgtcttagaggtcttgtggcctctttgaggtcttgttgacactccctaagtctaggtaggaacttatttgaggagatctcccttcagatggaaaaagactagagggcattgcttgggagaaatggtcttggattttggaatctgaaactttatatggaaaggtcttttgtttgtctttgtcttgttatatgtatttatgtttgtggaggggatccctgaagaaattactagtggaagaaattactaactcagggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaaaccccactgtctcagtgtattgttctgttgctgtgcagcaggcatacaaatctgacaatctcgtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaggaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaaaaagtcacaaatccggggcaacaggtatgatctctacttcttataacccaacaggggactccatttaggcagggtgtcacttcttatacccaacagggaactccatttagccggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaaacatccaaagcatatgaagaatctattctcctctgtatttgccacacagaaccctacctgagcaggcacccccaatttgctcaatattttgttgacttcagagaaacaaagaatggttttagaaaaagctaaggaaaaggctgatcttattcacactgactctcccagtaatccagtaagggcagctgctcagattgcagttcccacctctgacctgggatggaatataaacactggagatagatctaaccttgaacactatcaaaactgcattttgatcagcctctgcaagggagtgcccaagcaaaggagtctcagtaaggtccaggatggtcaagcagaagcctaatgagggttgctttggaattcttagaacaagtctttgaagctttcagagaataaatggatattgacccagaagccccagaaaatttgatgatagctaacatgatgtttatccaacaaagtgccccagatattcagagaaagttacaaaacgtagctgaggcattggacatgtttttgtctcaattagtgaagattgtttttaatgtatttactgatcacaagtttaaagagtggaaaataaaacacaaggaataatgaaaatggcaagctgacttgttatctgtggctctgaccctagtagtccctggaccacaacaagggccgtcatcagacactccatctatggtagaaccacctgggcccccaaaggccaataaaaacggacatcccattgcaggtcccaaccagtgtgcttactgcaacaggggggacactgagtggaaaatttctcatgccctacaaagcctgatgttaaacagtcagccttctgcccaccaaatgcctgggatagctggggagcttgagagagatactaaagaaaaagaccagaaatggtagcacccaggggcttctcctgacccagacaacaccctccatatttcccacatggggcttgagatcctgatgatggtgagaaatcagcttctggactttctagtagacatggtgccatctatttggtgttaaatatctggtggtctaaactttcctcagaaataatgaaggtgactgaaatctcagaaaaaatgctgatgagatcattcctccaaattttggattgtcagctagagtaagatcatttaaagcacagttttttgctgggcgcggtggctcactcctgtaatgccagcaccttgggaggctgagatgggcagatcacaaggtcaggagatcgagaccatcctggctaacacagtgaaaccccgtctctgctaaaaatacaaaaaattagtcgggcatggtggtgggcacctgtagtcccagctactcgggaggctgaggcagaagaacggcgtgaatcggggaggcagagcttgcaagtgagccaagatcatgccactgcactccagcctgggggacagagcaagactctgtcaaaaaaaaaaaaaaaaaaaaaaagacagagtttttctatacatccttgaatgtcctatccctttgttggggaaagtcttccttttttgttgttgttttgttttgttttgttttgagacagagtcttgccctatcgcccaggctggactgtggtggcacgattgtggctcactgcaacctctggctcactgaaacctccacctcacgagctaaagcaattttcctgtctcagcctcccgagtagctgggattacaggcgtgtgccaccacagccagctaatttttatatttttagtagagacagggtttcaccatgtttgcctggctcgtcttaaactcctgacatgaggtaatctgccctccttggcctcccaaagtgctgggagctgggattacaggtgtgagccactgctcccgtcctgttagggcagtactcttaaccaaactaaatgctaagattactttttctctgagatgattggacatccaggtgccttcagaccaagcatgtgctctgcaggccatattattacaactggagatccttgaaagtgcctgcacccctgaagagatactccaaaaggttagtccggaaacatgggcagatgggaggccagggaaaacaaaaactgcatctccagtacaagtcaagttttgtgcaggagtggcgctgccaaatctaaagcagcgccctttgagagaaaaggcacagcaatgcatttagcctctgctaatggccttcctgcaatacaggaagaattccttgtttctcatgtaacatacctgtcttgccaggacaaaaacatggaactgaggattattggtttgtacaggatttgagggctactaggcaaattttcaaagccatttatctggtgataactgatgcttatacattattcatgactttaaccagtgagttgtactggtgttcagtcttgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgacggcatattagaagccagcacaactatggcaaattgaccagaatattatactggctttacattttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgagccactggcaccacttgtgatcttctccaggaggcagaagagttcactttgggttaacctagcactgtacacaccccatactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatataaattactgagcaagtgtgttctattcaaccagacatgaccaaaattccctttaaaaacctggacttaaaaatattcactgaggaaagcagctttatgcaccacggacaacagaaggctgagtatgctattgtaaccctgtgacagatcctagatgcagagacactccctctgggttcatcggcacagaaggcagaacttagagtcctaatcagggcatcccaactaggtaaagactcctgagtcaccgattactctgattccaggtatgtttttattgttgtccatgctcatggggccgtttggaaagaaagcgggctcttaacctttgatgattaaaaaagaaaaacaattaagcatgctaaagaaatcttagcctgactaaaggcagtcttggtacccaagaaagtagctataatacactaccatggacatcagtggatggacaatttggtagcaagaaaaaaaaaatcactaggcagagcaggccactaaagaggtgaacagagaaaaaaatgcccaaagccttcctaatgccattaatccctgaaataaacttcagcctaaaatccctacctaatggaagaagatgtaaagagagaattcgattgagactttgactccaatcaaagaactcaaaatgagtggatatgtgacacggaagaaaaggttctggtgcccaagtatcttgtgacagatatcatcaaacacatacatgataccacacagtatggcaggcatgccacccttcaattgatccaggactatgtctttgggacacacttaaagaagactatccaaaaaataatttaaaaatacctacttggtgcccagaacaatcttaagactggtcctccacccccagtaccaaggattcaagcaagaggtgcagggctattagaggactggcaaattgattttaccgtgatgccaagggtagcaggaaattttaaatacttgcttgtatttttagatacattttcaagataaacaaaatcattccgctgcaagaccaagagaatgtctgagctaatgagagccttggtagagaagattaccctcaggtttaggtggcctgtctccatccagtgtgaccatagtgcaatttctgtagcctaggacaccatatattccaggccctcagcataatctggaatcttcatacagcctgcagactgaagtctactgaaaaaactcaaaagataaatcatactatataaaacaaaacaaattttagctaagatttgccaagaaactaacaacctggaataacattctgtccattgccctgctcagagtaagggtggtccctaaaagtgggcttaaattaagccctttaaaaattttacatgggagatcattcttccgttaccttctcagactaaggaatgccaataacatacacataaataaattagatattatcaaacatacacaatctttaggttgtactttaactactattcacgagtttgtggttccagcagattgtggtatccaactgacattctctttcatcccatccaacccagagactgggttctgctcaagaccaggaaaagtcgacatcctggggaccacttaaaacacagtgaaagaggccatgcaaagcatgactggtgacccattcctctgttcagcttgaaggacttagaccctggattcaccacagccatataaaacccgccccgccagattcttgtcctatcaagaaatgtagagaggccacttcaacttcagagactgtctcaaccctatctgaatggataagtaaatctttgatgggcctcaaatatcttttgaggaaaaatatcagataagtaactttaatgaaattagacaaaacatatgtcttcttgacaactacaatagttactttgagcataacaggaatgtttgttattataattattttatataaaaaggtgagataccttcctgtctattccctgccttactgaatgcttaagccatatatttacttggtcattataattgcctagataattacaattgctacccttatagacattacttcataattgccttggtcaatacaattgttagacttatagattttctagacattctatgccatgctaacatagtctcatgccactcattatgtggacattctaaaatttagaaatggtcactcttgttttaaaacttctaattatacctctcctgttactacagtgcctagacaggcatagcaacactgtagttcaactgtttcaaggtattgccactggaagaaacttaccagaatgatggatctgtcagtaactcccccaaactattcaaaataagcattttctgttagtcatacttgtcactgactttctggatgttccaaatatgactacctatctgcaccagcttctttccatggctactttccaggtccaagtaatagtacaccaagaaatcaccaccccatgtgtcaatctctctctgcctatcataaatggaaagtcattccattacataggccctccatggcccatggcatactgggcagacaaacgcagctaggagaagggaaataaaactaaaagtttctccttactatgccaaaaatatttacagtggggaatatcacacaaattctggggagcctgtaaaaaaagatccctagttcaattccatttgtctatattccccatgaaaaaatccatcaataaatgcacccttgagggctttacctgtgtgcccccttggtacatgtttatttgtggcataggatcagaccctcctctgttagggcaagcccactggtgtctcaataacctgtatattaagggctctcacttactgagatacttctcagtccatcctaatgacaaaatattctgcccattttcccaccgactccaaaagggactgccaggcatatatcaatatatctggtggcagagccttctaggcatcacgagtcctagctatggagtatacactcactgggacatgatcagaaacttattggcaaccacagaaataattgcaaaagaggctgctaagaacattgaggctgagaaaactcttcaaatttacttgcccagatagttcttgacaacggaactacacttgattttctcttggctttacagagaggagtctgtacagtgatcaataccacctgttgtacttatatcaatgcttctggtaaaataaaaaccaaactaaagaaaatatttcagcagtctcgctggagaccatatgtctctaccacagaccctatgtctgaatagttttttgagctttccgcctgcatactccatgttttccagtccatttttcaaggactcttgaagttcaagctcacaattctgtttatagggattataatttacatgattcaattaaatattacaataaaaccatagactgaagtactaacatgttcatccagcaccctaagctgggtataacagcttgcaggttgttacaagacggtttcattcctctaatcctgactctctctctgtgccccgtgtcagcaaaaagaagctagaatggccattgcccgattcataccatattagcttttacacctcagaattgagaagggatcaagcccggaaggaactgaaactgtccctaggaaagttatataaaattgattaagggggaaaaattcaactatgatttcaggaaaatcagcagtaatcactaaatcagctttccatttgtccaacttctctgtagctggtcattgattactaccctaggataaagaagcccttgtcacaagacattttggtccttttcctttctatagataaaatctaagacattgtgagatgataatctttctgcatgagtttctcctttaggttctgcatatgaaaaaaaaacctagcaacatactggtcaacaaggcaaaacctcattttcacaaaaaattaaaaaattagccgggcattatggcacaggtctgtagtaccagctgctcaggagatctgaggtgggaggaccacttgagcctgggaggcagaagttgcagtgagctgtgatcacgctactgaaatccagatgggcaacagagcaagatcatcttgctcaaaaacaaaacacacacacacacacaaacatacacacacagacacacagacacacacatcagctggtctaaagagcccagcaaaaagctgactcaggaaataatgcaggttccacatcctggtgacttcatcccccttaccctgaccaattgacaacccaaattttctagcccgtcaccctccatgatccccttaaggtctcttgcacatagccccttctcagaacagatctggggcttgagaatcctcccaattccttgtttggtgcccttgtgttgattaaagcctttctttgctgcaaaccctactgtctcagcgtattggtctattgctaaacagtgggcatgtgaacctgatagtcttataacaaaatagaatagaagctatttataggatcgatccatgcatgtgagtctatttctggacaccgttttctcttctattcttccacgtgtttgtcctttaaccagtatcatgagatcctttactcactgtagctttttttaagtcttaaaatttggtaatgtgagtttttcaacttctcttatcttttgaagaattgtttagctgttttagcccctttacctttccatatgactttagaatcagcatgttcgtatgtgcaaaacattgtgcttggttattcactagaactgggacacattcacagatgaatctggggagaactgatatgtaatagtattaaatttttcaatccatgaatattatatatcctttgatttagtaagatcatacagtcttaccctagttttttttattttaagcatacagatcctgtattttactagatttataactaaatattttgtatttcatccatcaacgaaaaattcaatttgtttaatagacagaatttattaatgctacctaatccttcttgagagagccatgatagtttgtggcttcagtaattttttaattcattcaagttcttgaatttattgacatggcattattcagaatattttttatttttcttttaatatatgtaaaaaccataatgatgtcatttctgtcattgctgttataagcaatttgtgttattttttctgatttagtctgtctaaaggtttctcaattatagagatctaaaataacaagcttttggtttccttgtttatatacatatttacttctttattatttcatctctgatctttattgtagtatttcttctgcttactttgagattaattttttctacttttactaatatctaatggtagaggctaaggttattgaagtggaacaccgtcattttctatcccaggtatttagtgacaccaatttatttcatactgctctagtgccattccacaacttttgatatatagtatatcaatcagtgtttggctggagtagggtgagtattccataaaagatttactgtgatttttggagggaggtgtgaagagggtattattaccaaaatgtggatttttttttaactccattctgtattttggctaagagaagcagctttggaacttctcaagtctgtacatctgtgagaccccaaggattacttgttttaatttttttttaagtttaggtttgttttgggtcaacttagttctttcaaggcttatttttaagcttttaaaaagcttaaaaaaccccagagatagtttgttcagaatattaagctgcttctgatgtctctactacgtgacctagatgttcaaacgagtctttctactctgattgattccatttaaatgtctccctgtgttgtgtgtgtgctctgggaatcctttacctttttgttctctggtagtgttcttcatctgataggtatcctttgtccattcttggggagttttgctctactctccagagtgtcaatattcagccaaataatctagggagttgctgtggaaatttgtagagccctttcactccatagtttcttcttttctcactctgtttcctgcagattctagtgaactcatcttctttgggaacactgagttttgtttcttctactcagcaagtgtggcactttctgctgaattctccttctccatgctgctgtttggaaaatttctcccagcataaagtcactttgatgatggaactcatctcattgtcactttttctctggaattaggtgcttcctgctttccaatgtctgaaaatgttattttcatctattttgttccatttccttatttgtggcaagaactctgttttacttgattattcttgcctggtcttttacctttttaaattgtctgtactgattgttttctatttggtttcttctcatatttggatttgtttcaaaatttatactcatgctggattttgtctggtttctttgttataatttattataaataataatttattttcagtttttattcttttcttttatagctatataatgataaatttccctctgaggattgttcgagtgtcatctcaccaagtttaatttaatatgtttttattatcattcaattcaaaatatttaatgtttcctcttctgattttctccttatccatgagttatttaaaaatgaagctgagttctgggaagcaacctagtaaacgacagtaatttctttttttgggttattattattattattattattatactttaagttttagggtacatgtgcacaatgtgcaggttagttacatatgtatacatgtgccatgctggtgtgctgcacccattaactcgtcatttagcattacgtatatctcctaatgctatccctcccccctccccccaccccacagcagtccccacagtgtgatgttccccttcctgtgtccacgtgttctcattgttcagttcccatctatgagtgagaacatgtggtgtttggttttttgtccttgcgatagtttactgagaatgatgatttccaatttcatccatgtccctacaaaggacatgaactcctcattttttatggctgcatagtattccatggtgtatatgtgccacattttcttaatccagtctatcattgttgaacatttgggttggttccaagtctttgctattgtgaataatgccgcaataaacatacatgtgcatgtaaccgacagtaatttctatcatcagttaacagaaacagtaacttccactctttcaagttaagttctacataatttgaggaatcatcattttggcctttcaagataaataaatctgttactgttcctcgtcttctttgaactccacatgtccatttactttgaagcacacaataagaatgacatttcaaattcttggagccaaaggctatgaaaattattttggcagattttctaagatcatcacaggatctcagatactccaattggctaaatgagatttggaattgccagaagatctacaataggcaagattaaaaagtcctaagaaataatactcattgtctattgagttctgacatgctgtagaattccaaatccattagacaaacagatttccaataatttcttagaaataattgtaagtgtcttaaatagagccttgttttaaaaagtgatgaagagtcttgatgtaatgtctttggcaactctgagcttattttccttgacttaagtatttgaatgcttatggttatccaggttttcagttacaaatgactcattattttttatatttacatattacttaaattcttataaaatgttattgatcatatgcttgtctttttcttattctcttcccttttagaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattagtaagtaatttattatgtttgtattgattatccagatgatacacaaaagtttactaactttagtctttttgtgggggctgatataatttcatttgaaaagataagaaaaaaaaacctgcaggaacaaagcagacatcaattttttttccttttcacattaattactcagatattagtctgtctttccattcaggcttttcctactctaaagcattctgtgttacagaaacaagttagggagctttatgtgtattctggtttaaactgattttgctttagctgagacctttatgactgttaatatatatctgttttataagattagacttttacatcaaattctttactcctagatacaaaagcaatgtttttattgaagatatggatgcctagtgcataacatcaaaataatttaaactctataatttgtagatttgacactgtaggatatgtctaatactgaatatcttccctcttagaaatttttcataaatatttaggtagtagagagacaaaatattcctagatggtaccaatttctgctctgttgtatgatttccctaccacactatctagatatttatgaagatttccctaccacactatctagatatttatgaaaattttctgggaacaattggttcaatttgtcttattttttgcaaaaccactcagtaatatgtgtgtgtgtgtgtgtgtgtgtgtatacgtatatatgtatatatatatatatatatatatatatatatatagagagagagagagagagagagagagagagagagagagagagagagagagatggagtcttgctctgtcgtcggccaggctggagtgcagtggcatgatcttggctcactgcaacctccattttccgttttcaagcaattctcctacctcagcctcctgaatagctgggattacaggcaccctccatcatgcctgcctaattttcgtatttttaatagagacagggttttgccatgttagccaggctggtctcgaactcttaatctcaaatgatcctcctgcctctcagtaatatatttgaagtaatatttaatatactcatgttaagtgaagtgaataaggtattcatgtatactgttttcattttttaatgtctgtgcttaatatgaggtctagtttacaaaaaatgttagtcctcataaaaaagctaattttatactaaatttttattaattattcttttaagattttcttattattaaagagaaaatgtcttgtataacataggaatttatattttcagtctttttctcctttttacatatgtctcaactacgaattagtttggactcttaatttacaaaattctgttatgattttctttaaaaaataatgtatacctgtaatggcctgttttattactagcattgtcataaatgctttagtataaatgaattaagaaaaatgtttttaaaatatattttggggcttaagcaatgaaaaaaaatgttgtgtagaaagatatactttcacttttgacaactattttacgacaacaaattctcaccagtcatagattatttttgtacggtacctatttattagtagatctaatcaataaagctttttcttcttagaatgggaaatactcagattgtttattagatgacattagaaatgacattctaaattttttatgcactagaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatggtaagtactggtttttcagaaattcattttcaaaatgaaaataaatctgttttccaattttaaaaatttgaattatatagaggaattgttaaggaatgttgattaaaatcaagatatctcctgatttgacataaactgggaaaagaagggagttttgaaaatatctctaaagtagtgcattaaattaatacttcctatgggccacctaccttccagatttgtgattataatataattgcttttgttaccctaaataaaagctttcaaattatttagaacctagcacttattaccaaaattatagttggttacaacttcctcagctaatttgtttttttaatttctactttacatcttctatcttgtgtgttaatttctgtactttctgagtgtagttctttattttctaaatttgaaaagttctgaagaccattacatgaatctcatttacgtttctcaatcagccatctatttttcagggttagaagaaggattggctctgtgggaaaacaagtatatgcagagtgttccaaggcaaagaaaaatatgtgcaaagctgtaaaaacaaaacaatatatttcaaggtggtaaagcagagtctatcctgctgaggctagatgggaggcaaggaaacaattatccagatcagctcaaggcatcatatcatttggattcattttatgactaatgaaaacccataaaagagttttaagaaaaggaatggtataatttgatttctagttttgttggattgttttcctggatgctgtactttttgtaggcaagaggcgacaccatgagtccaggtagggtgagaaagtgtggggactgagagagagtgatgataggggaggtgcagagcagaaggctgatttggaaaacatttaggtgatgaaaagtacaggtgatgttactaaatgttgggtgtgaaaaagagtgagattaagggactcacatgtttgttttcaattgttttctcacaagtatgtaggtaaatggcaataaccattttgtaaaatggtactgactggatagaatgcattttgagagggctttgcaacttttgacttggacacattatgattgagtcgccaatggaaaatcaaaactggatatgtgaagtgtggagttggatatgcatctagagaggagatatgcatttcggaatatcatcatataaatgatgacgctaaattggataagaatacagaatgaaaagagcaaagagctcaagatgaagccctgaaacattaccacatttatatataagacagaagagcaatagatagtaaagaaaatggggaaaaaaggaggacccagagaaacaggagaaaaaatctagaatgttgccatagacataaaaataaggaaattattaatgaaaaggtagtgtaacagattgcttaataagtcatcctgtctgaattctaattccactgcttgctgggcatgtatctttggccaacacagcaagtctatttgaagctttgttgactctttcttgttggtaaaatgtcacatatttacaaacagttctaatatttcaaaggattgtgttagttagcagactaaaatatttataaatatttattgccatagtgccttatataataaagtcaaagaagttgtaatttaattaccttaatatcattatcaaagtgataaatatttctaatttagttattatattctgttcagaaattgtgatggattaggtaaggtacaggccaatgacaagtgtaacaaaaatggattttaatagagtagaagagacagaccctacatagaatctgccaataaaaataatgagctagacattcaatacagactgtagacataactctttcaagattctggctttgaatctaataggaagatcagaatattgcttgaggaaagttgtgcactgaagggataattaaaagaaaaaagatggaagacaccagagcagatacagcaaaaggggagctgcaaaggctgaacacatgacttacatagttgccctgagaaaatgcgaggggaaaggactcacagctactgtggaggtattgtgctttggtggcaacaggactgcttacaaccttgtgacaggtggcaacaggactgcttacaactttgtgacaggagatgggaaggaaaatgagcagtaacgttggaaaatggtagaagctgatggattctgttttgaagtatgagacatggtcatctgagattgaatagtgtgtgggcgaaggaggaggaagagtactaggtagaatagaaaagttttgaaatagtcacagctgagaaagagaatgagtacattgtagatgaaaggcagtgtcaaaggtccagttaaatttgactcattcctgctgttgtaaacacctatcataggacaggagaaaatggtgaaaacacaagcacaggtctacttatccagagattttattctaatataagacagtggaaaactaaaaagagataagccaaatatccaagtaataaaaatatttaaaatatattttatgtatcactgtgtacagagaaatagaaaatccaataattgagatagaaaataggagggaaggaactggagatctgttttacataggaagtcatcgatgcaaagaatggttgaaagccatttgttatagtgagaagggtatgtgcaacagctgaggcagcgaagaacttgacctttttaataaaattcaaagatcataaaatctgaatcctggatttagtggaggagagagacatttgataacattggaagagtaggcatggatcataaagaggttgagttttgctctaattgagagggggaggcttaatttaagagactcataaatttcttttctgtgatgataggtaaatttaggttttatgaagccagaagcttttacaattttgaggggtcttcttcaaaaaagaacacaaaattgtgaatatattgcttcagtagtctttccaatcaccagacatgaaatgaaaacctaaaggagagaaagttggagtggcggacatagcagtagaagctgatgtagaaaatgtctttctattgcaaattgtacaaagacttaggatcatttgaacacataactaggaatttgctagtatagtacaggcctccaaacattaaacgaagaaataccagcttagtattcttttcaaatattcttctctcagccatgtaacagaaaactgcatgtggattgacagacatctgagtatatttcaagtgtcctaggaggtctcttctttgtggaaaggtttccacagaattgttattatggagcacttaagctaaataaggagtatgtatctcagagttaaaaattcatattaacatttcacatatctagtactaggacttagggttttgagttttagatgaagaaaaatatttctaattcatggagtgtccattcacattcttctctaaatcacgttttgtaagttattacctctatataaatacagcatttgaataatacccaataatcaagatcttaactttcctttttaagataatgcttttcacaatattacaacagacagaatttatataaaattagcacaaaatacgtgaacaaacacacatacaaaaaaaagaattgctatgtagaagattggtatagacttttaggagagaaatcccagtgattctcattcaagtgtgattttctcaaataatctgcaaaactcattaaaacaaacacaaaagcaaatttttgtagttattattttgtgacattacttttaagaatagttttaaatctaattttgtaattgtattttaataattgaggttatgatgtaattaattttctttttagtatgattctaatttatgaattctagcttgtacttttctaagttagcaagaaaggaggattctgaataagaaaaataatattttggataatatttagtaatgttgctgatttttaaaaattataaacatgtaagagataattttacacatttcttatctgaatcagaataattatcaaatttattaaacattgatataaatagtacatataacaaaaattgttatatgttaacataaatattcaggatacctagaatttgcctttccatgtgaacttgaaaatttatcttggtttgttttctttatttgtaatatattaattatgtgttttttatattttttttaacttaaaatatattagaaatgctattttgggttctttttccttgattacattaaacaaaaataccaattttaattaatttcttagtgcatatatcttcactaataaatctttgatgagaatttacctttttgtgatgtatatgtcagtcatcaagaattataaacatgatgagaccagaaatcatttgaggttgtttagtttcagttaaataaagttatcattgactctgcaatgacagatattataccatcattattctcgggatcctccccagttctattataaatttaacttcttaagatatttccatggtgttttatgatgtgttcttttatttttaaaattttaatttctatgttttatatgtttagatggtccaaatgcagttttgttgcatggatatattgcatagtggtgaagtctgtacttttagtgtattcatcacccaaatactgaacattgcacccattaggtaatttcttattcctcaccctcctgctatcctgccacatttctgagtctccaatgtctgttactcagcactctctgtccatatgtacgcattatttagctctcacttataagtgacaatatgtgggattttactttctgaatctgaattattttacctaaaataatggcctttagttttatacatgttgcttctgaaggcatgattttattctttttttttctttttattttttgttttggctgagtagtattctatggcatatatctataccacatattctttatccaatcatctgttggtggacaattagtttgattccatattattgctactgtgagtagtgaggctataaacatatgagtctgggtatcattttgatatgataattgatttcctttgggtagatacacagtagtgggattgctgggtgaaatggtagttctgtttttagttctttgggaaatgtccattctgttttccatagaggttgtactaatttacattcccaccaacagcgtataagcattcttctttctcctcactgtcaccaacatttattattttttgactatttgacagtggccactgtgtctaatgtaagatgataactcatttttttaattcgcatttctctgatgattactgatattgagtttttatttcatatttcttggtcattttcatgtcttcttttgcaaaatatctcttcatatcctttgtccactttttcatgggattattatttttttttcttgttgtgttgtttcagttctttgcagattctggatattagccctttttcagattcatagtttgcaaatattttcttccattctgaggttgtctgtttactctgtttattatttcctttgctgtgaagaaaatttttagtttaattcacaatcacccagaagcaggtcatttaattttcatgtatatggatagttttgaaaattctttatgatattgatttatagttatatttcaccaagttctgataagatacttgatattatttctaacctttaaaattttgggaacttgctttgtagctgtagcctagcatatggtctattttggagaatgttccatgcacaggtgagaaaaacatatattctgaggttgttgggtggaatgtcgttaaaatgtctgttaggtccatttgttctacagtccaatttaagtatgaggtttctttgtttatttttttgtccctgcaatctgtctagtatagtcattgggggtgtggaggttgcttgccctcattatattgctgtttatctttctacttagctctagtagcatttcatttatgaatctgagtgctgaggttttgagtgcatatatatttagaattgttatatcttcttgcttcctttatcattgtgtaatgaacttcttgtcttttttttcttgttgatttgaaatctttttttatatataaatataactataccaaatgctttttgtttctgttgttcaaaatatctgtctccatacctttaccatgagtttgtataggtttctctaagttaggtgggtttcttttgagcagcatgtggttggtttctgttttccatatttggtccacaaatctatatcttttaagtggaacatttaatctatttatgttaaaagttaatattgtcatgtgaggttttgttcttgtcattatgttagttgttacctagctggtttgtagtcccaactgtgtaattttttaataagacctgtgagttttgtacttttgcatgtctttatgatagtgagtattgaccatctatttccatgttcaggactccctggatcatttcttgtggggtgaattcctaaagtggatttctagtggtgatgaacttccttagtattagcttgtttgggaaagactttatatattcttcatttatgaagtttagtttagcaaaatacaaaatatatctctaatatatgttttttcaataaatatgaactaatctttctttaagaaccctgaaaataggacaccaatatcttctggcttgtacagtttctgctgagaagtccactgttagtcttacgagatttccgttatagttgattagatgcttttctcttgctgattttataatttttcccgttcacattgactttagatagcctgatgactatatgtttgtagaagttcatctcgcaatgcatcttcctggtgttatctgagcctcttgtataaggatttctatgtctctagcaagagggcaagaggagataaattttcctcaaaaaggtttttttagctttttcttctccctcaagaatatctataactcttaagttttctcattttttagaacgtcatttttctcaaaacctttgctcattaaaaaatgttatttgctctttatttttgtctgacagggttaattggaaagacctgtcttcaagctctgagagcaagtttttctgcttgatgtaatctgtaattaaatctttcaactatattttgtaattcttcaatgaatttttaatttccataagttctatttgttttttaaaaaatatttttagtacatttttcattcatatcctgagttttttttctaatttctttgtgttgcttttcaactttctcttggactccatttagctactttaaaataaatattttaaattctttggtatttcaaagattttattttggttaggacttattgctgaagagttagtgtgatcctttgcgagtgttgtaatacgctgttttaaatcatacttccagaaatgtttcagtggtttcttctcatccagatgaactatcccttcttatttttaagtccagtttccaacagacaggattttttttttccctttgagaatatgactacgatgtatgttgtatagggctatttggtttaggttctgggttctttcagtggtaaagactctgtttgagtaccttggttagagataacttttgtatgatggctttcttaattgctggttgtagtagttatgtactgggtgtatgacgaggcttactgcctcctgaagggctggtatggaggactacgcagaaaactaaccttgttctgcatcatgccctagtgtcagcattttgcactgggctgtgcagttcaacattcaggacagtaggtggcacggacaggtaagagccagctgcagcagaggcagatgagcctatgcttgtcactgtttatgggagactctctgttgccccaaggaatggactgatctgtgaaaggtacagtggtctgaggagctggggacaaagcgggatagatctgtaccactaagctcacccttggatgctccaaggatgagcacaagcaccagccctgacaggggtgtcaggggaagaccctggggagatacccgtagcttgtctttcttgcaagcctggcttcattgggcacatgaccagtggagttgtagccaccccctaatacccctacaatgtccgtcctctggtgtgtctacaccagtctcctttgcgagtgaccacagctatgaacacagaattggatccacgggacatgttcccctctctacatccgtgcccaagcgctgggaccattgggctcctgggatggatctatactcctcccttgcagagccaaacaccgcgtctgcgtgtctgctggaagtggcgtagtcattttcagcccacaagcaggttgctcttgcacacaggaaagtgaatgctacagtcttctttgccacaaggggtgttcctttgttgcactttccattaggaatagcctccctggtggttaaactattgggaatgctgtaactcctttgggtccagccagctatgggtgactgccacatccaagcaggtgacagggaatatttgtgcggctctggtgttatggggacagagggctgaggttcctgggtaggaaacagtccccacatgagtgcactgcaggcatgaaacctaccactgcagctcaggcccaaggggaaggcagatgaccctattcaactagtagtttggtgtaatgccctcaagaagttcccaaatctccactcacaccagtgtgtgtgttcacgaagacagaagagctctctgatggcttggatccacacggtgagctgcagggagcccagaagactcctacctacactttctatgaggtcccacagggtcctagtcaacctttgtcaggctcttgcttctgtctttttccatgctttggcttctctccatggtttctctatgacgctcctgcaccctctcttaaatatttttcaagttatgatcatttacctgtaactttggttcttctttctgaggagaacttgtgtccaaactccttagtcagtcatcttgttttcaaaaagccccaattctggtctatatgcacttttcttttttaatatgagagagtaatttcatgttttgagtaaaaaaagtaatattaaatttcattaatgtcagtgattaaaactagattcattgtaaataagttgaatttacaaattaatttttagaacagatatatttcaataccataacatttataataaagttccatttcaatttagacagcatataaaacataatatgtagcattctttacagggaaaaggatttatctgatgcccctctgtatgacccaatatcaacctcactttattgtggcatatgtaaaattaactttggcaatgattaattatatattctcatgaaattattttacctttttcaagaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaaggtgaatgcttatcttacaattgctgaaataagaattagaactttgaataccaacttttttcttattaattttgtttgggctcccattgcctgtaatctaatgaattaagtcaaatatttgcctgtgaaggacatgtattgagtactgaatacctgagattcagtcacttaagttaatctccactgtttcttgaacgatgtgctggaagtattcccagacacacaggtgttgtcggtcttagtctactttaggtttatgtttctataaaggaataactgagtctggatgatttgtaaaaatgttttatttggctcactatactcatgactataaaattcaagatcgggcatctgcattcagtgagagccacagaatgctggtagaaagggaagaggagccactgtgtccagagaacacatgatgagagaggaagcaagagagagagcagggcagtgacaggctctttttaagaaccagctcttccaggagctaatagagtgagaactcaccctgagagggggcattcatctgttcatgagagatccatacccatgatccaaacatctcccattagaccccacctgaaacactggggatgaagtttcaacatggggttggaggtgacaaacatttaaaccatactagtggctgacaatggagggatttctttgttaattttcattttgcttgaaatgtcaacatccattctggacattttatatagtgtgggctgcaacttaagtttcaccgggtgtgtctaaacaatatttaagcagcttatattcaattcagttgcttgtattgattagtcaaactttatgttgatcaaatgcttgcctcagttatgatatttttccaaaatgttatgataaaatgtttccatgaaatgtaaaaattaacatgattttcataaccacatttgctaattggttttcttgcatctttaagatatctagaagtctgagcatattttaacattttaatataccttcaatatgacaatttagtataagtaatacaatatgaacaccattcttgattgtttaggatgctataataagttacataatgaagaatacatgaataaaagaagaaaatctttccattttactgaatttttatattgtaaaacagacaatttaaccattatttacatagtatttctactatagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattggtaatgtataaaatattaatatttaaacttgtcaaaacttttgtattttgtatctaaaacacatacatcatgttttcacaataaactttttttgtaaaatttacatagtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtgggtgagaatacccttcttaaatcaacatttaacaaagtttaatatttttattgtaacaacaataattgcaactatatttttgaaatttacagatatgcctcaacatttccagtcttcaatatgagaccaatcttttgcatattgcttataattcaatatgtgtctagaaagaaaaaataaagctagtaatataattttatgaatctttctgcgtctgataacagtattgtttatatttaaaagtgtgaagcaacattttacttacaaaaattgtcatgtgaggccagggtggttgctcacgcctataacctcaacacttcaggaggccaaggcaagaagattgcttgaggccaggaggtagacactagtgtgggcaatatagcaaaagcccatctctataaaaaaaattttgtaattagttaaggtgtggtggtgcatgcctgtaatccagctacttgggaggctgaggaggaatgattgcttaaggccaggaattcgagattgcagtgagctctattgtgcattccagcctgggcaacagagtaagactctttctttaaaaaacaaaaatattaaaaaattatcatatgattaaatatgagtactaattactgagaaattataacagttttatataaaatataaatattattgttattgtatggtattcctttttaggcactgagaagcaaagaaacaaagttgacaaaatacctacttactactctcccataggattcttttctctcttaaagcttccaaaagtgataatttttcagtttgttccatatcagccaaaataagtgaatgtgctgcagggttggtgggccacaggccctctacatcagtggtatagctgagtggcatgaggtagtcagggactgagtcaggacgtaaatctcattgacggacttcacactgtaaatctcatgtcttgatcagcaagaaggcaaggtgattcacttacagtgtgacttgagatgtacaatctttaaaatcattttgcctctttgatgactaaccgggaggatcttggggaccctcattcacttttctctaaactgagatttttcctaaagttttcctgggtcctgaattctaagagtcctaatgtccaatcatacttatttatccaatgaaatatccaatgatattttgtatttcccaaagaataaaatgtcttctgataggtatctctaacatttcagcgacagaatacagggcttatattttgacataatagcattttgatgcaatgtgatcaggaataacttggttggtgaaatttataatgattaagtcataattttaccatgctaatactatttactttataactatttttatgtaatagttggtttgattcctatcatttgaattttcataaaaatatatttattttatagcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaagtaagctcttattttgttttcagaaatgtattctatttctcatttggaaaagtaataggtatgtgtgtcttttaaaaactttagctatttattattacaaatgctactgaataaggcaggtaaactagaaactaatgaaaacactgttcctaatattaactgtgccctgtgaattagttacctttagtataaacacacacacacacacacgcacacacacacacacacacacacacataaaccaggcactacatgtcatcattactgttggaggaccagtgcttctcattccttttcttgtcaacaaatgttcctgtgcctatacctctgtctatgccaataactactatgtatctgtttgtatatgtctgtatgcatgtatgtatgtatctatatctatttctgttgattcatttatttaatctatctctctgtctattcatctacctgttcatctacctaatcatctatttatctattaatttattgttcatctatcttgaaaagttagtcatattgacacatacagtttcacttgaatagtgtaggttttattccagtcttctcatattttatatctgtattttgctatccaattgtgggtttccttgcctcactaacttcaatatttttaccaatgtctgccagtctaggatatacagaaagcattgacaaccaatacaaaaactaatctgctatcaacatttcaatatgtttagagtccttaaagaagcaaataatatatatatgcagtgaagtgtacatgttctacagttttttcttgaagttttatagttttagccattctatatagatttattaaaatgatcgtatagttatcgtcctttctgttaatgggatgcatcacctttactaatttgcctatgttaaacgacctttacatttcttggattaaacccatttgatcatagtgaatgatctttttaatgtgctgtaggatttgttttcctagtatagtgttgaggggttttgtacctatgttcatcaggggattttgcctgtagttttctttttgcgttgtgtccttgtctggttttggttccagagtaatgttgggccactagaatgagttagaaaaatgatctcctcatcaaatttttggagtcgttttagaagaattggtattagtcctttctaaaatgttgttataattcagcaatgaagccatcaggtcttggattttctttgatgggaaacattttattactgacttaatctgttgcctcatgattactctgttcagattttctatttcctctgaattaatcgtcgtaggctgtgtgtctagaaatttatccatttcttctaggttatccaatttgttggcatataattgctaataacggtctctcattatactttgtatttttttgatatcagttgtaatatcacccttttcatctccgatcttgtgtttctttaagccgtatctctcttttttagttattctggttaaagctttgtcaatttttgattatctaaaaaaaaactattttcattgatattttgtactgctttgggggctctattttacttacttttactctgatctttatgatttccatccttctactaattttggaattgactagtttgttcatgtttttctgcttctttgaggtgtactactagactgtttatttgagttctttccactttcttgatataggcaattattcctaaaaacatccatcttagaactacttttgctgcatcccataagttttgctacgttttgtttccattctcctttactgaaaatatttttaaatttatttaaaatggtttgaccctatgattgtttcagagcatattgtctaattttcacctaatttaaaattttccatagttcctcctattattgatttctcatttcatacctttgttgtcagaaaagtgacttgatatgatttcagtcttcttgaatttgataagacttgttttgtggcctaacatataacatattctggggaatattctgtgcgcatttgagaagaatatgtgtttttttgttatgtggaatgttctttatatgtctgtccaatctatttggtataaattattgtttaagtttaatgtttccttattgatattctgtctggatgatctgtctcaacgttgaaagtaaaatattgatatcccctactattactgtgttgcagtccacatctccattcagattcctaaatgtttcctttatatatttagttgctttgatgttgggtgcatatataggtttataatagttgtattatcttgacaaattgaccccactatcattatataataactttctttgtacctttatacaatttttcccttgtctattttgtctgaaatgagtataactacccctgttctcttttagtttttatttttataggtttttttccatgccttcactgcaatctgtgaatttacgttacagtgaagtaagtcaattgtaagcagtttataattggatattaatttttgatttatttagtcattctatgccttttgattatagaatatattccatttccatttaaagtaattttagataggtaaggatttatagtggtaatttgttaattgtgttctggttgtttttaaaattctttgtttctttcttgcttgctttattcatggtttgatgactttctgtagccatatgcttaggattttttcttttaatcttttgtgtatctattagatgttttgcttttggctatccttaggcttgcatagcataccttataaaaggctatttgaagttgtagttatccttaggcttgcataacatatcttataacaggtattttaagctgataggaactgaattttgattacatataaaatatctaaattttactctgctcctcccatgttttctatttgatcacatgctttgcatctttcaataattcgtatctcttaacaaagtttgtagcttcagctgttcttaccacttttgccttttaacctttatgctagctgtatttacccatcactattacagtattagagtgtttgaatttcatattgtgcttacttttactagtaagttttatactttaacatcttcatgttactaattagcatcctcttctttcaccttcaagaactccctttaacatttcttgtaaggcaggaaagtgtccttatgctctctcagctttttttcaatctcagaaagcctttatcactcctttgtttttaagacagaatagtggaatctagaattattccttggcagttgttttctttcagaattttgagtatatcattccacttccttatggcctgcaaggtttctgttgagtaatccactgatagtcttgtggaaattccattttatgtaaccattcacttttcattggcttttttcaatacttggtctataacttttgataatttgattgtgttatgtcttaaagtgactatctttcattaaacttatttgatttcctttgagatttctgggtgtgggtttctatttctttcccagttgttgaaagttttctgtcattatttttttgaatatattttctgtatcgttgtgtttctttctgtttttaacatggtgataatgcatacgttattccacatggtagtattccatctggatcttaagctatcttcacttttatttatttatgtgtttattttggttctcagatttggtgattttcagtaatttgacttcaagttcactaattccttcttctccttcatctagtctgctgatgaatacctctttaaaacttttccgttcagttatagtattctcaaatttgtgatttttgtttggtattttaaaaatactttctacctctttgttgaagtagttaatttgtttttgcattgctctcttggtctcagtgagtatctttatgaccattattttgaattctttcttgagtaaaacacctatatccacttccctcaggtcaatttctggagactcatcttgttcttttgtttggagttatgatatcttgtttctttattttctttaactcacagtgtttctatgcaatagataagacaatggcctttctcagtcttatcagactggcttcatataggagaaagacctcactaatttttccagccagagattttcatgtgcctctcaagtctttgtgcggactgctgtctcttattttttgtggccccctggaggttagaatgtgccacatcttttcaggacctgggaccaacaagttaggagccaggaggtctagatgtagctgaaaatattgaagacttggctgtgtatttacttacttctattttcatagtgaaagtgaatgtgcgtgtttatctcccactctctctctgtattacaccaagtaaagaatctgtggctaatacctgtactaatattcaggctgcatgctctgatcctgaagaggtatctgcttgaaatgagtccattgtattaccagctttttgtattctgtgatgtagggcctttcaggaatgcagatctctatcatctcccagtgtgagtttgttaaggagacgatctcttgagttggagctatagaagtgatgacctttgaatgcatggctaaacttggtccaggaagaatggataaatctgaatttatcattggggcgagactcatgaagtgccaaactttggctttggctgcgggaagattattttttgtttgcgtcattagataccctgtgcaagctcgatagaggccagttcattaagtagccagtggaagtatgtgccctaagccctttcgacagagaaatggaaattgaactttctctttccttttctgcactgctccaatttggcatagcgcctggagtttttacatagcattttaagaccatctatttgctttacgatctatggagactggtatttttctaatatctgctgtgacagttaagagttttaagaggagtccttttggaggtaactgtaaaggttgtagcacttgatggatgacacaaacctttttgaggataaacaggggagctgcattttaaaaaccttttctctgcactgctcttgggcaatgaagctcctggaagtgcttacacacccatataaaacgccatttcttttttcagtggtctagatagactctggatatattttgtgccctctactcccagaactaagagctttagaatacagtccctgaatgaaagttgtaaaagttagggcactcaagtttgtgtggacaaacttgttctaagagtgattaatgtacctggatgtatcactggggtgagccacgggaaccggctagagaagtgcctgatgcaagttcattagaatccagactgcaagttttttagaattcagacctctaagtagccacaggaagaatatatcataaaacttctcgggagaaacaggggactgttttttcagccccttctctgaactgctattaaggaatgaagtttctggaagctcttcagcacttgtatcataccaccatttttcctgtgatctagagagactctcatgtgtttaatctcctctgcttccaaaattagtgaattaaaggccaaaacacaggatgctttatgtgagatccaaaaacttctccacaaggagaaactgggtttttgagattccttttctaattgtgtggtgcagtgaacaaggctggggtccatgctccattgtgttgcaacttttcttacttgttcaatgtgaatgttgtctttgttgcctgttaagtaggagtccctttactggtctttcattttctttcaggaggagttcatttatgaatagatgtttttttaggacattcttgggtggaagaagagtcaggagcttccacttctgccattttgctgacatcactccctgcctagctctttattttacccccaggaaactagagtattgcaggtatcgttaagtgctcctacacaagcaagagagaaacctgtactttaggatgctcccccaaaagctaggatgatagatgcttagttcactcttatctttcctctctgagggagaagcagtcaaaatatattggtctctgtttactttagggggttgcaggaggctttgaactggtttcttgatttctcataaagggaattgtttccagtatcgtcattgaatcagtgtgcctgtggggggaagggagagtggtggcttcctatactggcatcgtgctgatgtcactgccctctttcatcctcaatattgatcattttttaaatcttgatcattgtttttactttgtcctcaattttattaatattttcaaaaaccaattgtaatgcctttaaattttctccatttgctctgtattttttagttttattatgttttactgattttagctttgctaattttctcccttctctgtgtttctttgtccgttttctcttcttcactgattttactgttttcttccttctgatgacttcagttttaatttcacttttctcaatcttagggtgaaaaatgaaaacatggtcataaactatcatactttgaaaatataaaactttaaagctctattcttttaagcactgctttagctgtgtcccagaatgttacacacgtgtgtgtgtgtatgttctatgtgtcgggagacagagagagagagttcatttttatttgatttgaaatattttctcatttgtcttgtggtttgtctgttgatgattaattatatggaagtttattgtttaatttcaaaatatttgtttttttctagataagtgatttttgctggtttctaatttaattctcttgtgaaagaatactgggaaaatttcaatattttgaaacactcagttttttaattgctcagcacatagtctaccttgctaacggttctatttacaaataaaaatatgcatacacactaaatgtagaattaggctatactgggtcacaatgttcttcaaatttatttgccatgtcacaaaatgttaaataatctctttcttaattgtttactatcagcaaatactttaaattaaataataatgattgtggtacacattaaaatcaatgggatacagctgaaacagagatgtatttagcattataacatgcatcagaaaaaacaaataaaaaaataaaagcaacaggtactacaatctagaaggtagacaggaatgtacacccaacaaaaatagaaggaaagaatcattcaagcataaatagttgaccattaatcttaagaaaaataaattgatgagaatgttaaaaacatgtcaaaatattgaaaaacagaaataagcaaaatacttttgataaatatgaaatactttatcataagcgaaaaaagaaaactcgacattatcaataacctttaatgaagttttgttcatccaaacgtctccctgaattgataacaaaatgtcagacacttaaaatcattgccatgatttcctatagtacgattacataaagctttaggtgaagtagagcatacactatgataggagaaaggaaaatcaagggattatagaatgctcccagatgcttctaaactcccccgtcagtcaaacaggacatgcttcattttcatattatgaaaaaatgagatatttctgatgtatcgcagtttaacaggagcttagctgtgagtttacaaaggtgtctttatatgtgattatacaactaaagccaggctgtgcaatgcattaaactgggtgcataacatccatttaaatatccctaaacagtacaggtaagctagtaaataaaagctctaggggagtttcaagttttaaatagcacactataaatcactagtgattatatttaatgcttatattggtcaagtgtcagtaccaaattgattattaactacatataattctacttctggctaatcagattccattggcagaaaatttgtgagtgttttaatccaatcctgatacatttgattatagatatcaatttttatttaatgcatgtaattaagagtgtgtaattccattaaaacattctaaaggctcaaaataattaaaatcaatattacataaattatgcaaatttattaaacaaagaatatatgaaaaaactacaagaaagtctatgagaatacaagccaaaagttctattgtttaatgtaactgttacacagctgaaaagtataatatttgcatacaaaaacatcataattaatatgtgataatttatgaaacagttattgatctttctatttattctattttaatcatataaattatttttcatcaaaaattctaattttaatatttttattttttattttttattataacattaattatatttttaatattttttagtggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttggtcagtagtgtataatttgttttacataattctttcaaatgaggttaatattctcttgtgcttcgtgtaaacaagagagaagttctttctctgtgtctattactttatcctgacaaaataaattaggacctaggcacattaatcaatcaccactctttcagttttttgaacaaaatacagccaaaatctttggaatattatgtaaatgtcagataacatttccattcatgcatattttaatccttgtgatgaacaagacatgaatgaagatgattattgaacaagaggatggtaacatagatatggtggaggaatatatctttgcgagtttctaatatgtttttgtttttaaataattttatttgttcaaattatactcactttaaaatccgaaatagtatttagttttatatttcaatttaagtattttatttgtttttaaccctttgattttcattcttcatttagaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggttaggccaatatgaatactcaatttctgtttatagtagaattcataaaaataatctcttgttatcaaagtgaggggaataattgagattactgcatatataaaataatttatatattataccattaaaatactttttgcatgattgaatctattctatttatgttaattttatttgttcatgatagagtcactttgtattctggcattaaaaaataatatctagtgaaattaaacctatctgtattattctcatgctgccataaagaactgcccaatactggataatttatacatacaaaaaaaggtttaattggctcactgttctgcatggctgaggaggtcttaggaaacttacaatcatggtggagggagaagcaaacgcatgaagacaggaaggagaagttctgaccaaagggaaaaggcccttataaaaccattagatctcatgaaaacacactcactatcctgagaacagaagcatggggataactgcccccattattcaactacttcctactgagtccctcccacaaaacatggagattatgggaagtacaattcaaattgttatttggttggagatacagtcaaatcctatcattccaccatggcctatcccaagtctatgtcctcacaattcaaaacacaatcatgccttcccaacagtcctccaaatcttaacttattccagcattaactcaaaagttcatatccaaagtctcatctgagacaaggcaagtcctctctgcttatgagcctgtaaaatcaaaagcaagttggttatttcctagacacaatgggggtacagggattgggtaaatgcttccattccaaaagggaggaaatggctgaaacaaagtggctatatgcttgatggaagtctgaaatttaatagggcagtcattaaaccttaaatttccaagattatctcctttgactccatgtctcacattcaggtcatgctgatgcaagagatgggctcccacagccttgtgcagatgtggctttgtccccctcctggttgctttcatgggctggcattgagtgtctgtggcttttccaggaacatagtgcaagctattgatggatctaccattctggggcttcaatgattgtggtcctgttctcacagctccacaaggcagtgcctcagtggggactctatgtgagggctctgaccccacatttcctttcctcaatggcctagcagaggttctccatgtgggctcccccctgcagcaaacttctgcctggacatccaggtattttcatatatcctctgcaacctagttgtaggttcccaaacctcaattcttgacttgtgtgcacccacaggcccaagactacatgtaatccaccaaggcttggggtttcaccctttgaggcaatggaccaagctgtttgttggccccttttagccacagctggagctgaagcagctgggatacagtcctgaggctgcatagagcagcagggacctgatccaggtccatcaaaccatttttccctcctgggcttctgggcctgtgatgggtgggggtgtcatgaaggcctctgacatgccccggagatatattccccattgtcttggtgattaactttggctccttattatttttgcaaatttctgcagcaggcttgaatttctccccagaaaaatgaagttttattttctattgcatttacaagctgcacattttccaaacttttatgctctgcttcctcttgagctctttgccacttagaagtttattctgccagataccctaaatcatctctctcaagttcaaagttccacagatctctaaggcagggcaatatgccaccagtctctttgcatagcaggagtgacctttactccagtttcaaacaagttcctcacctcatcttcatctgtgaccaccccatcctggacttcattgtccatatcactgtgagtattttggtcaaagccattcaacaagcctctaggaagtgccaaactttcccacatcttgtcttctgagccgtccaactccctaggaagttccaaacattttaacattctcctgtcttcttctgacccctccaaatggttctaacccctgcctgttatccagttccaaagctgcttccacatttttggttatctttacagcagcaccctactctctgcagtaccaatttactgtattagtctgttatcatgctgctataaagaactacccaagactgcataatttataaaggaaagaggtgtaattgactcacaattccacatggctgggaggcctcaggaaacttacaaccctggtggaagggtaagcaaacatgtccttcttcacatgatgacaggaaggagaagtgcaaagcaaagacagaaaagctccttataaaaccatcagatctcaggagaactcacgcagtatcatgagaacagcagcagaggaaaaatcgccctcatgattcaattttctcccaccaggtcccatccacaacacgtgaggattatggcaattgcaattcacgatgagatttgggtggggacacagctaaacctgttctgcaagttgtcatgtttgctttgccactatgttttaaaacttcttttacattcttcccacaatgccccttcttatttcctacaatatattatgttttacctggaatcgttaactctcaatgtgtatcttattatcactagtaagtttacagaggcattgtttaccaggcatagatgatctctttctgaaatgtattgctatttttagtttcaagtccttcttcagttggtgacagtccgatagacagacagacaccagaaggctagttttaggaaacatttgtgttacttctctgtgatgtcatagtagctcctgtattgtttattttcaaataaaactacttaatattaaaacaggcatataaaattaaatttatgagttagtgaaacctgaattcattcttttttttttaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattctcagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttataaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaa

SEQ ID NO: 2156 - DNA, 19275 bp, Homo sapiens
cacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgt

SEQ ID NO: 2157 - DNA, 19275 bp, Homo sapiens; identical to SEQ ID NO: 2156

SEQ ID NO: 2158 - DNA, 12460 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacgggatttttaagaaccatcatcaatttcaaaacccgtgtcctcttagtgttactccaaagaatgttgaatatgaaataagaaactttctttgtcatagttttctatgtttagcatgtattcattcggaaagatatttcttaatcctgatctaccataagcagcaatatttgttaatgttttatgtgttccttcagtaaggagaaaagaacttaaatatattactttcagtttaaaggattaaaatttcttccaggactcatttcttttaccagaaatcacaaaactgttgatattatataaagtgctgtgtttgtatttgccttatttgaacttgtattttgatttgctctcacaataaatcaagtgatgaaatgatgttttttagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatcagtgtgatgagtctgatattttgctgttggtaacaaaataatcacagattattgaacaaccattctgctgaatgcctgcctaccaaaaatttcttttagaaagtaaagtttagaaattttctctttagggctgggtgtggtggctcacacctgtaatcccagcactttgggaggccgaggcgggcagatcacgaggtcaggagattgagaccatcctggctaacatggtgaaaccccgtctctactaaaaatacagaataataataataaccggcatggtgacgggcacctgtagtcccagctagtcgggagtctgaggcaggaaaatggcgggaacccgggaggcggagcttgcagtgagccgagttcgcgccactgcactccagcctgggcgacagagcgagactccgtctcaataaaaacaacacaaaaaagtaatttttctctttatatttatattttattttaaagaatttagttgataaataaaaatatactttcatgtttgacaatatgctgttttgatatatttatgctacaatgattaccacaaattaattagcacattcttcatcacctatgcttagcattgggtgtaggtgggtgtgtgagtatgtgtgtgtgtgtttgtggtgaggacacttaaaatctgctttcttgccaattttcagataaacaatacaatattattagctctaaatatcactagatctctatgtttgattccaagttcttattcatattatagctgaaagtttgtactctttgaccaatatcttaatcaaacaaaagcagcaatgataagttctaaaatgcagggatcctaaaatgacaactgatgtaatgaatcattgataatacacccctaattctcatacattaaacataaaacctcattttcacatcgattaccattttaagtttatttaaatcaatatgatgtttttacatagtcggtttggacagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaa

SEQ ID NO: 2159 - DNA, 30701 bp, Homo sapiens
taagtgaccttaaagccctagctttgtggtagtgcacttaaattcagaatcacacttggtaactaataatgaaagatttcaaaccccaaacagtgcaactgaaacttttgcattactatactactgagaatatctaacatgttgttactaatcaatgtcattctgaccttgtgggtttcctgtgctaatggacaaggtaagttgaaagagatctaaacactcagcttccctcttaaatgtaacttcgtgtaatatctaacttcatatgtctataatttttttataaatctgataggatatattcactatgctagcagaagtagcatattttgtgagagtataacagaaattaattttatgaaaaaatatctcataatttaaagaaaaaatgaataatattttctttgttttacaaattctacagtgtaaaaagcatctaatattcattatggagatatatgaatatactcataaaactttaagtaggaaacatgtcattagatagattctaaccttaaaatgttcagaattttcttattcataatacaagggaaactttgggagtgattgatactttcataatcttacatacagtgattttttattgattcatatatcaaaacagcaaataaaatattttaaattatgccatttcttatatttctattataccttaagaaagctgctacatctaattaacattaatatgaatttaatatttcaacaagattagcaatatgtaaatcacaacatatatgtaatcaaaaagcagaatatatacttaacttacattggaatgacagtaaattttaatttgcatttctgagttcactagcaaatgttcaataaataaatacataaataattttcatagctttatgtcattgttctctgatatgttttctcctcgatagtcatgtattttctatattaactatctctttgaatgcaggccttgcatattaaagaactatattgtatgtaacattagcagtggaaccacatgggtcaaaaatcatggacaatcaaaggtgtgtcaccattaatgaagaaaacaaattttataattatccaaaactttataatattccaacaaatgtaatggaggataatattggaaatcccactatcaattattgagagtatcttttccctcagcctctcctctcaaagctatgccactttatttgattctaagtaaacagctttaggttttacagtattatctatcacatgattcgctagttttaattgctgtgcaaaatcaaccttgatttgtgccaaaatgaaaaaaaaggaatttctcttgttattccctttgttaactaaactgctacaggcacattttttaaaataaggattacatagattaaagtagaatgcaaagcagaaaaatagagaaaaacagtactattttgaaatgactgaaattagattagaataagctctactttcttagttactttctcaaaagcagtataagaaaagaatgctgacaaattctttcttatttgatattccagttgaaaacttttctcctccaatgaactctttgtaagagtaaacttgagaaaaatgtcttgtaaatttgggtcacacctatatttctcaaaggagaaagtaactcatttagtggaataacatcttgggtagtgagaaacatctttgtgaattcagtagcattggctcaactgcatccctccaaaatttatttgtaaaagtccaaattcccaatacctgagaatgtgactgcatttgaagaaggagagcttaaagatgtaattaagttaaaggtcaatgattcaggtgggacctactccaatataactggtgtcaataagaagagaaaataaggacacaccatatagagaaagaccacgtaaggcatagagagaatacaaccatttacaaggcaaaggaagaggcctcagaagaatgcagccctgttgacagccacatctcaaagtattagcctccagaactgtaagaaaataaatttctatgaaatctgtggtactttcttatggtagcactagaagataaatacaatgattttacacaatttattaaaagaatattaacttaaaataattttttactctttactcatggatacgtatatacccaccatacatattttagagggtatttatcagaatttgataattatatcttggctgtattgtcttcgctgagttttgtctagttgaatactttatgtttatatatacctgtattcatatctattcagaatctggcaaagcaaacctgagaaatatttttcatatgattaatgaaggacatactttgtgagttgcctatgctaagaaactttgtttttaatggtagttgatgtttcagttctgaataataattcttttggaagccacgctatttgaaagataaacttgacagaaaattagtaattgtaacctattataatgttcattgaatttgtattgagcattatttcttccatcaacttgtaagttatttacatttaatttaaaataggttgtcaggaaaattattttaattatgaatatccttttaaaattgtataaatatttcattcatctattagagttgccataacaaagtatcaaaggtgacaattagtattttagagcaggattgcttctaaatctctttcaaactagatcattttcaatacccagtgcattacactctgttgccattgtacttctttgggatgctcaaattagtttcaaatctcactaagaagctggtttctgtgtgtatttcacgtgcccccattaagctttcgcataacaaaaggttccaggctttccttgacttttcctactacacacccagttctaataacttctctatgaaactccagtgccttctagtgggagaaacgatttttagaaatgaacctaaactatgaaaacctcacttcaggttcgaaaatgtcgtttattaagaaaaagaatttttggccagtcatggtggctgtaatcccagcaatttggaggccaagtcggggagatcacttgaggccaggagtttgggaccagcctggccaacatggtgaaacactgtctctactaaaaattcaaaaaattagccaggtgtggtggcaaacacgtgtaatttcagctactcaggagcctgaggcaggagaatcacttgaacccgggaggtggaggttgcagtgagccaagatcactctactgaactccagccttggcgacagagcaagactgtctcaataaataaataagtaaataaaatgatttcctttagtttacgtctctttcttccttggactaaatatcctgcaatcataagaaaatgtaagagtatctcaggatgttacacagagcagggatggttagattttccaatacggaggagacactcagcaaaaaactgtgcatccgtgcttgacggactgggtcagagaagctgtcatgcgtcacccaacaagcctctggagccagttctgtaactagcaaacgcctcccagaaagtaaagatgtcacttctctgaacttagtcttctcatctacacactaaagctgttgtgtcactagcctccttccagttctctctgatttatgatgattcaaacttaatttttctttagttatattcttaagatttcataacaaatagaacgtaaatattaatttctctcatgtttcagaattataaagaacttgatataaagaaacttgtttcaaaattataaagaaacataaattatttgctatttaaattgtggtagtgttcaatgttctctttgtatatacatatacatatataaatatacatatagaatgtatgaatatatatgtatattcgtgtgtggacctatatttttatatcaataatatgtctcacctgatacatgaattctaactatggtaagaatgtatgccatctaatacaaacaaaatgccacaaaactcaacaaaatgttttatttctggagataatttgctacatttcagattttttcttatgttatagtaatatttcttttctctattttccaaaaaacaattattgctaatgtgtgcacctgaactgacagctttagcataacttggtatagttttagataagctgagtttaaattaacgctgataaaatttccagaattgccgaagagaccatactacgtaggagaagtggataaagtggaatgaggttcttcttgtcttgttagctgatttgggagccactaaggattttaagtggagcaataaaatgaccagatgaaggatcactaatttatacacaggaaaatagattataaagatgagaggtcaggatcaggaaattagttatggttgctgtaatcccagaagaaaatggttgagagaagatgatatcaaagattattggcagggtttttttgtgcctgttgtgtttgtttgtttctttgttttgatagaaaaattgagtgaaagggaacaccacaaatgcagaagttcagttaattttgagagaggtaatgagaatgattaacatgaatttcccccaaaaaaagttctgtcaataattaccatattatgaataaatagggcatgggttatttttgcagctgactcagagaaaatagctatcacagcaaacctatgtctatattgaaattcatatatacatttaaagaatattattctataccatttatctcaagagaactaatcttcaaaggaaataaaatcagcaacatatttttaattaaaattttaacttctttcaaaaatgcctttattatttatctgttaagaacagataaatcattcatgaagcattcaagtcaaaaagaatttttatttttttgttggcagatttacctagtggaaacaacatgtgtatttagctttaaaaagaaaattccattaatatcagatgaggaaacattcaactaacaatgcagttaagtggaagaaaatgaagagtttcattaataaccctaatattaatggacaatggtggtactgagaggaacatctatctcttttaggcttcataaggaaatggtgtttttcagtgtcaacaaattaatctccactgcgtggttcacccaccaaatagcatatctgtaataatatattgtacttagtctaccacgttttaaaatgattggtttcaaactatcacagcatagaagacaatatatagatagttgaagagttaaagaaattgtagcgtaagaagcatgcaaaaagatagagttatagcgttataatgactgtcttgagatatttcaaaacacttacgaaggggagcaagttagcttttgatgaggactgtcacagtcagtgaagcaggtaacagtattatccaacatcgaatcagaggtcgagtgactttctaaaagggtgacctttacagatattgccatatgttgctgggatgggggttggtggtagaagagttgatctattctgagccttccacattttaagtggtatgattcaaaattacacatacaaactttgttttaattatactctattttaaaaactgcaattatcttttgagttgattttataatttatttttcttttaatttttgacttaagctcacaagcagttccttggaaaatatatttcactacacaattgagcgatcttcacttataagcactgttaagaaaatatgttagaaagaggttaatgaacacaagaaaatgataacccacattagatttatgtttggctgatggtatgtgtaataccattgtttgtcttcagatgtaaaagatttaccaacacaagaagcagatttgcttgttatttgggaataactgtattcccaaatctcagtagcttaataaaccaaagtttatgtcttgttcacactttgttttcaatgtagcttagaagggaattttgtttattacatgaattctaagactcaggtgacacagacctaatctctctatgtgcttccatgataactcttaacagctgggaagataacacaaaaatttctccaatggtttcttaaaattcctccgaagctgaatattaactctcatttacacctattatatattacaacactctcagttaaattgcacctgcttaacttcgctaatatagaaaaactgctctatccccccttttccgttgttaatgtcacagaatttcatctttacacatcatgtgcccaaaacttaataattcacttaaatgcattggtttcctaaattatgtagaaaatgaaatatggagttttaaaccaaagttacaacaataaaagcttttaggttaataattgtttttctaaacttcactggtctcttaaatcatatagaaaaacaaaaaatggagacaaaaaccattgttaccataatgctagcctttttaaattgcccatgtatttacctttattgaggtcattatttcttcctgcaatgtccagttactgtctagtattatttcactttacccttcaggactctattagacatttcttgaaaggcaagtctagtggtctcaaactccctcagcttttgtttatctgggaatgaattaatttctccttcacttttgaaggacacttttgacagatatgggattcttagttgaaagacgttttttttcttttagcgttttgaacatattggcccaatgcctctggcctataaacttctgatgagaaatctgctaataatctgactaagaaatacttacctgtgagaaattgcttctctcttgctgcatacaagactctctctgtgtctttgctatttaaaaatttgattatgaccaagtatagtggctcattcctgtaacgccagcactttggaagactgaatggggagagttgcttgaggccagaagtttgaggtcagcctggcaagcatggcaaaaccctgtctctaaaaacaacaacaacaacaacaaattattcaggtatggtgaaatgcacctgtagtcccagctactcaagaggctgaagtggaaggatcacttgagcccaggaggtcgaggctacagtaaggtgtgatcacatcattgcattctggcctgggtgccagagcatgaccctgtcaaaaaaaattatattaaagaaaaaagttagcctgatatagtagagcatgcctgtagtccttacaattcaagagactgaggcaggaggattgctttagactaggaatttgagattgcagtgagctatgatcacaccactgcactcctccctgggtgacagagcaagaccctatcactacaaattaaaaaacttaattaaattaaagtttgattataatgtatcttgatatctatctctttgagttaatctcattaagttcattaagtttattgagggtctctattaatgccattatttcttcaaacattctctattcatctttctcttctccttccgaaatccactttgtgtgtgttggtctgcttcctggtgtcccatgttccttagattcttttcactttatactttaatttctttttctgttattcagattcaataattttggtttttctaaaattgttaattctttcatctgcctgctctactatgcctctgaatctcttttttgatttttttccttttaattattgtactttcagaatttctttttgtttccttttcaggctttctatccctttattcatatttccattttgatcatacatcattttctttcttcacatctttctttacttctttcagtatctttaatacagttattttaaagtttctaatagacctaccatcagagctttttcagggaaactttcagtttattttttttcttttaataggccatactttcctatttctttgtatgacataatttttttgttgaaaactgaacattttagtctaataatgggtaacaactggaatcagattctcctccttctacatgtttgttgaggggcttcctgcattgttttcatttattgtttttgtctgaatgttgtaggctatgtctgtgtcacaaattagccggtagtatagactttaggttgtctccagtgttttccaagcctgcactttttgctaagtgttcatagtcattttctaattttccccattcatgcagttgctttggaacatcctagtgtttagtgtctggctgccaaaatattctttttgtggaaaactgaactttttaatctaataatgggtaacaatgggaatcagattctcctccttctacatgtttgttgaggggcttcctgcattgttttcatttattgtttttgtctgaatatagtaggctatgtctgtgtcaagaattagcctgtagcatagactttaggttgtctccagtgttttccaagcctgcactttttgctaagtgttcatagtcattttctaattttccccattcatgcggttgctttggaatatcctagtgtatctccccttggacaaattcacatcagccaaggggaggggcttgcaacaatggagaaagccgaaaaacaatggccgcctatctttctgtctgcatctctgtgatcaaagaacccagcaatcagagcacaaatctcaaatatttgaagaatcgagttgttttcgacactctggctccccgctgctatgtgcaggttgctccataaatacacatacagctgcctgccatgtggctaaggagcgtggtatgaacatatgacactgtgctaggagctaaaattgactgaatgtgagtgcaacttacgatccaagtcatccctagaagttgtagggcttcaatagactccaaaaatagtacaatcagacaaattctggccatgcaactgtaaaggtgaggagtcagattccaggtgtttcctcctccgccatcttcccagatttctttttctatatttcttagattgctttcagtaaatagaataacaagctaatgaatttaatcttttttattattattattatactttaagttctagggtacatgtgcacaacgtgcaggtttgttacatatgtataaatacgctgtgttggtttgctgcactcatcatttacattaggtatcaaacataaacactactagctccctccattgagtcgttctgagaagaaaaggcagggctctgaattccgatggaagggaacagaaagaaaaaaagaaaaggactgaactggtgaaagcacctttgtctttcaatcaagatgaaatgggggagttccctgattcccctcgcaggacgtgcgagaggggtgttatctgctttgtcgccccgcagctcaaacccctaggggcagcttgcagacgggcaggtgcagaggccggcatgagtgcttttgagctctggccccacggcagcgtctagggtaggcgtctgtgagtacagacgcccaagtggacgcgtgttacaaaactcagatttgctgtctgcagacggcttgtgtgttaatccgctcaatggaccctctgccttatctcaagagcctggggccagtgtgacagacttctgtatcctgagctcttgcccagtggtcctaaagaattggatcacatgcgggctcaaaggatgactgcaaggttttattgagtgatggcggtggttctcagcaagttggatagggagcccgaagtgggggatggagtgggaaggtggtcttcccctggagttaggccacccagcggccagatttttctccgacctcccctagcggaactcatttccctcggcatccagacattcctgctcttctctctttctctgctgccttgttccgctgtgattgttcagccgcgtatgtgtgcccgctaaggtgttgggtttatatgggggctggatgaggagcatggagggccaaaaggcaacattttggacaggaaaacagacatgcctgtcctcatttagggtcggggtggggcctttgacagggaatcgccctcttctaaccagtatttgcctgtctcctttccgtatcaaagactctcactaaatcaaccagagctaagatatgtgtactcaaggagaaaagctgaaagacttctgtgtggaatacatggatggttaacactgtaagtccttactcaggccttccttatttgcatttttactgtgtttctagcaagaatgtactttattttaatgggtagtgatttctacatagtccacacagccgttttcttttcagaaaaaaaaaaatgtaatcctccttatattcaaaatgatgtctacacacctgaaaagacaaaacacagaattgaagatttaatcatatgtgagtttatagatggcttttatcctacaacccagggaaacagggcaaatgcactagtagtgggtgggtacctacgtgctccaggatgtagcagtaagttccagtccatatactgacttacatttaaaatctgaaattactttctcttaaacacaaaaaaaggggagacaataaatttcaatattttagtatatggagttttgagaagtctttgctttccaaagtagataattctaagtagaatttaaaacaattattgtaaactaaaattctctttaatgtttgctactcagaattatacagatggatgtgtgtatatgaatagatatttctctattcttccaatgtccaaaataatacactgggtgagactagcaccctctaaagcctagtatattagttatgtatggttgtgaaacatattttgctaaaaacatatttgcttaaaacaataaacctttattttctcacagattttgtgggtcaggcatttgggagtgactttactgtttagttctgtgtcagatgctctcctgtgtcgttgccaaggatgttggcctgggctgcagtgacctgacaacttggctgggctgcaggatctgcttccaacatggctcactcacacagattttggtaggaggtcccagtaccttaccacattgtcccctccacaggttgcttgaatggcaactacatttctccagagctaaagattcaagacagagagagtgaggagtaggaggaagccttcatgtcatttatcacctagtcacacactctcacctgagccatatttattcttcagaaatgagtcactaagtccagcacacaacaagtggaggagaattaggctccactattttgaggaaggagtattgaagaatttgtggaatttccacaatcatcaaatgtagcaaaatgtctctcacgtcaatagggtgttttatttctatgatggttcctttgcctttttcaagattttttctgtctctacaaacatattcttttttttttctatcttgcagtgcattgtaaaggtgaaccatacttaaagtggatagtccatgacagaaaaatgttctttcctcttctttttaaaacaaggtcttcctctgttgcccaggctggagtgcagcagcgcagtatacgtcgctgcaatcttgacctccttggctcaaatgatcttcccactgcaacctcctaagcagttgggaatataggcatgtgccaccatgcccagttacttttttatttttattctgtagacacaaggtcttgctgtgatgcttaggctgatctcaaactgggcctcaagcagtcctcccaccttggcctcccaaggtgttcggattatcgtgcccaaacccagatgaattgtcaaaagcatgagttcttaagaaaggtagctattgtaactgtgaaaccaatttcactgtgcataaaaactataaggtaaataaataattattctatagttggcttatgaaaatgctagatcagcccaaatgcttctggaccaactgaatgccagctatatctggttttctgcaaaagtatttcgcaagtgaccttctgaaatttgtgtggaaaagatggagaaattgactggtttgatgatttatcaagtagtttgcagttttattaaatgttttacctgattatcagatacagcattttattctcaggcttcattactcttttgtgtctgcccatagtttaacggtttaggagaaatgcagtataaattcacaaatgaaatgctacagcagatggtgacagtgaatctgcattagtatagattcataattccagaagaatcctacgtgcaaagctaaatctaaaaaaattaaatttagtagtggtaactgtaagatcctggtcttgggtcaaaggaatcagcagtactagtacaaacagattagcaaccactataaaaattagtgagtattttaatcaacgttaaggtcagtttgagttaacattgtgatagaaccatcataactgcttgtgagtctacaattcacatggtagaagactaagaaatagaatgaggctgctctaagttctgctgacttcagtgccaatcagatcataggtggaattttttttttttttttttgctttagagaactaccatatgagaaagataaaaatggtttaaattttctcagtaaaaaagaaaagtcatgaagtggctcaagcttgtggtattaatgataatgatagctacttttaattatacttcctttttgattttttgaaaagaaatctcagcagactatgttatttacattctatgaaacaccatcatgagatagataactatacttgttctgaaatcagaaaactaaagtttaaatctctgctctaccacttaatggaaattttaattgagttttttaaggctcacttcctgcaaatccaaagactcaagcttgtccaaggtggaattagtgttaaatgatctatgttgaagtatcataatgtatcatgatgaaatttgcaaagttcaaaggtaaagagaaaataatacaaatatccaaacagtggtcggggggaaacaacagaatgtaacatagaaggaatgaaactaaatgaggcattttaagctcaactttggaagttcaaaaaatggggggcaaaatctatcaacaatgagagatatggatataggccaagaaactatacaaagacaagttattgttcccaggtctttgttaaagacatttacaacatgcaaggattcaaagttataatcggcataactaatctgtagaaaccggttgaaaaatttttctaatcaaacaaaaagaaatagattgatgaacgccagatgtgttaaagacaaattattcatctgacacttgttaatatgacaagacagattttatttgactattgcaataggggaaagaagtcttgagctaagcttcaaaaacagcacagctgaggatttataccctaaaatcagagtaattaagatgctatttataagcaatgaaactgaatgaatatttgaacttccacattggaagtttcaaaaatgtggcaaaaaaaaaatggtgaagagaaatatggactgtaggccaagaatctatacctagagaagttactcacgtatcttttaaatgaagatacttaagagatgcaagaattcaacatttataatccacaaaacaagactgtagaaactgcctgaaaatctcgctaatgaaaaaataagaaagaaagacaataaaccagtggactaaagaataatggagataataaacaatattgtgcgtgtgtgtgtggtgcatatgttggaattttttataatgtgtagtataaggtttcttgaacaatgatcatatttcatagaaaaaatgaatattcttctggtattacaagtagtaaattatctccgaatcatcccatggaaatggaaactttttttggaaatatcaagtataagccttataataacatagtgcttaaacatatatgtcaaatattcaatatacacaaattcctcaataaactgtaaatatactgtaaaaaatattgtatataaaacattaaaaacatcttattttctaatcaaaattaaaaattaataaaaatgcttattacactcttagatatttagatattaagaaatattcctagttcattttcctggttaaataaaggatagaaatcttgtcttaataactggtttgagacatgaattagcaatattattttgttgtgtgatgtgatcaatgagaaattcctgtttctctgtagtttttacattccttccagtcaattttttaaaatcctcaaaaaactactatctcccactctagagttggtctgagaagaacaggcagggctctgatttctgatgggatggaacagaaagaaaaagaagacagatgagctgaatggtaaaataagcgccttcatctctcaaccaggaagctcactaatcaaccagggctacgatatatgtactcatggagggtacattaaataggtctgcacagttttcttcaatcttcattagcaaacagctcttcacatatctaggtcattggatttctgtaacttttcttgccctaaaacccctaattcattacactaagaagagaatataatttattgatcaaaaatgtcatatatgattatctgttatagaaaaacattatttatactgttttttgttttttattacaagaagtgaaaccttgtgattttccagaaattcaacatggaggtctatattataagagtttgcgtagactatactttccagcagctgcaggacaatcttattcctattactgtgatcaaaattttgtgactccttcaggaagttactgggattacattcattgcacacaagatggttggtcaccaacggtcccatgcctcagtaagtaaacctctttacaagaatatgtgcataaaacttgaaaagagtgagagaacagcaaataaatgattatattgtcttatataacagaaataggaccaaaggaagagttgttcaagcaaaaagaccaaaatggatcttttttgttatgagatcttcgtgaaaattacatgagaaataaatgtggcaactttatgagaataccgatataatttaaacatattttatcataaaaactaaggttaagtaacattgaatactgacttttttgtaaaaacatttagtagtagctttagtttttcttgagtcatacatcattttcagtattgatgcagtcttatttaaatgttccaaaaattattttaatatactattttgatcaaattcatgtctctaatttacctttaaatcattttatggtccttaggacaatgtattttcaattatttggagaatggatataataaaaaatatggaagaacgtatttacagctggtctcctcctcccagatgcattcgtgtcagttagtgcactcatttgagatcccagtatgtccgtaactgtctaagatctagatatttaactggaaaattttgtacatcaactctgaagccgaatttatgtctttttattttaaaacagaagcctatctagtttccagttccaaatgtgtctgaatacatttaaaatttctggataattagtggattctgtcacttaatagggccaagcagcaatagaaatataagtcaggggccaggcgcagtggctcagtcctgtaatcccaggactgtgggagaccgagacgggcagatcactttaggtgaggagttcaagaccagcctggtcaacatggtgaaaccctgtctctactaaaaatacaaaaattagccgtgtgcagtggcacatgcctgtaatcccagctacccaggaggctgaggctggagaatggcttgaaccagggaggcggaggttgcagtgagctgagattagaccactgcactccagactcggtgatagagcaagactctgtctcaagaaaagaaaaaaacacatatatatatatatgtatatatatacacacacacacatatgtcatgaagatcacaaaatacactaaatacacattaaagtaacactgcttcagtatttatatcaaagtgaatgcattgatttaagtagattataaaattatagcattaattaacaatgcttgcccaaaggtcacttgtacatctctcacaattatatgacatctattcttatagctaatgctcatgctctgtcgctttaaatgaagacacattcagttatagctgactttcactttttaggtaaaggggtctctgaaagttgtttgtgtgtattgtttgcaatttacaaaacattccattatagaaactatatgataattaggatacaatagagataaaggacaatggtaatcttcttacacattcatagaagcactgccctcaacaacagcctaagcctctggaagggaagtcccttttgctcctgccataggcaccaactctgtcattaatccacttaacaaatattgttgtgtgtcaagtgcctttataggtatcgaaaataaaattgtttacgagagaaactgaatactgtagtttagagactggaggagattaatcgaaaagttgacaagaatagatcagaaaactcatgattatgacaaatgctttattataaacatgtatcatctttaacatgatttattttcctttcagatagtaaaattggtccatttacatttttttctaattactaaccaaaaaagaacatacacattattaataagttagaacatacgcattactaaaataattactaccttatacatatacccattagtaatgtatagaacacatacattgataatatataaagaacatatacattactaatatattagaacttatttttgctatcttgtttgttttttcctgcttacatttccacatttctctcaaacaccatggctatatgggtttaagcatccacttaagatgacaactattttaaattcctggagacaaaagatttacaaatttatttccttgcctgtggtagcagtgtgtactgtatctttgcctgggaaatggcatttgactaaatgaagtctaagacctcttaatagcaccagaaaggttcaggttattgcaaagtagccagaaactcttccaaataattatagggaattgagagtctgctagatctgcattcctcaaggcctgccagagctctgttgacagtctcaaagattctttgcttttattctgcccttccctgtgttttcactattttctttcaaaattcacagatgtctaggaaacttccagttttgctgttttcaattcattaacagatgtttcattgtttcaccatactgccatgtttttacttgttcccttctataaaagaagtattcaacaaatatttacttttttctctactttttctattttaggaacatgctcaaaatcagatgtagaaattgaaaatggattcatttctgaatcttcctctatttatattttaaatgaagaaacacaatataattgtaaaccaggatatgcaacagcagagggaaattcttcaggatcaattacatgtttgcaaaatggatggtcaacacaaccaatttgcattagtaagttatttacatattcccactcagtttctgtcaacttctttcctctctttgaggtgatagtgttttacagaaaaagatagaaaacacttttaggagtaaagagatataaatacttctaacatcatctaacattctgtgccaaactaagtcttttttgcctttttagagtaatggctacttgggaagatgatcattccatctctctcaattcaatttgcctttacgtaaaagcaatcccatcaggtacagactagttagggagctgcatgggaatatcagcacaatgtattacttgtcaataaaaactttgttcttttccctttctttgtatttcaaaattatcaactgcttgtattgtattccttgctcacactcttaagatgtacatgttagggaagggatgagtgcttaattctgagtttctgctagcatcaggaaaatgagacttcaataatttgtatcaatgatgcaactgaggagaaccaactcaaaaaattatttccagcttattgtctagtacagagaaaacaagtaaagaaaaagagtaagtgggtgggctgaatgtttacaaacctcatacttggcaatggattccttacaactaaagttctctaaaacattcccaacttgtaattatttattaataaagagattgcataatgaacaatggaaaccttgcagtggcaaaagtttatcttttttgtctttcctctttaggcattcaccaagatttgtaaagataaatcatttaatgtatttttaacacacatattgatatataatttacatactgcaaaatccacttcattttcaagggtacaattcaactatttttagccatgagacgaaatggaaaggactactgatatgtaattgaacatggatgaatctcaaaaatattaatctaagtgagaaaaaagaaaatgctacacttagaaagtgattatctcaaagttactctgaggtttgggagctataaaatatcaattcgtacatttctagaatactgttttcaatttctatgcttatcacgggctctgcaaaagacaaagctgtacacttcaatctgatttgaccagctttgataaatgatctaagatttgtaaaataaaagatgctttaaaatttttatagaacgtatatccaatgaatataattttaatccaacttataaaccctgtcagtaaactgagtacataaatatgtacattaacttttaaattcacaaaattttatcttctttaaaataatacattatagtgataaaggtagactgtaataacagtcaatgaggtgttcacaaataaaaatagatctgactaaatagtcttaatatgtttttcatagggtttgaataatgagaaggatcattatagggaaatgtatttttctcttgtaattaactgttatagcacaaaaaaaacactgattgtcggactatttttaatagtactcaatttattagcacacactgattggtaaattttattcctacaatgggactttcttagtcgagttgtacatcatatggcatagaaaagcaatcctcaattttattttgtttcagaattttgtgatatgcctgtttttgagaattccagagccaagagtaatggcatgtggtttaagctccatgacacattggactatgaatgctatgatggatatgaaagcagttatggaaacaccacagattccatagtgtgtggtgaagatggctggtcccatttgccaacatgctatagtaagtattttattcaagtatttctttttactagaattaaacaaatagaaacatacatatgtatatgtacacatatgtgtatgaatacatatgtgtacatatacatgtagtcctcatttgagtgtgaattaccttgaaacttaaaaaaaaaggttgaaaatacaaatgtcttcctaagaaatcaaataagatacatttaagagtatataaaaagctttattcagaaagtttccaataaaactgttgatttttccccaatgtaaagtattttttttcagattcttcagaaaactgtgggcctcctccacctattagcaatggagataccacgtccttcccgcaaaaagtgtatctgccatggtcaagagtcgagtaccagtgccagtcctactatgaacttcagggttctaaatatgtaacatgtagtaatggagactggtcagaaccaccaagatgcatatgtaagttcttaatattctggatctgagaaaattagagtaataactttgatccttgtttatttatactaaaatttttatgggttattaccctagaactgtgttcacaaacagctattctgctgaatatttgcctttcagatcttaatatataagtgtataagcttggaaaattttatgtaaacaatgacaaagtttccttttaaaaacaggaatgttcagagacctcaatttgttaatggacacaatgagtcttcaagaatgatatccatttattgcacacatatgaaatacagcatctcaccttaacatcaataaccattttcacattattaatacttaggtaaacagttttcaaagagttttgaaaacactgttttaaaaaccatggatgtggaaccaacccaaatgtccagacccaaatgacagactagataaagaaaatgtggcacatgtacaccatggaatactatgcagccataaaaatggatacgttcatgtccatgtcaaaagtgacatggaggaagctggaaaccatccttctcagcaaactatcacaagaacagaaaacctagcaccacatgttctcactcagatgtgggaactgaacaaggagaacaggtggactcagggaggggaacatcacacaccagggtctgtcacaggatggggagctaggggagggatagcattaagagaaacacctaatgtaggtgatgggttgatgggtgcagcaaaccaccatggcacatgtattcctatgtaaaaaaactgcatgtcctgcacatgtaccccgaacttaaagtataataaaaaccatgcactattaactaaaatcctacttgaaaacctgaaatgcttcctgatagagcacatagctagttaacactgagaagttctttctctgattattgtttttttcttacactttaccagtatttctagcaagaaagaaagaaattaacagaaagctcagccatttccaaatgccaatgctttctgttttcaccttcatctcctctcccctcgtcccagaatgaaaatgaatacactaaaaagccctcaagtctgtaatacaggtatactcttagaattttgtcccacaaatcctatgaacttgaagaaacacaattcaaaaaatatgagccaaaataattatggcagcaaaaagaaaacctaaaagaaaatttgccacaaatttctactagcctatgaggtagagaactgagatacccatcaggccttgcatatcagataacttattcctgtcacagctcttaaactgtaaactcacgagttttccaaatgctcaagttcctaagtacaggatgatacaagcagttcttttctgtgatatgactcatttcttttattttgatgctatgctaccttttaccttttatattgactgatgatgctgatattttggctgatcctatgatgggctaaaccttaattattgtccctatttatgtatccacttctgtagatgatcatgtgtaagtccgggctccaaaccatgcaagtggcaagactgcagaggaaaattcgtatcctcaaatcaaaatagtttacaagtatctttgaacatgatttcataggaaaaatttagtattaggtttcagagataaattctgagtcttaaatttgattgactgaggagatggacactcctaagatggatttcacagcaaaatcattacctcttctcataatcaagaacaggaaaggattataattatctgaggacataagatcagttccatgatacaagcaagactttcagtcttaaaatctaaagaagcaaagagcattcaagcagggaattctagggaaaaaggcaaccttatgaaaaatattacatatacatatggcatattaaagtaataaggaaaacattccagaacagcagaaaactttagaaacttttgaaaaatatgtttggagaagtatgtagtgctcaaataatatttatttttgaattgtaaacagcccctgaatgtattgaagagatcttaaaaatttttggatttcaaaagtgatatgtactatgttaagaaatttatttaagtgcttgaaagatggattaaaatatgatttggggaaatttctaaagaaatactaatgttaataagggctagacttgagtgcagaatacttgcatcaaaaggagagaagaggagtgaatgatatcatcaaaaatgaaaagtttaccatggaagaactgggcttaatacctagcgtatgggttgataggtggagctaaccaccatggcacacatttacctatgtaacaaaccttcacatcctacacatgtatccagggaacttaaaaaataattataaaatttaaaaaaaaatctaaaagaaaaccagccaggcgcggtggctcacacctgtaatcccaggactttgggaagccaaagcaggtcgatcacctgaggtcaggagttcgagaccagcctgaccaatatggtaaaactctgtgtctactaaaattacaaaaattagatgggcgtggtggtgtgtgcccatagtgccggccactcaggagactgaggcaggagaatcacttgaacctgggagacggaggtcacagtgagcagtgatcgcaccactgcactccagcctgggagacagagcgaaatttcatctaaaaaaaaaaaaaaagtaaagaaaaaaaaaaacattatttggaaggtaacataatcaaaacagtcatctcttatatcattgtctgttacagtgaaacattatttatactatttttgttttttgttacaagcaatgaaaccttgtgagtttccagaaattcaacatggacatctatattatgagaatacgcgtagaccatactttccagtagctacaggacaatcttactcctattactgtgaccaaaattttgtgactccttcaggaagttactgggattacattcactgcacacaagatgggtggttgccaacagtcccatgcctcagtaagcaaacctctttacaacaatatgtgcataaaacttgcaaagaatggagagagaagagcaaacaaatgattacattgtcttatatgacagagatggtaccaaaggaagagttgttcatgcaaaaacaccaaactagatcttttctgttatgagaccttcatgaaaatcacatgagaaataaatataggaaccttatgagaatacctatataatttaaacatattttatcataaaaactaaagataagtaacattgaatactgacctttttgtacaaacatttagtagtagctttagttttccttcagtgatacgtcatttttgtgtactgatgcagtcttatttaaatattcaaaaaattattttaatatactattttgatcaaattcatgttcctaatctaccttttaatcattttatggtctttaggacaatgtattctcagttatttggagaatggatataacacaaaatatgaaggaatatctttacagagtcaatctgtaaaagttgaggatatcctggctacagtctttcaaatgtgcagaccacagttccatgtacagaggatgaatggtctcctcctcccagatgcattcgtgtcagttagtccacttgtttgagaccccagtatgtccttaactgtctaagatctacacctttaactggaaaattttgtatatcaactctcaagctgaatatatgtcttttttatttttaaatagaagcctagctagctttcagttccaaatgtgtctgaatacatttataatttctggataatgagtggattctgtcacttagtagtcaagtaacaatagaaatataaatcatgaatagcacaaaataaatagactacggattaaagtaacattgcttcagtatttatattgaaatcatgctaaatgcattgatttaagtagattataaaattatagcattaatttaaaaataaatataatgcttgcccaaaggtcactgctacatctctcacaactatgtcatatctatttttatagttaatgctctgttgctttaaattaaggctgatcttcagttatagctgactttcactttttaggtaaaggggtctctgaaagttgtttgtgtgtattgcttgcaatttaccaaacattccattatagaaaccatatgaatattatgatataattgagatgaaagacaatgggaatcttcttacccctttgtaagagcaactgtcctcaacaataggcctaagccactgaaagaaaagtccctttttctcctgccataggcaccaactctatcattaatccacctaataaatattgttgtgtgtcaagcactttataggtattgaaaataaaactgtttacaatagaaactgaacactgtagtttagaggctggaggagattaataggaaagtaggcaagaatagatcagaaaactcatgattatgacaaatgctatattataaatatgcatcatctttaacatgatttttctttcagatagtaaaattagtccatttacatttgttttctaattactaattagaaaagaacatatacattactaatatcttaaaacatatacattactaaaataattactaccttatacatatacccattagtaatgtatagaacacatacattactaatatataaagaacaaatacattgctaatatattagaacttatttttgctatcttatttgctttcttttttctgcttacatttccacatgcctctcaaacaccacgtctatatgggtttaagcacccacttaagatgacgaccactttaaattcttggagacaacggatttacaaaattactttcttgcctatggtagcagtgtgtaccgtatctttgcctgggaaatggcatttgacttaaggaggtttaagaccccttaatagtaccaaaaatactcaggttgttgcaaagtagccagaaagtcttccaaaatatcattagggacttgagagtctgctagatgtgcattccttaaggcccgccagagctctgttgacagtctcaaggattctttgcttttattctgcccttccctgtgtcttcaacatttccttcagaaattcgtggtttcctttaagaacacggatgtctaggaaacttccagttttgctgttttcaattcattaacaaatgtttcattgttttgccatattgccatgtttttacttgttccctcctataaaagaagtattcaacaaatatttacttttttctctactttttctattttaggaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattagtaagtgatttacatattcccattcagtttctgtcaacttcgttcctctctttgagatgatagtgttttacttaaaaatatagaaaacacttttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagaataacagcaaaatgtgttagttgccattaaaaacttcgttgttttccctttctttgtatttcaaaattatcaactgcttgtattgcattccttgctcacactcagaaaagttgtacatgtcgggggagaaatgagtgcttaattctgaatttctgctagcatcaggagaatcagaccgtaataatttgtatcaatgatgctactgaggatatccaatcaaaaaattatctctaccctattgtttactacagagaaaacaagtaaaggaaaagggtaggtgggtgggctgaatgtttacaaacctcctacctgccaatggattctttacatgtaaagttctctgaacatgctcgacctttacttattatgataaagagattgcataatgaacaaaggaaatctttcagtggcaaaagttgattttttttctttcctctttatatattcacaaagatttttaaagataaattgcctaatgtatttttaacccagatactgttgtataatttacatactcccaaatccacttcattatcaagggtacaattcaactatttttagccatgagataatatggaaccttgatacataatacaacatggatgactctcaaaaatactaggctaagtgagaaaaaagaaagacacatttacaaagtgattatctcaatgttaccatgagttttgggggctatatcaattcctacatttctagaatactgttttcaatttctatgcttatcatgggctctgtgtaaagaaaaaggtgtatacttcaattttactcagctttgataaatgatctactttaaaacttgtaaaataaaagacaggatgcttcataaatttttatagaacttatatccaattaatataatttttatctaatatatacacccttactgttagtaaatcgttacataactacataaatggtttcgttaacttttaaattcacaaaattttatcatctttaaaataatagattgtagtatcatagtagtagactttaataacagccaatgagatttttcacaaataaaaataggtctgaccaaatgtttctaatatattttcacaggatttgaatgataagaaagaatatacagagagaaatatatttaactattgtaattaactattatagcacaaaaagcactgattgtcagactatttttaatagtactcaatttattagcacacactgattggtaaattttatccctacaatgggactttcttagttgagttgtgcatcgtatggcatagaaaagcaatcctcaattttattttgtttcagaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttatagtaagtattttattcaagtattttttattagaattaaataaaataatagacacctacatatgtatatgtacacatatgtgtgtacatatatgtacatatatatgtagtcctcctatgagtgtgaattatcttgagacttaaaaaaaaaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagatcacgaggtcaggagttcgagatcagcctgaccaacatggtgaaccctgtctctacaaaaaatacaaaaattagccaggcatgctggcatatgcctgtaatcctagctactcaggagggtgaggcaggagaatcatctgaacccgggaggcagaggttgcagtgagcggagattgcaccattgccctccagcctgggcgacagagggagactccgtctccaaaaataaaaaaataaaaaataaaaaataaataaataaaacagaagaagaagaaaagaaaaagagaaaaagaaaaaaccaagaatgttcagagtcttcaatttgttaatggatacaatgagtcttcaagaatgacatccatttattgcgcacatatgaaatatggcatctcagcttaacaccagtaatcattttcacattattaacactgaggtagagttttcaaacagttatgaaaacactgtttcaaaaaaccacgaactattaaatcctccttgaaaacatgaaatttttccggatagaatacatagctggttaacactgagaagttctttctctgattattattcttacttatattttatcagtattcctagcaagcaacaaagaaattaacgaaacttcagccatttccacaacccattgcttttccatttttaccttattctcctcttcccttataccataatcaaaatgaatacactaaaaacccctcaagccagtaatataggtatacttctagaattttgtcccccaagtactatgaacttgaagcaacacaattcaaaaaaatataagccacaataattatggcaacaacaagaaaacctaaaagaaaacttgccacaagtttctactagcctatgaggtagagccctgggatacccatcagtccttgcatgtcagataacctattcctatcacagctcttaaactataagttcatgagtttttcaagtgctcaagttcctaagtaaaggatgatacaagccgttcttttctgtgatgtgactcatttcctttattttgatgctatgctaccttttacctttcatattgactgatgacgctgatattttggctgatcttacaatgggctaaaccttaattattgtcccctacttaggtatccacttctgtagatgatcatgtccaagtttgagctccaaactatgcaagtggcaagactgaagaagaaattagtatcctcaaatcaaaatagtttacaagtatcttcaaacttgatttcatagaaaagtgttaggtttcagagataaattctgagtctcaaatttgattgaatggggagatggacactcctaagatgggtttcacagcaaaagcattacctcttctcacaatcaagaacaggaaaggattataattatctgaagatacaagatcagttccatgatacaagcaagactttcagtcttcaaaactaaagaagcaaagagcattcaagcacagaattctagggaaaaaggcaaccttatggaaaagattacatatacatatggcatattaaagcaatgaggaaaactttcccaggcagcaggaaactttagaaagttttggaaaatatgtttggagaagtatttagagttcaaataatatttatttttgaattgtaaacagcctctgaatgtattgaagagctcttaaaattttttggatctcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaaatgaaaagcttgctatgtaagaactgacatttttatcatgtaagaattaggcttaatacctagggtatgggttgataggtacagcaaaccaccatggcacacatttacctatggaacaaacctgcacatcctgcacatgtaccctggaacttaaaaaaaaattataaatttttttacaaaagaattttataaaagaaaacccatatgtggaagtaacattatcttactgattttacagatgaaggcatagtgagatagagtaatttgtccataatcatgtagggattcacattaactcctgtgtgcttatccttgcctctttaaaatagaaaatgaagatgacagggatagatgatggtgatagagagagagataattgacagatattgaggtgtatgtatgtatgtatgtatgtatgtatatatagagagttttattttaatagatgactattagaaagattatacctttctacagttctttttctacactgtgggcataagagaaaaatataaacatagaattaaattagcaaaatgtgagtacatttggagtgcttgtagtcacggcttgtcaaatgggggaaaggaggataagtaaccatgactccagtggaacatgttagcataatcctttttgatatgaagtcactagggtggacacaacatgttttagggaagaagagttcaggctctagagaaagactgccagggttcacgtttatcacctcacctgatgatctctgctgtgacgttggggaagtgcaactgaacttattatatttttgaaatgctaaagtcagtatgtagcacaaattaataactattaactatttggattattttataattttattttatcctaaactactcattaggatgcattttatttgctcatgaaaggcaagattatgattgttaattgtttctttttctgctttcagatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtccaacttccacttctcactcttatggtctcaaagcttgcaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattggacttcctatcaatgaattagtaagtatagaaacagataactgaatggctttctgcatattgtacagtatacctagacatag

SEQ ID NO: 2160 - DNA, 30701 bp, Homo sapiens; identical to SEQ ID NO: 2159

SEQ ID NO: 2161 - DNA, 30701 bp, Homo sapiens; identical to SEQ ID NO: 2159

SEQ ID NO: 2162 - DNA, 101829 bp, Homo sapiens
cagtaactgactacttttctcccttctctagggtcctagcacagtgtctgatggagctttcctaccagaccctgaaattcacgcatcaggcgcgggaagcggtaaggaacgcatatataaaacatgattataccaagaacccctctcctactgttgctgcgggacgattccgagtctccggttgctatggcgacagagtccgctactagagaagcgcaaacgcagtgagaggcgctcggccgaggtggttaaatcccgggctgggcttgcagccgtgatggagggaaaaataaatgagacacaggcgggtttgggggtgacaacgggtcggatgaaagggacggcagggtcggttcctgattgaggaaatgaggtattgacggggaggtgttattagactctggatcttgattgggtgaatggatttggggagtggtcaaaattagattgttgaaagacaggaaaacattgacctgggagttagttagaatattggcttctgatcctgatttgccatcactaaggcgagagatcttaggcatttaattcccctcttgggcttcagtttctccatctgaaagtcagggaattggactgtaatctttttcacacgaagattacatgagctctacaatacattaagtggtttaccgtggtctgtatcacctgctactggccagcaattctttccacagcgatgaacatgaattgaggacacatttgtctgccaggcactggggagataaaaacaacgtgggggcggggggaaggaaaaataaaaataaagttaaaaaatacttctacctggatctcattcctagaggttcagaattactggcttgggatgagttctatgcatcagtatttttagaaagctcaagaggtgattacagtgtgtagccaaggttatgaaccacagctctagtatctcctaccttttaaaaactaataatacacaaaaaggtaaccctctggcttcatacccattatggttaccagcctctgtttatttctctccatcttctagaaaaggttggctacacatgttgttgctaattcctcacctccggattgtacttaagcctattttaatctcagcatgaactacccgcctcagaatcttttgggttaccctttaatagagcagattcttgggcctcatgaagacactgaatcagaaacccccgggatgatttcttgaaacttgcactttaagcacgaactctacgtttgaaaaacacagccgtaaacgttctcatatattttcatgacttctagtactatcttttaaaaatttatctttttggagacagagtcttgctctgtcgcccaggctggagtgcagtggcatgatctcagctcactgcagcctccacctgccgggttcaagtgattttcctgcctcagcctcccgagtagctgggactgcagttatgcgccaccatgcccagctaactttttgtatttttagtagagacagggtttcaccatgttgcccagtttggtctcgaacttttgagctcaggcaatcttcccccctcagcctcccaaagtgctaggataacaggcatgaaccaacatgcctggccgacttcttcttcttctttttttttttttttgagtcggagttttgctcttgttgcccgggctggagtgcaatggtgtgatcttggctcaccgcaacctctgcctcctggtttcaagtgattctcctgcctcagcctcccgagtacctgggattacaggcatgtgccaccatgcccagctaatttgtttgtttgttttagtagagatggggtttctccatgttggtcaggcaggtcttgaactcctgacctcaggtgatccgcctgccttggcctcccaaagtgctgggattacaagcatgagccaccatgctcggccaaacttctaatactatctatataccaaaaactcccccaacctacctcaactggacttctttgttaagccccagaccaatgatccagaagataaaatatgggtaggacaatggatcaactgattacttgacatatctactggggtgttgcaagtatctgcattgtgtgtgtgtgtgtgtgtgtgtgtgtgtgtttgagacagggtttcactgtcattcaggctggagtgcagtggtgcaatcatggctcactgtagtctcaccctgctcaagggatcctcctgcctcagcctttcaagtagcgggaactacaggcatgcaacaccatgcccggctaatttttctgtatatttagtagaaatgggttttgccatgttgtccaggctggtcttgaactcctaggctcaagtgatcctcccacctcggcctcccacggtgctggaattataggcatgagccactgtgccttgcatcttaacttgtttaatgcctaactacttctcctccttctccttttccttttctccttctccttcttcttttcttcaacagggtcttattctgtcacccaggctggaatgcagtggtgtgatctcagctcactgcaacctccgtctcccaggctcaggtgattcccccacctcaacctcccaagtagctggaaccacaggcatgtaccatcacacgtggttaaattttgtattttttgtagagtttcaccatgttgcctgggctggtctcaaactcctgggctcaagtgatcagcctgccttggcctcccaaagtcctcggattacaagcgtgagccttcgtgtctggcttaatgcttaacttttgaatgtcctctctaaaacctgtacctttcccagtctttccccataggggaagccaccccagtgaaaccaccattcatccgattgctcaaatcgtaattctgggggttatccttagctccttctttctcctagtccctctcctctgtcctctacaagaggaagacatcagcaaatcttattgattctacttctatattgtatctttaataatccatatattcacatccacctcctgatctaaacctccatgccctgtcactggaaccacattaatagcatcttagctattaccccttggtttttgcctctcttcagtccaaccttcatccaatgatcagggtgattttcttaaaatagtgccactcttttaatgggatccttttaatgcctttccattacacttgggataaaccctccaaatcttgacaagacctacaaagcactgcaataaagcccaacctctgcctccatgcttttcctctccattttctgtgttgcctctcagtgctccagccacattctccctaatctaacgtctgacaactccatagcatttatgccataaatttagtatttaattggattaattatattgttatctgttgcttgcatgtaacagataatataaatttcttggaacttgaaagcaaggcaggaactcaagccttattttttgttttagtccctagatggcgctaagagcaatatttaggtatgctcactgatggtttgatctcttggggtctatgtgcaaggaattgtgctgagtaggggtctggagaagctggaggaggggatgtgatccagtgtgttagatataaagaggactgcacgtccacaagacattctgattacctacatcatctactgtattgggattttcagaatattttctttgtatttggtttatttttgttgtttcaaattatttatttacaaatatattttcagtttttaatttttaacaaagtaatggcagcacatcacttaaaattataatagttcaacaaaatttgaaaaaaaacgaatctcctgcttcacctcaactggcccttacttaattactgctccccagaagcaactgcttcgacttgtagcagcttcttcaaaataacatgtttatactctttttctttttttgagacagagtttcactcttgatgcccaggctagagtgcaatggtgtgatctcggctcaccacaacctccacctcctgggttcaagcgactctcctgcctcagcctcctgagtagctggggctacaggcgcccaccaccacacccggctaattttgtatttttagtagagacggagtttctccatgttggccgggctggtctcgaactcccaacctcaggtgatctgcctgcctcggcctcccaaagtgctgggattacaggcgtgagccaccgtgcccggcgatgttcatactcctgaagcttgatttttcattctcagttatagtcgactcacttttatgaagataagcactgaactcccttctacttctccctgtccctggcctcctcccaccatcagtatgtatttcccttccctcattctctcaacacggagagaaattctatcataattttcattaaatcaattttcagtattaatattaatccgattgtataaatactatttagagctgagccatacagtgcactttggttatattttatattttatttaacttttgggacaagactcaatcatatattaaccaatgcattcttctttggtttacttttctgtatatttgataccacttccttcctagactttccaacagaactgtaaaattctcaatgtggggaagctaatcaggtaatttctaagtctgattttttttttttttttttactgggtggtatcttttctggatctctgagattctcctgctgtgtcaactcattgctctttgggcgtactatacagctttttttttttcctaggaaatcccttcctcccttccctgtgttagaaatcctgcttcctgggctccatgtcttccccttcttgccctatatccctcttgtagtgaaacatatcaaccaataactatctgagaaaagatatatgggaggtaaagttttggaaacaaagtatctatgaaacttctcctctcaccttgattggtgatttggctcaggttaatactctaggttgggactgatttcatctcaatggagaaggcattgctccattacttttttaattaattaattaattattttgagcagggtcttgctctgtcagcagtggcccgaccttggctcactgtaacctccacctcccgggttcaagctattattcccaggcctcagcctcccaagtagttaggattacaggggtgcgccaccatgcccggctaactttctatttttagtagacatggggtttcaccacgttgcccaggctggtctcaacctcctggcctcaagtgctccacctgccttgacctcccaaagtgctgggattacaggcatgagccaccatgctaggccccagtttctttctttcttttttagagacagacaaagtctctcccaggctggagtgcattggcatgatttagctcattgcagccttgaattcttgggcacaaatgatcctcccacctcagcatcccaagtagctgggactacaaatgtgcaccaccacacctggttaaatttttttattttttgtagagacagggatctcactatgttgcacaggctggtttcaaacccctggcctcaagtgatcttcccccacccaccacctaggcctgctaaagtgctgggattataggcatgagccattgcactcagcctgcaggtatgttttttttttttttttttttttttgagatggagtctcactctgtcacccaggctggagtgcaatggtgcgatgtcagctcactgcaacctccgcctcccgggttcaagcgattctcctgtctcagcctcccgagtagctgggactctaggtgcgtaccaccacgcccggctaacttttgtatttttagtagagacggaagtttaaccatattggtcaggctgatctcgaactcctgacctcatgatccacctgcctcggccttctgaagtgttgggattacaggcgtgagccactgcccctggcccaggtatgttttttattgatggttgaatgttcctttttcactgtatcctgttcttgcaagatgtcatgctttctttcgtctctctgaggaggttttcctttccttcctgcctgcctttctttttctttcttttgtttccttcctcccttctctttgtttccttccctccctccctccctgcttccttccttcttttttttttttttttttttttgaggcggagtctcgctctgttgccgaggctggagtacagtggcacgatctcggctcactgcaacctctgcctctcaggttcaaccgattctcctgactcagccttctgagtaactgggactacaggcatgtgccaccatgcctggctaatttttttaagttttagtagagacggggtttcaccgtgttagccaggatggtctcgatctcctgacctcgtcatctgcccgcctcagcttcccaaagtgctgggattacaggcgtgagccaccgctcccggcaccttcctccttttctttttctttctttcttctaacattttctctgtttccccttatgttcctttttgcattttttaatttgtggttttgtctttcatgtgggatattttcctcaaaagtcagtgatacagggttgtccatttatttttaagaatgagtcatctaggctgggcatagtggctcacaccactaatgccaacactttgggaggccaaggcaggcggagcgcttgaggccagaggtcgagaccagcctgggcaacgtgatgaaaccctgtgtctactaaaaatagaaagttagctgggcatggtggcaccacccctgtgttagaggtgggaggggtgcttaagtccaggagtttgagaccagcgtgggcaacatagttagacctcatctcaacaaaaaataagcaaaatgaactgagcatggtgacaagtgctggtggtctcagctacctggagggctaaagtggcaagatcacttgggaccggcaggttgaggctgcagtgagccgtgatcacaccactgtactccaacctaggcgacacatggagaccccgtctcaaaaaaaaaaagatataaaaaatgagacacctaaaatttaattagaatttttgtgttttagaggaggcttgtctcacaaagacagtttttctgtaggataatcaggtaccagggcccttttcattgggggatgccaaatgtcagttatgtgtaggtcttttttctgaggccttccatttctatgctctccttcagggaataagggcaaaataagtttggttgccagcagtgttggagagaacagaggaagactttgtgggggtgaaagcagggaatggaaggtggggtttcacctctctcttcagtatatacgcttccactgaattatccctttcttcaggtagtccaggtagtcctggtagtcccgtcttctgcctgggtaggggaggaattgtaacctgattggagaaggggagggaatctgcaataccctgttcagcatgctctttatacctcacttctgcccttggaggtgcctgatgactccagaggaacctggtgtccccattcctgtaactttctagggttctgttatatgttttcttctccttcttcttcttcttcttcgtcttttttttttttttttttttcctgagatggagtcttgctctgtcaccaggcgggagtatagtggcatgatctcggctcactgcaacctctgcctcccatgttcaagcgattctcctgtctcagtctcctgagtagctgggactacaggtgtgtgccaccatgccaagctaatttttctatttttagtacagacagggtttcaccatgttggccaggatggtcttgatttcttgacctcgtgatctgcccaccttggcctcccagagtgctgggattacaggtgtgagcccccgcgcctggcatcttcttttgttttttgggtttttttgagacaaaagaagtctgacttgattgtcacccaggctggagtacaatggcgcaatttcagctcactgcaacctctgcctcctgggttcaagcaattctcccacctcagcctccagagtagctgggactacaggcgtatgccaccacacctggctaattttcgtattttatttttatttttggtagagagggtttcaacatgttgaccaggctggtcttgagctcctgacctcaagtgatccacctgcctcggcctcccaaagtgctgggattatagacatgagccactgtgcctggcctctgcttcttattggcttctttccctgtaggtgttggttttctctatttttggttttctttgcttttggctttctttgctttaagtcagctggtgtttatccatttgcttcccctgtgtcaatttccttcctccctcccttcctccctccctcccttccttccttttgtctttctttctttctctctctctttctttctttctttctttctttctttctttctttctttctttcctctctctttttctttctctctctctctgtctttcttttttttttttgagacaaagtttcactcttgttgcccaggctggagtgcaatggcacaatctcagctcaccgcaacttctgcctcccaggttcaagtgattctcctgcctcagcctcccaagtaactgggattacaggcatgcgccaccacgcctggctaattttgtattttttttttttaagtagagacggggtttcttcttgttgatcgggctggtcttgaactcctgacctcaggtgatccgtctgccttggcctcccaaagtgctggaattacaggcgttctaccgcgcctgacgcttccttccttccttccttctttatttctttcattctttctttctgtgtttgtttggaaacagggtctcaccgttttgcccaggctggaatgcattggtgccatcaaggctcactgcagccttgggctcaatctaccctcctgcttcagcctctggagtagctggggccacaggcatgcaccactattcccggctaatttttaaattttttgtagagatgggggtctccttatgttgctcaggccagtcttgaactcctgtcctcacacaatcctcccacttcagccttccacagtgctgggattacaggtgtgagccaccttgcctggtttgggtcatagattttttattcctttatcatcattttaataaggctttgggagggagcagagataagtgatatcaagaacactttttatttagatatttattgagtgcctactgggtacaaagaatcctactagttgctcttgcagaggttggtttcagagaagtgaatatttaaaaaattgactaacatatgattcatatctaaaatatttttaaaattgatttcaagctaggcatttgtcacacatgtttatatattcaaatttagttttcaatatggttatttctttggatattgtagggtctggtggctgagcatgagagtgggtattagatgcttttgaatttatatcttggttttcaccgattaacagtaaggcaaatatgcatttattcattaactcatacgataaacgcaatttagtgcctgctttctgtacaacatggtactggtgttttgagatttgcctaaatgggattagtgacactaacactactgattatttttagaaaggccattttctcttggttttcatgatactaccgtctctttgtttcctacatttctttctggtctccttgatgagctgctctctctctgccccttaaattcttgttctttaggatctaaatttgtcttttctgaccagcccctttaccaatttaataaagtgtcccttcttgattcagggagtagatatcaccacaccattcttatcccaggaaattatatttgaatgtttactggttgctttcttccccccatcccagtagactgtaggctccttaagagcaagaactctggcaagtttcttttctgactagcaaattgatcttgcttttgcagagcttctcagtctttagtgtgcacattaaacacctgggaggttttgaaaattcatatgatgaggccaggcatggtggctcatgcctgtaatcccagcactttgggaggctgaggcaggcagatcacctgaggtcaggagttccagaccatcctgaccaatatgatgaaaccccatctctactacaaatacaaaaattagccaggcgtggtggcatgcacctgtaatcccagctatttgggaggctgagacaagagaattggttgaacctgggaggtggagtttgcggtgagccaagatcatgccattcagcctgggacacaagagcgaaactccgtctcaaaaaaaaaaaaaaaaagaaaaagaaaattcatattctgatccagaagttttggagtgggactgctttgccagttaattttatgtgtcaacttgactgtgctttggggtgcccaggcatttggtcaacattatccttgactgtctgtgaaggtgtttcggggtgagactaacgtttgaatcagtagattgagaaaagcagattgccctcttcttttttttttttttttttttttttgagacggagtctcgctgtcgcccaggctggagtgcagtggcgcggtctcggctcactgcaggctccgccccccggggttcacgccattctcttgcctcagcctcccgagtagctgggactacaggcgcccgccacctcacccggctaattttttgtatttttagtagagacggtgtttcaccgtgttagccaggacggtctccatctactgaactcgtgatctgcccgccttggcctcccaaagtgctgggattacaggcgtgaaccaccgcgcctggccttttttttttttttttttttttttttgagacagagtttcactcttgttgcccaggctggagtgcaatggcacgatctcggctcactgaaacctctgcctcccaggttcaagcgattctcttgcctcagcctcccaagtatctgggattacaggcatgtgccatcacgcctggctaattttgtatttttagtagagacagggtttctccatgttggtcaggctggtctcaaactcccgacctcaggtgatctgccggcctcggcctcccaaagtgctgagaatacaggcgtgagccaccgcgcccagcctaattattgtatttttagtagagacggggtttcaccatattggccaggatggtctccatctcctgacctcgtgatccatctgcctcagcctcccaaagtgctgggattacaggtgtgagccaccgcacctggccagattgccctctttaatgtggattggcctcatccaatcagtcaaaggtctgagtagaataaaagactgaccctcccacatgtaagagggaattcctactttctgactgtctttaaactgggacagcgttttgttttttttttctgcatttggactcaaactgaaatattggcttttcctgagtcttgagtctggctgcttttagattagaaccacaccatctactctcctggttcgggggccttcagacttggactgaaactatatcattggctcttctggttctccagcttgttgactgcagatcttgggacctgtcagcttctataatcacatgagcgttataataataaatccttataattataaattccctataataaatctagtaaataataaataatctagtacaaaataatctagtaaataataaatctagtaaaaaaatacacacatatatttatacatacacatgtgcatgcgtgtgcgtgtgtatgcatgtttgtataatttgttctgcctgtctggagagctgtgactaacacagatttgtatcacaagcttctatgttttatttctgatgctgctggtgatcttctggtagcaaagatatgaaatagagatttttctccaactccgttttaaatttagtgtttaatacaaataagactatacgtaatctgtatacctctgccactttctttttcttaacctgaatgtaagaatcctctataatgctctaaggccaaagaattatgtcattgtttttaatttggctgcacaattaaaaacaaacaaaaaaataattagagtcaatgcacgataatggtttttggaaaactggaattgatccacacattcatgtgtatgcacaaaagaatcctaaaacaaagtcatgtttgtttattctcatgtgtcattatacgtacttttcaaaagttactactctgccttggtgaaccttttatattacaaaatatcgactgtgttagctaattaataaggtcattgactagtttttaaaatgagtgttgttaaaatgccttagtttttattaatcgcatgggctcctaaaaaaagagtaattgaaaatttaattacatcagtgcttttcttcaaataactgaagcttattaaacttcaaatgttcaaacatttaagcatctattgaaataccaatagctataaaaaatgtgcagttctaaacactaattaaacaaactctaaataaccataaagctaagctgaattttaaataactcttacgttttaagtgctctgttccgctcatatacaaggaagattaaccccttcaattctgaccactgctacagccctgtgggcatctcttaaaatgctgtggctgctattgaaccactttcttcttatacttggaccaaaaaggagagactaattagacaacctggaacatgttgctaatgccacattagtactcttggaaccttttttttaaaaaaaactaactgagaatatacagacataaatttgtgtatttcatgttttgtgtgaaaacatacttgctttcttttgtaaaaataatgtttgttaggttttacttttaatttaattttttttggagacagagtccctctttgtcacccaggctggagtacagtagcaaaaccttcgctcactgcaacctccgcctcccaggttcaagtttttctcctgtctcagcctcctgagtagctgagattacaggcgtccgccaccatgcccggctaatttttgtattttttagtagagatggagtttcaccatgttggccaggctggcctcaaactcctgacttcaagtgatctgcccgcctcggcctcccaaaatgctgaggttacaggtgtgagccaccacgcctggccaggttttaattttaaatactcaaagtataaatttcaccacccaaatacatcctataaacattttaaaaaattgatatgaccttctactttcaactgagatggcataattggcaccagaccaggtctcctgtaagaaactggaaaactggactaaacatatgagtaaactcttttcaagcattggattatgtgatttttggacaacgtaattatgagagaaggccttctatttggaagcaataactagattctggttctggaaggagaaccccaaaaaagcggctgggcactgtggctcatgcctataatcccagcactttgggaggcccaggtaggtggatcacctgaaggtcaggcatttgagactaatctcaccaacatggtgaaacctcatctctactaaaaatataaaaaattagctgggcatggtggtgggcgcctgtaatgccagctactcgggaggctaattgcttgaactggggtgggtggaggttatagtgaaccgagattgctccattgcactccagcctgggcaacccaagagcgaaacttcaaaaaaaaaaaaaatgaacagcagttttgctaagatgaagcgatagagattggagtttgggaagactgagttgcttagaactgggagggaagagtttcagagaggaggagctatgcaaaaaaagagctccacaattattgatttttggctgaatactgagctgcacatacatagaggaaaaacatatgaagctgctctcataacatttagagacatttgcattatgactgacttaagtggagaaatcttgtgggacagaagagcatttagtagagctccaagtaaggctatgcataagagtaagcaaagccaggcacagcctagaataaaggctactttagatatcccttacctaacaaagcttaacaacaagctctgatatgaagaaactgatttgcaagtaactaaactgtagagggacgagacgcggacaaaacccctcagacaccgggttaaagaaggaagtggctttatttggctgggagtgtcagcagacttgcgtcttaagaactgagctccctaaaaaagaaattattggcccttttaagggcttacaacactaaggggaccacgttaaagggtcatgatagatcaagcaaacatgggggacataactaagggctacatgcattagctaatacaacagaaagttttgcaatgcttcctcatacaatgtctggaatttacagataacacaagtagtttaggtcaggggtagattttttaatttttttctttaactacaaggaccaggtggtggctccaggccatctggctatttatcttacttttgtttccttttaacttttcgctttctccctttcctcacgtcttaaaaactaggcaaggtggcaggggcggtgggggtgggggtgggtagcaggagaagtggtggtccccacctcatttcccctgtagagaatctcacttattatggggagttctcactttcatcatcagtttttaagtctctgtacatgatagagtgacagcgattcatgtaatacacttgtgttgaagttttctgataaacaaaggtagcaacaaaaacttttatcatttgtaggagcaagggtaatacacaggggaagagcaagcaacttcctattactagcaataaacttacaatgagggttttaaattctcccctagctgaaagacatttttcaaatacagacataggattaaacctctgccaaacctatacaggcatatgtgccaacgttgtcacatccctgaccatatttttgaccaccaatttttgaaaatctattggcagacagcaattgctcaagttgaatttttcacagacctgatattcaggtgagagaaaatagtccaaggccagtctattttgataaatggcatttttgatttgggctttctgctaggtaaaaaagtcaaaacactgccagttttgtcagtgattatttttaggagggcctgcaaccgtatgatatgattgagaatgtagatgggggtttgctactaagaatataagtttttaagagctacacacttgaatttcagggagtctgcggaaagagctacagttatcttcaggcattaacatttttcctttctaagtctactggtcttgtatgttagtccttccaaaaatataatatgaggaaatgcataggctgctggcactattttcagccacttgagcaaataggattttggctcagccctctaagaagctgggaccacaggggccgtgccaccacgccgggctcattttggtatcttttgtggagacggggtttctccgtttggcccagcctgttctccacctcctgggctgcagcgatctgctttcctcggcctcccagaggaggatggccgacgattacaggatcatgcccggccttttccctaaaagaaaacaccaacagcaacaaaacattttgcgtagtcggagttatcagtgtcaactggtggattgagagtttgtgtctaagaagtccttccttatgcactggatgatttcaaaagaaaggagaaaagacaaaagggaatctcacatcttgtacctgatttatgattgcaactagggcgttatttaaaagacgatcagtgaaccaccaaagtagaattgatccgaatgcgttcataatatcttctgaattctgaggtgtcctccaagcagggaggcagtggctgggtgtgggaggcaaaaatcacagggccagcacttgacacctgcaggattcggaggctcaactttgcaccaagccaagggttctggtgtccgtcgcaagtttcgttccccaacccgcattgactttgcattggccctcctccccccagattttatccgtaaggcaagtcctgagtttatcgtcgggagaatcttcccttgtagtctcgaattgccttggccatcagcggggccactttcttggcagcctgttttcgggttttgtccgcgggcgccgcgtgccggttgctgctgccgccgccgctcacgctgccgccgtcgccgtccccgaggccggagggagcctggctgcttcctgcgggcttgggggctggctccatctctccatttccggggtcagcggctcctgcagacttctcttgcctcctggaagcatcataaggcgtcttggccacagagttgaaacagatcatctttgtctgtcggccgctgggtttgttttcacgtgcggatcggattttcgtggtcactactcgcagccgctgctctcgggcgtcccgaagccgcaggtacagctcccgccaagactcgtgctcctgtggcttttcttccttgaagtcctggaggcaatgaatcctccataattcatctgtctctcgagcgagtgcggcattgtctttctctgtgcggtacggctgatcgggcgtccacccttccagaacgggttcaagagccgagtaggggaccccttccacgtcgccgagggcgtccggattgttcctaggcacccggaggcactgctggcgcagcgtcggcacctggagctggcaggcaggcctggagcccgagtacaccggcatcttagcgttcactctgcgtccagggaaagcagcttcctcctggagcgttggcgcggagagtgcttctgggtttgcctgggaggtcatggcctcaaaagcggacagcagatcgtagttggcctgcatccaggcctctgaggggtcccagagctccgagaagacatggctgggcaccgttttcggcccggcggaatcagcgacggccgcctgcagcctctctgactggctttcctggacaggaggcgatttctgagccgaagccccgcgggacgatttgtgccccttgctgtggctccccaccgcttccccctggggttggccctggcagccttgacccagcagaggcccgccctgagcggcgtgagcgtggcctcttccgggttgctccccgggcacagcgggctcagggccctcgggcatcgggaggggagcggtgcgcgttggagggtcccgatgggggccggaatcagctggggccattctggggcgctttctctcggctctgggctcgcgactgggagacctcgggtgaggtctctgttgccccggaggtgttctgcgtgctgtccgtctgtgctcagggctgtgagatgggctcctgggggccgtcgcgttttctgggaagccccaggccttttcccgctcctgaagagcctccccgaagcgctgtcgggaagcgctctcctcagggtcctgcgggtcaggcccggtgtttcggtccacgagcaccagcttcttccaccgggccgctaagtctctggcaaagtcgcccacgtgctggtgcttccgcaggcgcttcaccgtctttctgattccagtctccgccaggatgtctgcggtcatgggcaaggcggagagtttctgcaaatatttctctagctttttcggctccgtcttagtggccagacgcacctgcagcttccccactgcgcgcagcgtagtggaccctgccgccatctcgccagagctgtgcaggcgtcgctgtcctcgcggtcgcggctctgtccgagctcggggcggcggcacaggcagtctggggtggccggtcctcgctgcccggtcgccaggcggcgacctcgggatgtggagtcacagcctggagcgagctgggtcctcggagcagcgggccacttggtctggaacgccggtccttgcagacagctgagcaggcccgcttctgttcctcgggatgtgcggccgcagcctggagtgtgacctgtgcggtgcgccgtccaaggcggagtgaagctccgctgccagagcccggccttatatagccagccccgggcccacccagggctcaagccctgacccccctgggcccctgggctgccccgccccgataggaattcattccgtcagcccaacgcagccaatcggggcggtccacgccaggtggactgctgtgccccgcggggtcattaggttaattgcagcctggacacaccccactgagttctaccgttggccctccatgtacccagcttccacatctgtggattccaaaagacacagagagaatcttcttgggagtaaaagcgaaaataacaacaccgcaagacagaatcgtaggaagaagaaccaacagaggatgacaactctttacctgggattgacgttgtgtgaggggacttggaaacattggtagaaaagtgggattaagggagagagaggaaacaggcgtattttactcctcaacctcggctccatcagcatcaagacccttctggaagcagtgtcttttccccgccgtctagcccatcccttaaagcccccagggtcctgggaatttaactatttccatgcaatcttttttccattgttaactgaagaaaactgggtgccccttacaggttttccaagacaaggaaacaaagagaagtcagcaggcgccaaatcaggattgtcaggtggacgcctcacggtttcccatggcaagtcttgcccagctgcccttgttcgaagaaaggcatgatcaggaacactgtcgtggtggagaagaagtctctggtggggaccttcttcgctccagctttggctaactttctgaaaacgctctgctagcgagcagatgtgatcagggtttggccctgcagaaagtcaaccagcagaatccctctagcatccccgcccccccccccccgcccccaacggtggccatgacctctgctcttgactgctcctctgcagcttcgactggagcactgccacctcttggtagccatggcttcgtgcttggtcttcaggatcctgccggtagagccaggtttcatctcctgtgaccaatcttggaagaaatgcttcaggatcttgctcccaccggttgtttaaaatctcctcggaaaggcttgctctggcctgcagctgatactggtgccacggtttgggcagccgagttccactctcacctttcagtccaaatgaggaaaacagaaccatttgaagtgtctatggtgtcggctattgtttctgctgtcggcggcgatttcgcgtaatgtttacattctcacatgactttctctctctctctctcagtgtgtgtgtgtgtgtgtgtgtgtgtgtgtgtgtgtgtgtgtgtgtgtctcttctgcagaaagataatcgttatagcctgagaatcggggaatggggattcgggtgttaagccttttctgagaattaccctccgtgttgtgcagagaaataagtaaatttgctgtgtttccagacttccagctgcctcacgaagaggatcgtagtgcaatactggcgatgcctccagagctccctgaatgaggtttatcttgtaaataggtgggaggagaattgagctgtcctgggtcagtgtagtaatgttacagcaggatccttaggttgatgctgaattctatctggggtagatttatattttgtgcgggggttgtttcctttctgtgttttcgagcgggattgtcgctgtgggagcagggatctgctaaggtttgtctcgttctccagtaatgaatgagtttaatgggtgcagccgctgttttcagtagcatgccagtgggggcatcgatgagctatgaggggctagagcttgctcggattgtttccttgtgtttgtgttttgagatgcgtttgcttgtgtcatgtttgttttccattttggcaggggaaaggttttccaggaagaaaggttgttgccagtggatttggttccgaggggctggggtttctggctgggagtggggaggggctgcacggtgatcggtggctactccacctccagaaagagcgtgtggcttctctgcctcggggaggatattctgctctcttgtgagttttgcaagccacccgagattctctcttgaattgctgtcaagaaatagagaccggcgttgtctctggccctcgctggggaagcttttctgaggttttgtttttttaatttgagacggagtttggcttttgttgtccaggctggagtgcaatggtggcatctgggctcactgcaaactcggcctcccgggttcaagcgattctcccgtctcagccccctgagtagctgggattacaggcgctcgccagcaagcccaaccgagtttcgtctttttagaagagacgggatttcctcatgttggtcaggctggtctgcaactccggacgtcagggggtccgccggcctcgacctcccaaagcgatgggaatagaggcgtgagtcaccgtgcccggacatgtctgagtttcacagggtcgctgattggattatgtccccttccccggaacgaatgcttttctgtcttccttaagggtagtatctctgtggcaccctgttctggctccttacgtgttcttcaggcttgaaggcctcttttcacgtgcaccggcatccactcaggtgcctgcttccagaagcttcccagcacccactctgctgacagccaagggcacaggactttgatctcttctgctgcccttgctgggttttgccttgcggcttaggtctttctatttctctctctatccctcactgtcggtaacgcctaagaaccaagtttacttaatggtgtgtgtgtgtgtgtgtgtgtgtgcgcgcgcgcgtccgtgtgcgtgctcatgtgtgcgtgtgcgtgtgtgtgtgcgtgtctttctttgtgtgtatgtgtgtgtgtcgtatctggcacacggacctgtgattaccagcccgcgtgaagccaacaaatgccctgagttagaatgcaaactttcaccaaagcttgcaggagctcgtaggaggtgaactcaaggtagttaacccggtcatctcatggtaattagaaactctgcttggcaggtttagacttcctgatcgagaacctaaagaagctgattgaggtgtcgccattctttcacaggggttctggctgaaaagattgggattgattctttgccgtgcttagtaaaagtattttgacttaaggaacgtagcagttgttagcatttatgtatgaaatccaggagttcctttcttcagataaacagcaggtttctttgagatgtgctccgcttgtgtcacccaggctggagtgcagtggaatgaggaagggtcactgcagcctccgcttgcccagctcaggcgatcctgccacctcagccctctaagaagctgggaccacaggggccgtgccaccacgccgggctcattttggtatcttttgtggagacggggtttctccgtttggcccagcctgttctccacctcctgggctgcagcgatctgctttcctcggcctcccagaggaggatggccgacgattacaggatcatgcccggccttttccctaaaagaaaacaccaacagcaacaaaacattttgcgtagtcggagttatcagtgtcaactggtggattgagagtttgtgtctaagaagtccttccttatgcactggatgatttcaaaagaaaggagaaaagacaaaagggaatctcacatcttgtacctgatttatgattgcaactagggcgttatttaaaagacgatcagtgaaccaccaaagtagaattgatccgaatgcgttcataatatcttctgaattctgaggtgtcctccaagcagggaggcagtggctgggtgtgggaggcaaaaatcacagggccagcacttgacacctgcaggattcggaggctcaactttgcaccaagccaagggttctggtgtccgtcgcaagtttcgttccccaacccgcattgactttgcattggccctcctccccccagattttatccgtaaggcaagtcctgagtttatcgtcgggagaatcttcccttgtagtctcgaattgccttggccatcagcggggccactttcttggcagcctgttttcgggttttgtccgcgggcgccgcgtgccggttgctgctgccgccgccgctcacgctgccgccgtcgccgtccccgaggccggagggagcctggctgcttcctgcgggcttgggggctggctccatctctccatttccggggtcagcggctcctgcagacttctcttgcctcctggaagcatcataaggcgtcttggccacagagttgaaacagatcatctttgtctgtcggccgctgggtttgttttcacgtgcggatcggattttcgtggtcactactcgcagccgctgctctcgggcgtcccgaagccgcaggtacagctcccgccaagactcgtgctcctgtggcttttcttccttgaagtcctggaggcaatgaatcctccataattcatctgtctctcgagcgagtgcggcattgtctttctctgtgcggtacggctgatcgggcgtccacccttccagaacgggttcaagaaccgagtaggggaccccttccacgtcgccgagggcgtccggattgttcctaggcacccggaggcactgctggcgcagcgtcggcacctggagctggcaggcaggcctggagcccgagtacaccggcatcttagcgttcactctgcgtccagggaaagcagcttcctcctggagcgttggcgcggagagtgcttctgggtttgcctgggaggtcatggcctcaaaagcggacagcagatcgtagttggcctgcatccaggcctctgaggggtcccagagctccgagaagacatggctgggcaccgttttcggcccggcggaatcagcgccggccgcctgcagcctctctgactggctttcctggacaggaggcgatttctgagccgaagccccgcgggacgatttgtgccccttgctgtggctccccaccgcttccccctggggttggccctggcagccttgacccagcagaggcccgccctgagcggcgtgagcgtggcctcttccgggttgctccccgggcacagcgggctcagggccctcgggcatcgggaggggagcggtgcgcgttggagggtcccgatgggggccggaatcagctggggccattctggggcgctttctctcggctctgggctcgcgactgggagacctcgggtgaggtctctgttgccccggaggtgttctgcgtgctgtccgtctgtgctcagggctgtgagatgggctcctgggggccgtcgcgttttctgggaagccccaggccttttcccgctcctgaagagcctccccgaagcgctgtcgggaagcgctctcctcagggtcctgcgggtcaggcccggtgtttcggtccacgagcaccagcttcttccaccgggccgctaagtctctggcaaagtcgcccacgtgctggtgcttccgcaggcgcttcaccgtctttctgattccagtctccgccaggatgtctgcggtcatgggcaaggcggagagtttctgcaaatatttctctagctttttcggctccgtcttagtggccagacgcacctgcagcttccccactgcgcgcagcgtagtggaccctgccgccatctcgccagagctgtgcaggcgtcgctgtcctcgcggtcgcggctctgtccgagctcggggcggcggcacaggcagtctggggtggccggtcctcgctgcccggtcgccaggcggcgacctcgggatgtggagtcacagcctggagcgagctgggtcctcggagcagcgggccacttggtctggaacgccggtccttgcagacagctgagcaggcccgcttctgttcctcgggatgtgcggccgcagcctggagtgtgacctgtgcggtgcgccgtccaaggcggagtgaagctccgctgccagagcccggccttatatagccagccccgggcccacccagggctcaagccctgacccccctgggcccctgggctgccccgccccgataggaattcattccgtcagcccaacgcagccaatcggggcggtccacgccaggtggactgctgtgccccgcggggtcattaggttaattgcagcctggacacaccccactgagttctaccgttggccctccatgtacccagcttccacatctgtggattccaaaagacacagagagaatcttcttgggagtaaaagcgaaaataacaacaccgcaagacagaatcgtaggaagaagaaccaacagaggatgacaactctttacctggcattgacgttgtgtgaggggacttggaaacattggtagaaaagtgggattaagggagaaagaggaaaaaggcgtattttactcctcaacctcggctccatcagcatcaagacccttctggaagcagtgtcttttccccgccgtctagcccatcccttaaagcccccagggtcctgggaatttaactatttccatgcaatcttttttccattgttaactgaagaaaactgggtgccccttacaggttttccaagacaaggaaacaaagagaagtcagcaggcgccaaatcaggattgtcaggtggacgcctcacggtttcccatggcaagtcttgcccagctgcccttgttcgaagaaaggcatgatcaggaacactgtcgtggtggagaagaagtctctggtggggaccttcttcgctccagctttggctaactttctgaaaacgctctgctagcgagcagatgtgatcagggtttggccctgcagaaagtcaaccagcagaatccctctagcatctcccccccccaccccgcccccaacggtggccatgacctctgctcttgactgctcctctgcagcttcgactggagcactgccacctcttggtagccatggcttcgtgcttggtcttcaggatcctgccggtagagccaggtttcatctcctgtgaccaatcttggaagaaatgcttcaggatcttgctcccaccggttgtttaaaatctcctcggaaaggcttgctctggcctgcagctgatattggtgccacggtttgggcagccgagttccactctcacctttcagtccaaatgaggaaaacagaaccatttgaagtgtctatggtgtcggctattgtttctgctgtcggcggcgatttcgcgtaatgtttacattctcacatgactttctctctctctctctcagtgtgtgtgtgtgtgtgtgtgtgtgtgtgtgtgtgtgtgtgtgtgtctcttctgcagaaagataatcgttatagcctgagaatcggggaatggggattcgggtgttaagccttttctgagaattaccctccgtgttgtgcagagaaataagtaaatttgctgtgtttccagacttccagctgcctcacgaagaggatcgtagtgcaatactggcgatgcctccagagctccctgaatgaggtttatcttgtaaataggtgggaagagaattgagctgtcctgggtcagtgtagtaatgttacagcaggatccttaggttgatgctgaattctatctggggtagatttatattttgtgcgggggttgtttcctttctgtgttttcgagcgggattgtcgctgtgggagcagggatctgctaaggtttgtctcgttctccagtaatgaatgagtttaatgggtgcagccgctgttttcagtagcatgccagtgggggcatcgatgagctatgaggggctagagcttgctcggattgtttccttgtgtttgtgttttgagatgcgtttgcttgtgtcatgtttgttttccattttggcaggggaaaggttttccaggaagaaaggttgttgccagtggatttggttccgaggggctggggtttctggctgggagtggggaggggctgcacggtgatcggtggctactccacctccagaaagagcgtgtggcttctctgcctcggggaggatattctgctctcttgtgagttttgcaagccacccgagattctctcttgaattgctgtcaagaaatagagaccggcgttgtctctggccctcgctggggaagcttttctgaggttttgtttttttaatttgagacggagtttggcttttgttgtccaggctggagtgcaatggtggcatctgggctcactgcaaactcggcctcccgggttcaagcgattctcccgtctcagccccctgagtagctgggattacaggcgctcgccagcaagcccaaccgagtttcgtctttttagaagagacgggatttcctcatgttggtcaggctggtctgcaactccggacgtcagggggtccgccggcctcgacctcccaaagcgatgggaatagaggcgtgagtcaccgtgcccggacatgtctgagtttcacagggtcgctgattggattatgtccccttccccggcacgaatgcttttctgtcttccttaagggtagtatctctgtggcaccctgttctggctccttacgtgttcttcaggcttgaaggcctcttttcacgtgcaccggcatccactcaggtgcctgcttccagaagcttcccagcacccactctgctgacagccaagggcacaggactttgatctcttctgctgcccttgctgggttttgccttgcggcttaggtctttctatttctctctctatccctcactgtcggtaacgcctaagaaccaagtttacttaatggtgtgtgtgtgtgtgtgcgcgcgcgcgtccgtgtgcgtgctcatgtgtgcgtgtgcgtgtgtgtgtgcgtgtctttctttgtgtgtatgtgtgtgtgtcgtatctggcacacggacctgtgattaccagcccgcgtgaagccaacaaatgccctgagttagaatgcaaactttcaccaaagcttgcaggagctcgtaggaggtgaactcaaggtagttaacccggtcatctcatggtaattagaaactctgcttggcaggtttagacttcctgatcgagaacctaaagaagctgattgaggtgtcgccattctttcacaggggttctggctgaaaagattgggattgattctttgccgtgcttagtaaaagtattttgacttaaggaacgtagcagttgttagcatttatgtatgaaatccaggagttcctttcttcagataaacagcaggtttctttgagatgtgctccgcttgtgtcacccaggctggagtgcagtggaatgaggaagggtcactgcagcctccgcttgcccagctcaggcgatcctgccacctcagccctctaagaagctgggaccacaggggccgtgccaccacgccgggctcattttggtatcttttgtggagacggggtttctccgtttggcccagcctgttctccacctcctgggctgcagcgatctgctttcctcggcctcccagaggaggatggccgacgattacaggatcatgcccggccttttccccgaaagaaaacaccaacagcaacaaaacattttgcgtagtcggagttatcagtgtcaactggtggattgagagtttgtgtctaagaagtccttccttatgcactggatgatttcaaaagaaaggagaaaagacaaaagggaatctcacatcttgtacctgatttatgattgcaactagggcgttatttaaaagacgatcagtgaaccaccaaagtagaattgatccgaatgcgttcataatatcttctgaattctgaggtgtcctccaagcagggaggcagtggctgggtgtgggaggcaaaaatcacagggccagcacttgacacctgcaggattcggaggctcaactttgcaccaagccaagggttctggtgtccgtcgcaagtttcgttccccaacccgcattgactttgcattggccctcctccccccggattttatccgtaaggcaagtcctgagtttatcgtcgggagaatcttcccttgtagtctcgaattgccttggccatcagcggggccactttcttggcagcctgttttcgggttttgtccgcgggcgccgcgtgccggttgctgctgccgccgccgctcacgctgccgccgtcgccgtccccgaggccggagggagcctggctgcttcctgcgggcttgggggctggctccatctctccatttccggggtcagcggctcctgcagacttctcttgcctcctggaagcatcataaggcgtcttggccacagagttgaaacagatcatctttgtctgtcggccgctgggtttgttttcacgtgcggatcggattttcgtggtcactactcgcagccgctgctctcgggcgtcccgaagccgcaggtacagctcccgccaagactcgtgctcctgtggcttttcttccttgaagtcctggaggcaatgaatcctccataattcatctgtctctcgagcgagtgcggcattgtctttctctgtgcggtacagctgatcgggcgtccacccttccagaacgggttcaagaaccgagtaggggaccccttccacgtcgccgagggcgtccggattgttcctaggcacccggaggcactgctggcgcagcgtcggcacctggagctggcaggcaggcctggagcccgagtacaccggcatcttagcgttcactctgcgtccagggaaagcagcttcctcctggagcgctggcgcggagagtgcttctgggtttgcctgggaggtcatggcctcaaaagcggacagcagatcgtagttggcctgcatccaggcctctgaggggtcccagagctccgagaagacatggctgggcaccgttttcggcccggcggaatcagcgccggccgcctgcagcctctctgactggctttcctggacaggaggcgatttctgagccgaagccccgcgggacgatttgtgccccttgctgtggctccccaccgcttccccctggggttggccctggcagccttgacccagcagaggcccgccctgagcggcgtgagcgtggcctcttccgggttgctccccgggcacagcgggctcagggccctcgggcatcgggaggggagcggtgcgcgttggagggtcccgatgggggccggaatcagctggggccattctggggcgctttctctcggctctgggctcgcgactgggagacctcgggtgaggtctctgttgccccggaggtgttctgcgtgctgtccgtctgtgctcagggctgtgagatgggctcctgggggccgtcgcgttttctgggaagccccaggccttttcccgctcctgaagagcctccccgaagcgctgtcgggaagcgctctcctcagggtcctgcgggtcaggcccggtgtttcggtccacgagcaccagcttcttccaccgggccgctaagtctctggcaaagtcgcccacgtgctggtgcttccgcaggcgcttcaccgtctttctgattccagtctccgccaggatgtctgcggtcatgggcaaggcggagagtttctgcaaatatttctctagctttttcggctccgtcttagtggccagacgcacctgcagcttccccactgcgcgcagcgtagtggaccctgccgccatctcgccagagctgtgcaggcgtcgctgtcctcgcggtcgcggctctgtccgagctcggggcggcggcacaggcagtctggggtggccggtcctcgctgcccggtcgccaggcggcgacctcgggatgtggagtcacagcctggagcgagctgggtcctcggagcagcgggccacttggtctggaacgccggtccttgcagacagctgagcaggcccgcttctgttcctcgggatgtgcggccgcagcctggagtgtgacctgtgcggtgcgccgtccaaggcggagtgaagctccgctgccagagcccggccttatatagccagccccgggcccacccagggctcaagccctgacccccctgggcccctgggctgccccgccccgataggaattcattccgtcagcccaacgcagccaatcggggcggtccacgccaggtggactgctgtgccccgcggggtcattaggttaattgcagcctggacacaccccactgagttctaccgttggccctccatgtacccagcttccacatctgtggattccaaaagacacagagagaatcttcttgggagtaaaagcgaaaataacaacaccgcaagacagaatcgtaggaagaagaaccaacagaggatgacaactctttacctggcattgacgttgtgtgaggggacttggaaacattggtagaaaagtgggattaagggagaaagaggaaaaaggcgtattttactcctcaacctcggctccatcagcatcaagacccttctggaagcagtgtcttttccccgccgtctagcccatcccttaaagcccccagggtcctgggaatttaactatttccatgcaatcttttttccattgttaactgaagaaaactgggtgccccttacaggttttccaagacaaggaaacaaagagaagtcagcaggcgccaaatcaggattgtcaggtggacgcctcacggtttcccatggcaagtcttgcccagctgcccttgttcgaagaaaggcatgatcaggaacactgtcgtggtggagaagaagtctctggtggggaccttcttcgctccagctttggctaactttctgaaaacgctctgctagcgagcagatgtgatcagggtttggccctgcagaaagtcaaccagcagaatccctctagcatctcccccccccccccccgcccccaacggtggccatgacctctgctcttgactgctcctctgcagcttcgactggagcactgccacctcttggtagccatggcttcgtgcttggtcttcaggatcctgccggtagagccaggtttcatctcctgtgaccaatcttggaagaaatgcttcaggatcttgctcccaccggttgtttaaaatctcctcggaaaggcttgctctggtctgcagctgatattggtgccacggtttgggcagcggagttccactcttacctttcagtccgaatgaggaaaacagatccatttgaaatatgtatgttttcggcttttgtttctgctgtcgttggcagtttcgcgtaatttttaatttctcgtgtgactttttttgtgtctctctgtctttctttttgtgtgtgttgtggtgggggcggggtgtgtttcttctgcagaaagaaaatcattatgccctgagaatcggggaatggggattcgggtgttaagccttttcttataagtacccttccacagtttgtagaaaaataggtaaatttgctgtgtttccagacttccagctacttctccaggagaatcgtagtgtaatactggcaattcttcagagctagaatgaggattattttagtagagatgggatctttttcatattggtcgtcctggtctttaactccttaccttatgtgatccacccacctcggcctcccaaagtgctgaggtagggccttgagcctccccacctggacttttttgagttttatatggttactggcagtgtcacatcccttttcccagaaagaatgctttcttgtcttcctgaaatgcagtatccctttgtctccatcctggcttttttcctgtgtgtgtgtgtatcatatctggcatacgttcctttgattaccagcccgtgtgaggccaacaaatgccctgctttataatgaaaagttttaagaaagctagcagacgtccgtgtgatctgaactcaaggtagttaacccggtcctttcatggtaattagaaaatctgattggcctctttagacttcttgattcagaacctaaataagctgattaatgtgtcaccattctttcataggggttctgggtgaaaagtttgggaatgattctatgtgttacttagggaaactattttggcttaacgcatgtaccagtgattaccattcacttatgaaatccgatagttccttttttctaagaaatagcagttttctttgagccatgctcaggttctgtcacccagcctgaagtgcagtggaatgatgaagggtcactgcaacctctacttgcccagctcaggcaatcctgccacctcagccctttaagaagctgggaccacatggaccgtgccaccatgccaggctagttttgatatcttttgcagagacggggttttcctattttgcccaggctgttcttcacctactaggctcaagcgaactgctttcctccacctcccaaaggaggatggctcacgattacaagatcatgctcagccttttattaaaacaacaacaacggcagcaacagcaaacattttatgtattcggagttatcagtgtcaactaatggcttgtgtgtttttgtctaagaagttcttatctacttgatttcgaaaaaaaaaagaaaggaaaaaggaaatctcacatctttttccttatttatgattacaactagggtgtttttaaaaattatcagtgaacatccaaaatagaattgttcccaatgcgttcatatcttctgaattctgaggtgttctccaagctgggaggtagtggctgggtgtgggaggcaaaatcacagggccagcacatgacacctgcagaattcaaaggctcaactttgcaccaagttaaaggttctggtgtccattggaagtttcgttccccaacccgcattgactttgccaatgcaaaaatccccccagattttatctgcaaggcaagtcctgagtttatcgtcgggagaatcttctcttgtagtctcgaattgccttggccatcagcggggccactttcttggcagcctgtttccgggttttggccgcgggcgccgcgtgctcattgctgctgctcaggcaggggttggcccgcttctcagggagccagcgaaggatgctgctgctgctgtctctgccaccgccgctgctgctctggctggagggagtgtggctgcttcccgcgggcttggaggctggcttgatctccccattttcggggtcagcgtctcctgcagacttctcttgcctccttgaagtatcataaggcgtcttggccacagatttgaaacagatcatctttgcctctctgccgttggggttgtttccacgtgcagatcggatattcgttgtcattactctcagccgctgctctggggcgtccggaagccgcaggtactgctccctccaagttttgttttcctgtggcttttcttccttgaagtcctggaaacaatgattcctccgtaattcgtctgtctctctaacgagtgcgtgattgtctttctttctgcgatacagctgatcgggcctccacccttccagaacaggttcaagaacccagtaggggacctctcccacgtcgctgagggcgtccggattgtttctaagcacctgggcacactgctggcgcagcgtcggcacctggagctggcaggcaggcctggagcccgagtacaccggcatcttagcattcactctgcgtccagggaaagcagcttcctcccggaactttggtgaagagagtgcttctggctttgcctgggaggtcatggagtcagaatccgaaagcggatcgtagttggcctgcatccaggcctctgagaggtcccagagctctgagaagacatggctgggcaccgttttcggcccggcggaatcagcgccggccgcctgcagcctctctgactggctttcctggacaggaggcaatttcttagccgaatcccaggactcacgagtgcccttggattcgtttgctttcctttgtttatctccaagtgcagtggtggcagattttccagtctttttcttttgcttccgcaactgatcgtaggtgaggtatttttcacatgacagagtgggctgctcgaattcctcagccatatctacctcctccacctcagagagggagctcacggacgttctgtccaaatgagcagtcggtggcttcccctcttgagtctctcggtcgttggaaagctgctctttctcctcgggcgacaggccgtgtgtcccatttcctgggtcccggccgtctagactgggcctcttcttgttcgagtgactgtgctgaggcctcttctggtgactgtctggagcctcctccaaggcagggacacgctggccgctgccagcttgccccccttccttgtctgtcttgaagtccgaaggctgcctgtccctggcacttgcccaggagggcatccttggggtttcctctcttaagcaggccccgcatgatttctccctgatcaaagtaggggagtgccaatctccctgggcacacaaggggcgtttttcctggcgagacgatttgtgccccttgctgtggctcacaacggctttcccctggggttggccctggcagcctggacacagcagaggcccgccctgagccgcgtgagtgtggcctcttccgggttgcttcccgggcgcagcgggctcagggccctcgggcatccggaggggagctgtgcgcgttggagaggcccgatagcggccggaatcagctggggctattctggggcactttctctcagctctgggctcgcgactgtgagacctcgggtgaggtctctgttgccccggaggtgttctgcgtgctgtccgtctgtgctcagggctgtgagatgggctcctgggggccgtcgcgttttctgggaagccccaggccttttcctggtcctgaagagcctccccgaagcgctgtcgggaagcgctctcctcagggtcctgtgggccaggccgggtgtttcggtccacgagcaccagcttcttccaccgggccgctaagtctctggcaaagtcgcccacgtgctggtgcttccgcaggcgcttcaccgtctttctgattccagtctccgccaggatgtctgccgtcatgggcaaggcggagagtttctgcaaatatttctctagctttttcggctccgtcttagtggccagacgcacctgcagcttctccactgcgtgcagcgtagtggaccctgccgccatctcaccagagctgtgcaggcgtcgctgtcccggcggtcgcagctctgtctttggggctgcgggacaggaagtctggggtggccggtcctcgctgcccggtcgccaggcagcgacctcgggatgtggagtcacagcctggagcgagctgggtcctcggagcagcaggccacttggtctggaacggccgtccttgcagacagctgagcaggcccgcttttgttcctcgggatgtggagccacagcctggagtgacctctgcagtttgctgtgcaacaaagaatgaagctctggtgccagagctgggccttatgtagcccatcccaggctgacactcacggctctagccctgaccctcttagctcttgggctgccccgcccccatacgtactcatgccgtcagcacaatgcagacaatcgggacggtccacgccaggtggactgctgtgccccagaggttgattaggttaatttcagcctcgacacaccccactgagttttaccgttgaccttccatgttcgcaggttccacatctgtgaattccaaaaaacacagactgaatcttcttgggagtaaaacagaaaataacacagcaagacaaaatcatagaaagaagaaccaatacaggataacaactctttgcctaggactgatgttgtgtgaggggacttcccaaatttgtcaaaacagggattaaaagacaaaaataaaaccggtagattttatttcttaacatctgctccatcaatttcgagacagtagttcgagcactgtcttgaccccgccttgtccctcaagccctgatgtttctgggaatttaactatttccaagaaatcttttttccattattaactgaagaaaactgggtgccgtttgcagaatttttaatacgaggaaataaatagaagtcagcaggttccacatcatgactgcaaggtggacgcctcatgatctccttttgaaactcttgccaaactgccctttgttcagtgaaatgctacagcaagaactttttcatgattaggtagaactctctggtaatggtttttctgctcatgctttggctagttttctcaaaaactctgttagtaagcatatttgatcttggtttggcccttcaaaaagtcttttagtcatatcttttgagcattccccaaaactgttgccatgacctcttctcttgactggtcctctctgtctttgactggagtgctgccaccttttggtagcctttgttttgtgctctttcttcaggactatccagtgtagccatgttttatccccgcttacaaatcttggaataaatatttctggatcttcttccacctgttttaaaactttaaagaaatttttactcttgtctctagctattattgttgaaacagatttggtatctggatcggactttaattttcagtgacaattattaaaacaggatcatttgaaatatctatggttttttctcttatttctgttgttacttatttaccctctcaaattagggaacacttggtcctatgtttctgagcatagttgaccaattctgacattgtattaaattcaataaatgtcttttctggatctgtagacacttcttttgatatttctagcatttttttgggttgtacagcatttgaaagttaggaagtttcctggcagagccaggagatagtcaggaaacaaacaagaaacaaattagaacctacaggtatatatattcaaccttttaggggaatattagatgcagggactgtaaaacagaagtatagtaaagacatttgaaagaagtgatgtatgctttttaactgtttgtttttgagattgaaagcttaatgcaaaatttggatcttattactgaaattgaaacgagctcatgcaaattaatctccattgcacccgtaaaaaggaaattaaaagcactaatgttgcatgtggtgtatatacagtaacatttcctaaatatcttctgggtctaaaactgggaatgatattcaatgcttccttttcctcaggctatggtatcataggattcaattttgaatttgataatggaggtatatttgtggcacaatagcccacaaaggaaatgaaagaaaacaaaaacagccagattattgaaacatgcaaatgagacacctagattagatgttcacttctgggcctcctttctttgtacacagaaattaatgagcatgtaattgtgtccatttcaggggcacaccatctcttacagtttaaatggatcctttttgcggggaatggctcattcttagttttttttaattcagaagataattttctaggttaatttgaatggcctgggcagaaagatgtagatctggccaactttatacctttaattaagaaatttgtaagactgcattctgtgttttcagtaacagaagctcatcttaaatatttaacactacatttggaatagtgtttttaaaactctcttttcctgctttactcttactgaattctgaatttttatcactcttaccacaaaataaaaatcacattattattttaagacctggtcaccacaagtaaaagctgcttcacagtccacatagtaggaaagccatttttttttttttattagagatgggagtctccctatgttgcccaggctgctctcaaactcctgggctcaagtgatcctcccaccttggcctcccaaattgctgggattacaggagtgagccacagtgcccgaccatgaaaagccatttttgatgcagcctcattaccagacagagttctaaaggactcagccaatccccattatagacatcgactcttttgcaaactgtgattctaataaaaaaaaagtggaaattcttttgattggagttgaagtacctgccattttgcagaaatgtaatgaaaaccctgagtaagcctgtcttttaggctattctttcaaaagtatgatcaacattgctcagatttgtttaggattaagaattagacctctgtctcaagaattagagcttttgctttcttatttatcctgattaactgtgttaattaggtcagtggttcactgtttaaatgactctccagggattctaaaaaggagtttgaaggaaataattctgacaaatgttccaacttgcttttattagggttgctatgaaactcactatcctacctgtgggtagtagaaaataaactgtatttttctgcctctgtgtatgtgcatgtatgtgcacacatggagtatttctataatatagtgtaattgatcctctagagtataaattgctgagtgatattgctgggtcgacaggtatgcgcatttttctctttgatagattttgtcaatttgctctgcaaaagggttgtaccaacttacattcccaccaattgtatctgaaatacaatattctttcaataccttaccaaatctggatgtaaaaatgtaaaaaatagctgcactttaaaaaatttgagagtcttattgaaagaagcttatttttgtaccaaaaaactgaagaagtatagacaatagttaaggtggtttcttcaacttgtatatatattgcaaattattataaaacccacaagaaaaactgcaaagagaaatgtctgctgtaaatgaatatgtgaagattctgaacacagaaatgcctgtattactcttctgttcagtaagtctactcctgtagtcacactgatagagcaaggctgggtagtaataaagtgtcattgctacactccaaagcagaaacaggctctgtctgggggctgaaaaagcaggccctcatggtgctgtgtgtgataaccagttcttttacccccatcatttccatcttgaatagcttcaaaatattgcatataatgatttatattttcagttagactatttattttatatatcaagccacaattttacttaaattatttacatttatttaagccttcttttctctgcccctctcccacattttgcattttaaaatatctttattcatataccttacaactcaccatttaaaatgtacaattccatggctttcaagatattcacagagatatacttccattgccttgatcaattttagaaccttttcattagcccaaagagaaattctgtaccctttacctgccatcccctccacccactgcctcctgcagttctcccatcctccccagtcctctcctccctgcttttaaatgtttcttccaggatctttttttttctgttcctctaataaatctaatgagttttccctaatgagtttttcatcccactaatgagggtcttcctctgggtatatgcatgtctgtgcacacatggagtatttctataatatagtgtaattgaccctcctcatctttaagaaattcagccaaacccagtgcagtggatccagtactgaggagcacacagaacactagctactttttctcagtgacctagtcctagagaacatttgcacaagtacatgtttcaattaggaagaagcaaatgcttctagtgaaggatagagagactctgaaatgcatgtacgaagcaactaacagctattgggcacccaccaattactatccctaatattggcatagcacccccacagttttcaaagcactttccaggctttatttcatgtgatgtacaggacactgtgttagaacctctaatatggagggatatggacattgttagaaatgggaccagtcagtgtccaatatagtctttagaaaaatgtagatcactttcatgtctctttaagccaattcccatctttgctttctcaaagacttttacatgcatatgaaatggattagctttatttacagcaggtctgcaactattcagcaattaaaagacataatctcttataagacatactactcctggtacagcagggtgactaaccttttgaaggaggtctagccagtaacagctttggaatggtcactaatattgtgggaaattaggtttgagaaattgtaaaagacatcattcatttattactctgttaggtcaactaggaaagaccggctggtaaccacagttgtttgtttctggcaagtttggcccacaggttttggtaaattaaaatagtggttgtgcagggtatggattttatgaaatgatataaagtagaagattatctctggtctggagtgaatataaattggtgagagaatgatgaggaggagttgatgaaaggaagagcattggcctagaagccaagattctgctttcaactatttgggcttttcagcaaataacatatgcattctctgcatatgttaaaaatcaagtataaaaacatttaatgccttggaaaaatatttataaaatattatttctaaaaataagttatcagcttacatgagagtactactttgtaagaagacttaaaaagtataggctgggtggaatggtgcacacttgtagtcccagctacttgggaggctgaggtgggaggatcacttcagcccgggtgttcaaggccagcctggtaacatggtgagatccctgtctctaaacaaataaaattaaattttaaaaaagaatgtgaccaaaatgtgtttttttctcatggttttatgcattgtaccagttttctaccacgattatttttgtaaatgcagcttgggggaagactgtggtcattaatctatattgaatacaattttataataagagtttcagaagttttttgagcaatggaataagaacatgatctgccaaggaactaatttgaaaccataaacatccatttaaaagcagtaggcctgacaaattagtcactgctttttaaaaaatagaatttattttttagcgcagttttagattcacagccaaattgaacaaagtatagagaattcccacgtacctctctgcatgctcaccttcccccactgtcaacatcccaaaatacagtggtatgttgttaaatcgatgaacctacactggcatgattatcaaccaaagtccattttacatgagggttcatgcttgctgttgtacattctgtggttttggacaaatgtataatgatgcctatcggttactataatctatcatatagaatggtttcgctgccctagaaatcttgtactctacctattcatcccttcctccccgcaacccctggcaatcacttatccttttactgtctctatagttttgccttttccagaatgttatctatttggaatcatacagtatataggcttttcaattggcttcttccacttagtgatatgcatctaaatttccttcatgttctttcatggcttgatagctcatttcttttagctctgaataatattccattgtctgagtataccacaatttatttatccattcacctactgaacgacatcttggttgtttctaagttttggcaattatgaataaagctgctataaacatccctgtgccagtttctctgtgaacataagttttcaattcatttgggtaaataccaagggttgcaattgttgggtcagagtaattgctgagtaagagtatggttagtctttactttaaaaaaacctgccaaagtgcctttcaaagtgtttgtactgttttgcatcccaccagcaatcagtgagtttctgttgctctacatcctcgccagcatttgctattttggattttcaccatcccagtaagtgtgcagtggtacttcactgttgttttaactttccattccttgatgatgtgatgttgtcttttcatatgcttggttaccatctgtatatcttcttttgtgaagtgtcagttcatgtgttttgcccatttttaagtggattttttttttagtgttgaatttaggagggtttgtctgtgtttgtatattttggataccagtcctttatcagatacgtcctttgcaactatttctctcattctgaatcactactttttatgtcatctattttataggttcgaggattatatttttaaatctctttttcttttgaacttctgagagccctgacttttatttattttagactaaattcaaagcaacaactagcttttgaatggcagagagcaaaatcgatcaaacaagtagtacttactatgctcccttcacaaacattttgaaacacaggttgccttatttgttgtgttttctagcactctgaataaaggcttatcatcttaagcaataaaactttctatttgaattcttttggatggatatgtttataaaataggttactgttttacctgcctacttacattgcaaatattgagcataactgaacctcttcattatgactttaaatcataagataatactctaaaaaacaagaataagatgctatgaaaaaagaaagaatcagagaataagaagaagctcctggaaattaaaaatgttattatctaaataaattctgctaaaaaataaggccaaggaaattgctcagaatatagaacaaaagagacaaaggaatggaacactgtgggaaaaaaagtctttaaaaatcagttcaggatatcccctatccaattaataggtattcataaaaataaaccagagaaaaaatagtgaaataatttaccaaagaaataataaagaagttttccaaaaatgagaacatgagaatttctagcttgacaatggctaggcagtgaatggaaaatgacctacaccaaagaaattgtgtaattttagaaccctagggttaaaaatgagatcgtaggctgggcgcggtggctcacgcctgtaatcccagcagtttgggaggccaaggcgggcggatcacgaggccaggagatcgagaccatcctggctaatacggtgaaaccccgtctctactaaaaatacaaaaaattagccgagcgtggtggcgggcgtctgtagtcccagctactcgggaggctgaggcaggtgaatggcgtgaacgcgggaggcggagcttgcagtgagcagagattgcgccactacactccagccccggcgacagagcgagactccgtttcaaaaaaaaaaaaaaaaaaagagatcctaaaagcttcctgggaagaaaaattacattacatgcaaaggatcaggaataggaatggtaatgttataccttttcaagctatcaagcttaaagtagaataaagacactttcaggcatacgaattctcaacatttatctcccatacacctttactcaagagaatgtgtgctattttttgttgatgttgttgctttggtaatttacgaagaaaagaggtttaattgactcatgattccacaggctgtactggaagcatggcggaaagtgtgctattaaaacaagagagggaccagaagagaaagattcagtttctaggggatccaatgcaagaaaatgtcaaagggaaatcccagaaaaagcatctattgcaggtcttagagtcagtctctagagtagaacgggaggatagaggctccaagagggaagcaagaggtgagtgagtagaaaggacacaaaatcttatgtatttgatggcatgggaagtgatatgagatgtgttagtgttttgattattaacaatacgtatgttgaaaagtaacctaataaaaatggggtggttattcatttcaaaaaaaaaaaaaatgtacagaaatggaaaagtaaccatggtatttttggctccacagtgaacaacttttatatggtcctaataatgtaatcagcaaatattgatccaactgtagggaaggatagtttgaaaagggtataagacagcttagttctcatctgtcttaaaggaagtgaatagttaatgcctaacacacatatcatgaaacaatgatatattatttagaaacatggaagtacatatcagaagaaacagctaaaataattaaggttgtttcctctagggcaagggtgtccaaacttttgtgttccctgggccacagtggaagaagaattcccttgggccacacataaaatacactaacactaatgatagctgatgagaaaaaaaaagcaaaaaaaaatctcatgttttaagaaaatttacaaatttgtgttgggccacattcaaagctatcctgggccacagacaaaaaagtagagaggtggttgccaggggctgggggcaggggagatgtggagttactctttaatggaaacgaagtttcaattcgggaagatgaaaattttctggagatggatggtggtgatggttgtacaacaatgtgaatgtatttaatgacactgaactgtacacttaaaaatggttaaaatgatggccaggtgcggtggctcacgcctgtaatcccagcactttgggaggccgaagcaggcggatcatctgaagtcaggagttcgagaccagcctggcgaacatggcaaaaccctgtttctactaataaagtacagaaattagccgggtgtggtagcgggcttctgtaatcccagctactcaggaggctgaggcaggagaattgcttgaacccgggaggcagagtttgcagtgatcggagatcatgccactgcattccaacctgggcaacaagagcaagattccttctcaaaaaaaaaacaaaaacaaaaacaaaaacagtttaaaatgggtccggtgtggtggctcacgcctgtaatcccagcactttgaaaggacaaagtaagaagattgcttgaggccaggaatttgagaacaacttagccaacattgtgagactctcatctctacaaaaaatatagaaatcagccagattagttttatctaggtggtagtgtgcacctgtagtcccagctactgaggagactgaagcagaaggatcacctgagcctagggagggcagggctgccatgagccctgaccataccactgtactccagcctgggccacagggtgagaccctgtctcaaaaaaaaattaaaaaagaaaaaaaatggttaaaatggtaaattttatattacatatattttaccacaataaaaaagcaacttagaaaaaaatttagtattatttgattttcaaatatttatatgcatattttaatttcattataacattaatttttagaaaactctgcatgaatgcctgaaaaatgttttttggtttttggtttgtttgtttttcttttcttttcttttcttttttttttttttgagacagagtcttactctgtcacccagcttggagtgcagtggcaagatcttggctcactgcaacctctgccttccaggttcaagtggttctcatgcctcagcctctcgagtagctgggattacaggtgcctgccaccactggctaatttttgtagtttttgtagagatggggttttcccatgttggccaggctggtctcaaactcctgacctcaagtgatccatccgccttggtctcccagattgctgggattacaggtatgagccaccgcacccagccattgaaaagtgtttctatgtatcatgaatataagtgtttgtgcatagattttgtgatgtaatttaggccacacaaagaccttttatggcttttgtctagttcttacctgtattctacttagataaagatagataagttattttcaaataagggaagtattactgaacatgactattttgtgaatacattttggggcaatttgagataccagtttcctaaatgtagcacattaacactgtgaataagtgcacggattcatccagtttgagcaaagaccttatcatacaggagttgtccttttatggcctctgctattctcagtggctattctaaatccttgcctgtgcagtcacccctgaatggtttgtgggaactcatctctgcatttggcaaggactgggcggggctctgagtgaactacagatatggtagcaggtaagtgcctgtgttgtcacagatgatttctggctcacagctgattatctttttctaatcagtttccttaacctggtcccaatagtagtagatgtacatttgtttcttcacgattataagcaataaaaggccgattggctcggcaggaagaagtccaagtggtaaagagcaatcctaattaaaatcattgtcccttaagtttacaattgagaaggcagctgtgagaagaaaataacaatggaaaacaactttatatgtccttagagacttcaaattgctttccagcctttaagtcatgctgcttggctttgacaggttacatttaccttccagggtttattgccgtaggagcagtgttattttttgttgtcatcctacctaaattttcctctgttccagtgcgagatgaggacagaagcacgacgaaaaaatcttctcattttgatttcgcattatttaacacaagaagggtatgttacagtacaaacatttatagagatgattcctctttctctgctctctacttttccagatgcgtacttttaaatacaatagactttcttgtttagagcaattctatatttacagaaaaatcgagcagaaagtacagagttctgtatgccccttcccttttccagtttcctctcccagtgacatctgtattgatgtggtttattactaccgttgatgagccaatacattattaactgaagtccatagtttacattagggtatactctttgtgttatattgtgctgtgagttttgacaaatgcgtaatggccatgtatttgccaatatggtaccatacaaaatcatttcgctgccctaaaaatcccctgtgcaccaccgattcctcctcctgccccaacaacccagacatacactttttttttcttttgagacagtgtctcattctcttgtcaaggctggagtgtaatcatggctcactgcgacctctaaccacatccccctgctcccagcctccccagtagctgagactgctggtgtgtaccatcatgcctggctaatttttgtattttttgtacagacagggtctcaccatgttttccatgctggtctcaaattcctgagctcaaatgatcagcccacctcagcctcccaaagttctggcattacaggtgtgagccactgcacctggcttcagacttatgcttttattgcctcatttacctagatatttttcacattagatgttgaaaacttttcaacagacctatccagtacataaagtacttttcctttcctctacacatttgaagatagcacagaaatgaggtttttctatagtctcactgctggctatgtgcacaagataactttcttaatcagtttttctttcctcaaaataaacgtattgcatttacttggacaacctaaacccaactctcttcttcctcgcaatgcccattctataactggcagggtgaggaaatttaaaaacttttgggtttggccacctacctcattaaaaacacacaagcaattacagtaagggctgctgctactgtgctggatgatataagagtaagagagctgctccacaaagtgtttgaagggcactatctactttatattcgcttttcttttcaaatttcagccaggaagaaaacatgtaggtttcagactaagagcttacaaacttttttttttttgtaacagatgggggtctcactctgttgccagggctgcatgatcatagttcactgcaacctctaactcctgggctcaagggatcctctcacctcagcctcctgagtagctgggactacaggcacatgccaccatgtccagctaatatttaaattgtttttagagacaggatcttgctgttgctcaggctggtcttgaactactagcttcaagtgatcctcctgcctcaacctcccagtcactgagattagggctttaaaacttttgagttagagcagtggttctcaattaggatgattttgttccttgggagatatttggcactgcttagaggtctttttggctgtcacactggcatctagtgggtataggccaaggatactgccaaatgccatctgacgcacaggacagcccccataacaaataattatctgactttgaatgtcaacagtgccaagatggagaaatctggagttagagcaagaaaaaccaatcaatttttgatattttcccaaaaagtctgataagcatcttttcctccattaaataagggagctactggaactaaaagtcggttttgagactccagtgaccctcgtcctggagaggtacaaaggaaaaaggtgaggagggcaggaggcagttgacaacgaactgagagttcccattgtttctcttacccatgccagcaaccactgctttcaataaacctattgccccctagaaggaaatgagtgcccccgtcccatggttagcagacaggcaggccatcagtcacttctcagcttaggctcaaactctgtatctccacatagcagtggggtggaattgagccccggagcagggcagggctgactttggtctttctgtgcctctgtttctccatctgggctataagagcattcctgaaattgacaagccagacagtctgcatgtgggtagtgggctgctctgctctattcaccaggcacttaagtaaagtaaccccaagggtagcatatgagaaagtgctaagtgttcaatctatgacagggctgtggggcttgttgtcatagggacggcttccaggatatgcgtataaacttagaagccagactcttttttttttttttttttttttttgagacggagtctcactctctcgcccagcctggagtgcaatggcgcgatctcggctcactgcaagctccgcctcctgggttcaggccattctcctgcctcagcctcccgagtagctgggactacaggcacccgccaccaagcccggctaattgttttgtatttttagtagagacggggtttcaccgtggtctcgatctcctgccctcgtgatccacccgcctcggcctcccaaagtgctgggattacaggcgtgagccaccgcgcccagcccagactattttctttcaaatgtctgctcttccctttgctaatctgtgatcttggacaagttacttattctctttatgcttcagttcccttgtctgtagaatggagtaatggggtatagctaagtatcaggtagatgccattattacgaggattaaatatgtaacatgcttagaatcatgcctgacaattacacttatacttctattattgataggatttgggttttattctcttaatacccaacttggttcagcaaaggacttaaagaaactggaatgtgggcttggcccattttacatcatcttttgatggaatctcagctctatccaaagaaccctgagttaaaatacctcaaggtgcttttctgagtgtgtgcagcacttggagcagtagttatacagaatattaataggtgttaaagagttttgtggtcaggtaagcttggcagatattgggttaaattaaactaggtccctcatttcaggacttctcagaccatctgatttactatgtgcaatgagaatatcatactaaagtcacagtattcaaggttttgcaaatcaatttggccaaagcttttccagggttttgttattgtggttgttgttttggagacagggtctcacctatcatccaggctggagtgcagttgcccaatcatggctcactgcagcctcaaattcctgggttcaagtgatcctctcacttcaacctcctgtgtagctgaaactacaggtgtatgccacgacactgtttgtttatttatttatttccttattcatttatttttggtaaagatggaatctcgctatgtagacatagctggccttgaacttgtggtctcatgcaatcctcccacctcagcctcccaattagctcaactgcaggtgcgtgccgccatggctactttttgtttcgttgttttgttttgttttttggtagagatgagatttatctgttgcccaggctggtctgggactcctgggctcaagcgatccacccaccttggcttccagagtgctgagattactggcatgaaccaccatgcctggcctaaggaactcttttttttttctcagaccatctttagagacgagttttccacagataactttgagaatgctgtcttcctagataagttgactcttataaaacttaaactcaccatgccaggtcccagcactgtgaacatagtaacagaatctcagtaaatgttatttgcatagccattgaggaacttactagaatgtagatgggtagaataattagaaacgaagacaatgccattttcacaaattatccctgattttttattacaatgtattttttgttccagaaattgtatcagaaagaagaactgtaaaaacaaaaagataaaaataaaagtcagatgtagttgttaaggccaagtagtttgctgcttacaaagcatgcatttttcctttctgccacgagatggctctttgtatcgtgaatcaatgaaagttctactagaactgatcattttccgaaacctgctgggaaagggacaaatgagtggactgtcaaaacgaaaatgaactataggtatttttaaggacatatgagtgtcaataaaagagatctgccttaacgaagttctacaaattcagcagaggatagattactgtggattaaaataaacaatcagggaaagctttgtagagagggtgacgtgagctggacttaaaagatgtatagaatatgaatagaccgatgtgatgtaaggccattcctggcagaggcacagaggaagaaggggcacagcctaagtggaacaattaagtaaacaagaagaccagagtttgaatgtgtgagtgagaattggtgacagcagacaatggagggtcatggatgctggttcttctattaatagtcctccatatccatcttctcgggcttgggtaattttagtagcctctgcgtctctctcttgtgtcttgttattatggcccagtattgcacactactcctaaagtcccgtcctgtcgctctgttggttaagaatctctagcggctcctcctgccaaccacatcgaattcaaacctcattcaagctcagctcacttgagaccagacgttcgggaccagcctgggcagcacagcaagaccgcatctctacaaaaaataaaataaaataaatagctgggcgtggtggtgcacgcctgtagtccaagctacttgaaaggctgaggtgggaggattgtttgagcccaggagttccaggctgcagtgagccaagattgtgccactccagcttaggtgacagaacaaggccctgtctctaaaaagaaaaaaaaaaaaggttaaaaaaagtttgtaaaaacagaggaaatgttagtcattttctctgaggggcagaattttcttttgatttaccagtattttctagttttttcttaagtgaatatgtattactccatactaaagttattaataaaaaactgatttagtttttctctctgtaaaatgaggattaagacatagtatagaagcatggtgagacatgaaaaagtatagaaggtgattggctagagtcaactgactgtggtttgcagcttctttaaaattagcttaggagagatacatacatttcaaggtcattgaaaataatcatggcatcttcttttaagaaagttcaggctaggcatagtggctcacacctgtaatcccaacactttggaggccaagaagggaatcaattgcttgaggccaggagtttgaaagcagcctgggcatcataaggagaccttgtctgaaagaaagaaagaaagagagagaagaggagggctactaaaaaagaaagttttctctttctactttcctggatctagattcaaatgaaacagaaagaactctaacctgcagcagaaatctgaatctggggtccttggatgagctcctgaaattgtatgctaatttgcacatgtgcacacttttcaggagaaaattgttggttttaaaagaagttaagaactaaaatttaagacctggagagtctttcttctttcagaggattttgagacacagcccttgcttccagtgctaaggccacttatattggacagttttacaactgaacaagttaaaaatgacagtaaggaacaaagatcaaggtactacttttatacagaaacactctgaagtgcaatgtgtgactgattaaaaaattaccagaaacaaataatacattccaagtggatgttatcttatatgaaagttctttgatgatcttgattggtagatctttggaatttccttcagtgctcgagacttgttaatgtgaattacttcaatgatggcaaatttgggttgaatttgggttttatcattttgccaaatgttacctaaaatgaatacctgtgaataaagaggtaaccaagtttgggcagatacccattttaggctgcaaatgagtaaagacaaatcacaagatgtttcttggttgatttacttatttgacttttaagcacttccaaaaacatccttaacaacggtgacatcaccagaataagtatgtaactttcaaaggcaactgctttgaaagataatagttaaatatacttaacaaatatggggctctttataggcaaacctcctatgcacatactagttttcatctaatgtgctatatataggcttactttttgtattgcatccctttagacttgtaatgcctgttagccattattcttttcacctcagttaatttcttctttttattctgtgaaactgccaggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacaggtacatgcctattttctagagataaggctttgtctcatctgtaagattagtgtttctttctcatcttattcccagatagatggagaccctcaccctgcaccaaaggagtaggccaggaggattgtgtagccattctcatatccagcacagacaactgaaatatgattacctggacactgatatccctttaggcactttggcatttgtttgagaaaatgtgttttcaggcaatgaaagcaaaaccccagtgtatcataggtacttttcagatgattagcattactttaatttccttagagatgaaaagaactgttggaagaggataaatgacagaagactttttttgtttttaggagacctattatctgtcttgaaaataactacaaaaatgagtattggggaagctaatagctcatgtatagataatgaaaagcttttgaaagccatcaatccagataatgatcaatataatataaaaacccagtataggttagcagtcaacaaggctggctggaggaaagatctaaagtgggggccctgtgctttgtagtaacattgactgagaagtctgtaagtgggggaagtaattataaaccaagggagatcattgtcctgtttacaagccacttgttaagccacagactttaacatttcatgtagggaccgggaaaccaagaggaacatcaatttaaaatagccagggccagatctcagagctagaaaaggtcaaagaggtattttatctgagctcccttccaatgcagcattcagagcttgacttccttggcaggtggttagatgtgggccttgaagagacagcccagactcctaaacacagggtgatcagcactgttagtgacatgatctcacttccagatggctagttcccatctagcatgatacccaaattctcctatgatattggacacgttatttttattttaactagcagagtatgacttcagtgttccctgccagattcgtgcaatcatcctggtgtcccatgtaatgcagcaaaatggtgtcaagttcatgaaagcgtaatgaaatggtagctgtaaagctagcctatattggagttgccaccaggtccacagtctctgacatgtttaatatctgagccctttgcaatcttcctctgtgaggagatgctggagaagctcaggcctctttctcttcgctggtaatttcagttctctctagatgagaatagcttaaagtctctagattccaattggttaaaactcaaattttaagaacaatgcaaaaaggggaaacatacctgaaaaaaatcactttgtcactcttaaaattattttctttccctcccaatgtctgttttgtcacagcagaaaataatttaccgcaaagaagtagagggaagaccagaaggtaaagtgaatggtaattcttcttaatcgactcggctcgaggagcttgtggaatccctttccagaagctttaccatcacagctctgtgactgtctcccagcaatactgactgcagtcatgtgacctggcccagcccaggacttctctcattacagctgccccagatttgggccaatgtccgtctactctcctggttttactgtaaataagtatatcctgtgatgctctgtctttccaggccatgtggtatgaaaagtcttaacctcaaaggttaaaagacccaggttcaactcctggctctgctatttacaagcatggagcaagttttggacacatagtgagttcctggcacacagtgagcacccaagatataatattttccctcttttcatcatttagttaatttcaagcactcccagatcagatgtcctgacctgtctgaagatcaacaatgagccaggaggtgtgagctcaggcttctggcttcgccagtcctgaccagtggggacccattcttctcttgcttttccctcctgttcacagctcatcttgcattcctttctccagcttctcaagtccaaatctcatttggggcttgtagcctctgatgggagcccctctgtctctggacctttttgggtgcacatattctctcacaaggccccctactcttgccagtgtccttcgcattcctctcgccccactcccatagacccctccactgtcagagctgttcagaaatacccaggggaacaagggtgctgctgccggctgccagtgagggccagctctggggcatcgcaacctgtgggctgttgctattacagtagggcctaaacctcatggaaagacacagccatccaagcagtcaacaaagtgtttaaagtcttaaaatgctcttggaaaaagaaaagttagattgtaatcacatgcaacttattaggccctcaagaggtatggattctgttatgcctccgctacatttcccacccctgcgactccagttcccttgttccagcctcagaaggaagggcctaggacactttacagggctggtgggcacagcttgcaaaaatggctgtggagcccacgcacgctccacgatcctacttgttataatacttggcctcgggctacctttgctttgtgctattctgcaggaagagttttatcgctttgacaaaagtgttattcttttatttatagtttccacaaagttagtcagactctgggtaataaatgataactgcttgtgcatagaaatcatgaggagcgtttgcagccagcttcggaaggcttttggattctatttttctggaaccttctcagcattcttccctggcaaatgctctgtgagtgaatggtgtcagagtgctttgttccccttaggcaaggagcaccgtggcacatttgacagtgtgggggctcctcagctcctctctgagtagatgtttgtatgtggcaagtgtaaaagttgaatagcaaatggttagaatcaggaggaataactaggaaagtaatgaatggtgtttctgcggacaatttatactcaaatatagttactaaaatgagacatgtcatgagactggctattagcaaatcaaagtgtcttttcctaatcttggaaaagatttataatccccacttaaagatttgctgatgaaccaagggaggaaaggttatctaatgtgatggatgacagaaatgggatcccaaaagatcttggcaattccagagatgggttcaaagtaacaagacgaaatttaataaaataaggtttaagctctaacaagagttacaacaaatagctcctccattacaaaatcagagacctggaaatctcagtttacctgggccaacagtgtgacatgagtgctactgtggtcccagccccatcaatagaaatacagtgtccaaaaaataggaggtcacactattctggaaggtgaccagtatgaggaacaatctgggaaccaggtaactttagaaatgactagagcaactgcagatgttgagcttgaacagatggctggtggaggggcactccttagaacattgcaggaacaggcttcagttcaccctctaaagggcgattgggccttttctgccaaattccacagggtgcacctaggactaatggttaaagtcaaagcagagtgaatttggttccatgttcagaagaattttaccatcctcagaaccaatttaaaataaattgcattgctttgtacattagtgctcttgtattttggtcttgttaaagcagatcttggggatcagttgcatccaatgggaaatcaaagtgggaatatagaatccctgtttcctgccagctccacaaggatggtgaggcaagtttaaatacagacacacacacacacaaacacataaacacacacacacacttccacacacacatatataacttctcttgagtcaacactattaatataagtttgcatttgtaaaatgcttggttttcatttcatagatattttatttttgtgccagcaaaagggtagagaaagacattcttattcctagtttaaagatagaaaaaaaaaaccccaagaactgttagtgtccacttctcatgacgctctccccagtgagaccaacactcacagatgtgtcaccatgtggacattggtggtgttatcgacatgtgtggtcttgctggccaaatagttgtgcatttatattagacatgaacatttattatccccataaagaaaggaagttgaaatagcagctctctgagatcactctgaacatggggagacttgcttctaacgaaccttctgcaaatgcatctcacatatggggacaaaagtgctaagagaactaagcaacaatgtgggagttcatgttctgcccccacaagctagtcctgtctctctctggatggcatcttctacagaaaaatatggatattccaatactgaattttatatctaattatgaggatgtagtgaaaaaagtgatttgatctttctatggatatataacatatatacagtcataccacatatataactatgtatacagtaaatgtatatactcttgtaaccacagttacagccaccggcaagctacctttgccccttctcagtcaaattctccccatctccatcagagttagctactcttctgacttccagccccatcagtttgttttgtctgaagtaaacaattgttgatgaaaatttgtttggcaaatatgattggtctgggacaacattgatgaagggaagtttgttttccttctgcaatccccttttgatgtttattactcataacatgctgagaggtattttaagtaggcagggtatatccaggacactggattaaaaccatggggccaatccctggatttcctactgtttcttagtttgaatgggaggactcctttctctctcacacctttctcctggtctaatgctccttttaaggaaggtggaaggaacaatggaagaatgcttgtaaagtaatgtattcttaagaactaaagctatttgcagaagggccgaagctatgtggtgtgaaagggaaatgaagagggtgagttggggggctcgaggaggcaatcttagaagaacccagtgagtagcctggagggtgttagggccaggatggacctggtgggtggatcacataggtggaagggccctatagttgccacctgcatatctttcaatagctttcttaaatgtgctattcttaagaatagttgtttaactacctcaaattaagtggctagaataatttcttccaaggtctttgttccctcccttaggatgatgaacgacagttgtcaaaatcttcccaagatcaatcagcagaggccccggtccaaaaccacagcggggaagacaggggacaccaaatcgctcaataaggagcatcctaatcaggtcaggatggcttggcttgactttgtgaacagcacacttggctgaaaaatagccctatgaaaaaggtcacatttatttattttttgaggacctacgcttttaaaattgctgtgtgatctaattgaattttaggttttcttccagtacactggactaaaaccatggacatatccctagatttcctaatgtttcttaacttgagtgggaggacttttttctcctccaagtttttcccctggtctgggtgctgggtgattggccagggtggggccagggcccagtcagagcgggaaggcctggttgccttgatcctcccatctgaggtaactattacctgaggtaactgagctaaccaagatggcaggtcttcccatcccagagcacattgctaggttcctaagtgtaggccaggcatagcctacactacatttcaggtatggctgggtctcaaggtctcctgttgggctcctccaaatcgcacatggtcagccctcaccccagaccttcatgctggacttcctgggggccaagaagggcagcaaggagagaatccagcaggtgagagaagtcaatggctcctgactcaggaggctcatgtccagaaccttcttagttaggactaaacatcccaggtttcaaaggaaagaggaccaatggaaactgagaaaaggaattaaaaaaattaatgtcaaataacggaaaggtataatcacaatatccgattggtcaaaaggattctctccccctcaaggaggtcctacggttctggccgctgcagcctgactcatgtggaagagaggtgaaggtggggcaggatgagtcccatgggaggctagttgactctgccatatctccaaactcagccactcctggccaaaaacacccctgatcacaggagaaaagacgagccagcgaatggggatgggttgaggcacaactgtttgaagcacattggaaaagctgcttggggcccatggggcctggcatcttctcagtcttccagggacaactctttccacatagtgcaggcagacagctacttcatcttcctgggtctgcacaaatgtggctaagctacatgtgcatgtcgcgttcacagaattgctatccagcatcggactttgcttgatggagtaggcaggtacatccagcaactctccatggctgctcacagccgatgtgtccttgtctctctttcttcaggaggtagttgataacactcgcctggaaagtgccaacttcggcctacatatatcaagaatccgtaaagacagtggagaggaaaatgcccacccacgaagagtaagtgaaactcatgaacctaacactgaaagtggtaatttctttttccttttaaacatgaaaacaaaaaacattatttttgtcaaacaggaaagttaagatgtgatttttgaaggttggctgtgaggtaaatggagaagagcgtcagaaaatgggttcttctttggaatctcctttctgaatgaatgggctggcatgaactgccccatctctaaggaactcagtttccacatttgtaaattgaggggcttggaagagattgtctctagtgttcccatcagcttaaaaattctgtaataacaatgacaaacattggcatgatcatcctgcatcgttctcatcatttttttttttttttaagagacagggtcttgctctgtcacccaggctggagtataatggtgcaatcatggctcactgcagcctcaaactcctgggctcaaagaatcctcttgcctcagcttcccaagtagctaggactacaggcatgcaccacaacatccagctaatttttttcatttttctagagatggggtctcactatgttgcccaggctggtttcaaacttctagcctcaagcaatcctcctgtctgggcttcccaaagcgctaggacatctgcgttatttagtgagttggaaacgcatactcattctgctctgtcctgtcagtggcatttgattagtggtgtcacctttctccttggagggatggctcctggtctaaatgtaatttcatgtggaccatgaaacatcagttgatacagggttgattttgtccttgatagatatttttacctttttcataatgaatctcatgtctagatttctaaataataatgtcttaagcagaaaagacccagattgggtggatgtagtcaaaaggtagattaaaacatgtaatttggaaatgaattgcaccatattgctcttggtcatactctccaaggttgtagttctttaagcttcttctttcttcagccaagtgctcaaacctctggagtgctgacttagttctggccagctcttagaaaaactgaactctgtgtgtgtgaatttggaggggtgactggagcatatccctgaaaatcaagagcagtgacctcactggcctgaactgactccctttaagggcctcacttacatggtaattgctgaagatgatgccatgggaatcaacacctcccttggaaaaatgtctccttgttcaccttcactgcttctattgtgttttcagtcacctttgcctagcttttttgtggcataagtttctcttgtgaatgcctcacattgaaatgaatggatgtttttgattgggtcacaaggaagggaccatttaacccagcacttaacctttgaaatagtctgactataaatcctcttaccagcagaaatgtcctcaaaggcacaatgtagatggctttctccctagcatttcatatgtccataggttgtatgagggtatatggcctggggccaatctcagaaaaccccaggtctgtcatttctatgttagtacctgtgtttgtctgttttgcattgctataaaggaatacctgaggctgagtagtttataaagaaaagagatttatttgactcatagttctatatggcactgggatctgctcagcttctggtgaggcctcaggaagcttttactcatggcggaaggcaaggggacctggcatgtcacatggcaagagagggaacaagaagggagggagatgacctgctcttataaacaaccaggtccctcgtgaactaatagagtgagaactcactcattacagtggtgagagcaccaagcctttcatgagagttcctccccaatgacccaaacacctcccaccaggcccacctccaacactggggatcacatttcaatatgagatttggagggggcacacatccttactacatcagaatccaagctttaggacaccctccctgcaaatttagtaggtatgttgttcttgagggcataggcttcagagtcagcctgtctagattcaaaacctggctcagatgctcccccactatgtaactttgggcaagttggttaagttgttttataatttctccaagcctcatttctctcatctgtaaagtggaaataatcatagcgtcccctttaagtctcatgatgaaaggagagccttggtgcagtgctagcacatagtaaacactccataaatgttaactattattattatttttttttttggtgcatccttgctttttccttcctacctctaggggggacagggtgatattggaaggatcatgggttgggagagagattaagtgggtttaaatcctggccttaagccatttattagctgtgtggccctgggcaaattacttaacctctctggacttactcccacatctatgaagccaggatgtcactcctgactaacagaagtgttataagaattagaagtaggctgggtatgctggttcgcacctgtaatcccagccctttgggaggctaaggtgggagtataactcgagctcaggagttgggagaccagcctgggcaacataaagagaccccacttctgcaaaaaaaatttttttaattagccaaaagtagtggcgcacatatgtagtcccagctctttgggaggctgaagtgggaggatcccttgagcccagaagtttaaggctgcggtgagctatgattacgccactgcataacagagtgagatcctgcctgtctcttaaaggaaaaaaaaaaaaggattagaaataatcctcacaggatatggagaaaagggaactcatacattgttggtggaaattaaattaattacacttatacccaataaatttatacaaattatatacaaaaataacaaaaaagaaatagttctcacaaagaacctttcacacttattttgtacccagcactctattgagtggtgaacgtgtatcacaatccatagacaggaactctcattaccattgtgccaatgagttctttctgcatgtgtaatattttaagaggataagaccatacaggggaagtcaacatataagggaggaagcagatggtctgtgtcaggaactgagaaatactcatgaatttttattcaaatccacttcattctggaaaatgtacttacaattttttaaggtgctccaacttgaggaaatcatcacgtttaatactagtgctggttctttttaaagcttaacttgaagtttgccctatataccagggtctataaatgtgtcttggtttaatgaaactgagttattaagaagagtcttctcttatgttctcatggcataaataaccattcctccctttcagggccaaatcattgacttccaagggctgctcacagatgccatcaagggagcaaccagtgaacttgccttgaacaccttcgaccataatccagacccctcagtaagtggcgaagatgtgacattcatctttcaaattgccaacatccagatgaactctggaaatataattttgagtacagtgaaaccttgagatcaagttaaaggccatagccacctgccatcgtttgtttcaccaagacctgtgcatgcccggggtttcttcctaaattatgaagcaatattgtaatgtgagcctttccgctcctctcatcaggaacgactgctgaaacctctgagtgcatttattggcatgaacagtgagatgcgagaattggcagccgtggtgagccgggtaagatctgatattcaattcacaaatttatggaggcaggctggggcttctggagctttgtgggctgcttcttttattaataacaataaatatgatcatttatttataaagtgcccccacttgcgcaggcactcatattgtttagaggcacaataatgcatgataaataaattatagagtcataaaattacaatatacaaaccccaccatctcatgatagaggccaagaaaaccaagagagaaaaagacttaggaatgaagggacaggtgaaaggttttatagcagagccaagagtcaaggaaagaaagcctcttaaagaagaaaagagtatgtctgcatctggtttaaaaagtcagagcctagaaatagagacgtcgggagtctgatgatatcatcattgaaaatctccatgaaaaacacaattagcaggaaagactaccatccagactacggacttttccagcttgcactgtggaaccagaaggcagtgaagaacaggctttggaattagctgacctgcctttgatttctagatccttctcttgctagctgtgtgactttgggcaagttcctgggaaataaaatagattcctgagttatagggtatttttctaatttctattgcttcatatttaattgaagactgaaacctaggcaggctcagaggggggtttaaaatgatccccaaaattcacagctcctctgagaagctaagggctcctgagctgtctctgttcagctcagcagttgtttcctgtatgcctcttgtgtgtcaggtgtgtgctgtgggctggagacacaaatgtgaacgagtcagagcatagtccttgccctcaagagtttctcatcccagggacaaagtgcactttaagagcatgaaggagggaggggtggggaaagtgttaggaaagaagacaggaaatcgctaagggaaaaagtggaagagggaggctaggagctgttctgggcataggcacttccatgagaaattgcagtttgtgcacatgtcctgtgggccacctaagaagcagggagtggtggggaacgggtggagagaggcagggttcctgaggaagggtgctgtgagcagtacccagggctgagaacacacctatagaagaggggaccttagaaaggcgcccgtcggaggatgggatcatcccatgtgcttgtggatggcttgttctatgacagtgagatgaatgaatagcaaagaaaaggagatggggagaccatctataaggtttttaccagtgagaggggatgagggactgagccaggctgcagtaaccccaaattaatagtctcattaccatttttgcaaaagggtaacatgactatgaggatagaactatagagtggaaatggcctgagatgattccatctggaatcctttctatagtagcataggaggtagaaaccctgctcctgcttgaatgcttacagtgacggagagctcaccacctcatgaggtagtcctgttgagttctgactgttaactttggattgatacaaggagaaactgtcagttgggaaattaaacattaccttgtggaactcaactctagaagaggtcaagaaatactgctgttatctatggatgcttttaatacctaggtaaatgaatcttccttgtgtgccgagatttcactaagaaaggacggtaataagaatgtgagtggctggtgggcctgcatgtagatccaggctctatagacagaataaggaagactgagtcctttctctacccttcaatccaagaatggattgtaaatatcatgcatgaccaaagtacttttataaatactttctctagaccagatgcagtggctcacacctacaatcctagcactttgggagactgagatgggtagatcacttgaggccaggggtttgagaccagcctggccaacatggcaaaaacctatctctactgaaaatacaaaacattagccaggagttggagaccagcctgggcaacataatgagaccccatttctagagagcattagctggtatatgtgggtttcccaagatcgactgtgggacttgagtatgcacagattttggtatgggggagagtgtcggggggggaacagggagaggttctggaaccaatctcttccatatgcccagagaccatttctagagaccccattagctaggcatggtggcatgtgctggtagtcctagctacctgggaggctgaggcatgagaatcacttgaacctgggaggcggaggttgctgcactgtagcctgggtgacagagtgagactccatctcagaaaaaacaaacaaacaaacaaacaagaactttctctaataaaagtgaaagttggctgggtgcagtggctcacacctgtaatctcagcactttgggaggccgaggcagaaggatcacttgtgtccaggagtttgagactgggcaacatagtgagactccgtgtctacaaaaaatgaaaaaaaatagctgggcatggtgtgtgcctccttgggaggctgaggtgggaggattgcttgagcccgggaggttgaggctgcagtgagtggtgatcatgccactgccctccagcctgggctacagagcgagacccagtttgaagaaaaattaaaaataaataaaaatttaaaaaatttaaaaaaaattttaaaaaaataaaaatgaacctcctatggtggagggaactggatgggtggggagcaggagtagcacaaacatctcaccagcatttaaaaaatgtatttatatttttggtccatgtgcatatattacttattaaaaattatataaatataataattagtttcagattttttctgtagtcactcagaatgactttggaaagaaggcttttcaggcttttttgaggaaacactctagatattcagtttgcctgaaacaactcctactgagaaaggccccttagtgactgctctgaggcgtctggtgaaattgaagtttggaaactgtaaattagttatcagtaaaagctaccttaattgattatcctagatggttgctacagggctcttctataagaggagaaaaactgcactttcgctcggttgtcagcttccttgaattctgtagaagcaattgctcctgctggaagtagggaatgatcgctagcgaaaaaagagaaattggtttcagaggagcattatctcctttatgcaacaaattaagaaagtgtttgtgagatcaaggagcaagagcaaggccaggcactggctaggaactatgtttcacagtaaaacctaatgtaagttgaaggcatattctgtagcttctttaattatggttataaatcagcatggtttgctattgactgaaaacaggtagagtctgttgttaggagatttttttttctctctgaaaaataccacaatgtgttatcaatgtcttcttcagggaaaatcattgaatattttcatggcatacctttggtgaactaacccaaaattacaatgtatatatgtgtttatatatatatatatatatatatatatatatatatatatatatataatatgaacagtttttatcaccagcactttatatcctattgtaagtcaagtattctgctgctcccaagtttattacagctgtagaggaaaacatcagttttaaaaaaatgatcaaatgtgcattgcaggacatttatctccataatccaaacataaagtggaatgacattattggacttgatgcagccaagcagttagtcaaagaagctgttgtgtatcctataagggtaaggacgggaagcctcttgggggttatttctgttcactatccattggacaagctgtatgtcacacaactatcaggaagggaagggcaggatgattttctgtccacacgttaactctttgcttgtgtcacagcactttctcaaccctggagcaccaaagcctggtccattctagatcatttaaaatcatattacatattagttcaagacaggtgtctgagctaagtgaaactttaaaatctaagaccatagtatacatgatttgtcagattgattcaaattagcctgctcccttaaaaatattcttattgttgtagaaatacctctggtaggggagaatctctcactttgtttccacagatccttcctttacacccctgcccccctgacctaccctccccaggatcgtctggggctttgcttctggctggttgtgaagactagacagccccttccagggcagtgaccagcaaagccagcctgttgtgctcattacttattactgacaaatctctgtgcagtttacaaactgggtagaaaaatagaaaaacaatactctccatgtttgatttacaaatgggttaatgaggagataagtgataacttagcttttgttgtataacagaccaccccacaacttagtgccttaagacaacaatttatttgtttgtaattccgtgggtaggcagttggagctgggctcagctgggctggctcatctcttttccacgtggtattcttggctgagctcaatcacaggtctgagccatcagccagagtagctggaaaagatggagagactgaaaaggctgggacaagcagtacggccaaggtgtctctccatgtggcctccatcctctagcaggaaagtccagtcctgctcacatggtggcagtgggttcccagaaagaggcaagaaagggaaagttctaattcacaagcatctttcatgcctcttatatttttttgctagtcttatattttcaagtcttttacatttgctaatgtcccactggccaaagtcacagggccaggcccagattcaaatgttggagaaataggctccatttcttgatgaaaggagctacaaataatttgtgaccattttctgtaatctcctgctgttaggattatgaatttattttattgaataacctatttagtcttaaaccactgagcccatgtggcccctgatttttggatgctttcctctaaggagacaaaaatcaatacatttggattctcttttccccctctttctttctgtgttcacacttaagggtaagaaatacactagtgttcagaattaatagaaatttactcaccttttcctctaaatggaactataaaacttttaaaaaggatagaacatctcactgaaattccctggatttgttgtccccatggcattacaagctccatatgtgtggagatttgacatcaggattagcatgaaactaatagctagttgtaattttactaatattccttgccacaccctctcccccattctctaccaacccttgccacccacattcccgagattgtttgaatttgaactaataggagagacttcctgaaggctacgcatgtcctgttcagcgttggtgtctcttaatgcgtttgcccctgaatattcccaacttccaaaacaagtttcaccgtagctctgtactttattcgaataaacctttactaattggttctagtatgtattttaaagttcatacctgctttacaacattcaaaagattgccaaatgctctccgtatagaagtctggggaaaacgatgttatgcatgtaagaaataactgtttaacggagaggaagaaatacctacatatacctttccttccaaaaaaattggtcctttaaaaagctgcaaaaattgtcaggcattctaatcaagcgtgaaaataaaattgggatgaataagatctgtttatttcggtcagaagcagacaaccttaagcaaaaaagggagccctgaatcttagagctgtgctgctttgacttcagctttcccagcttgtctgtgctgagagtatgcaggctgatgtgttggtaccaaacctcatccttgttccttgtttccttagtatccacagctatttacaggaattctttctccctggaaaggactactgctgtacggccctccaggtaaacacagcttcctattttgatgtcagtgttaagtgtgtgtgcagaggatgagttgccccttctgtcctcacttcaggactggggcacacgagagctgagcagtcacttccttccttgtgtgtgagactgacttctgtctataagcagggggatggagttgaaatgcctgctcatcttttatgtgtttctctttaggtacaggaaagactttactggccaaagctgtggccactgaatgtaaaacaaccttctttaacatttctgcatccaccattgtcagcaaatggagaggggattcagaaaaactcgttcgggtaggaattcttaattttgtttttaaaaataagttctagtgtaatacagtggtacaaaatgatgtcagagcttctttgcttttaggtgattttatgtgagatctcaagatccactcctggatcttgattaccagcagcttgggaaatggattgtctattacgtgtggatgttaattgtgcccccatcagcaaaacatgatctcccttcctttgggaatttgatcaacagctctttttttattcatgcaatttaggcatgaaagctgggggaaaaaaatctctgacgtggcatattttttcttcattcaagaagtatttattatttaacatgtacactatatttggttaacatttattgagaggctactactgtatgttagtccctatgctagatactctaagaaagaatcaagaaactttaaacttcattattctttcagatgttctgagcacctttgcttccatagtgcccatagcctgtaagattttttgctttctttttttttttttttttagacgaagtctcgctcttgtccccaaggctggagtgcaatggtgcgatcttggctcactgcaacctctgcctcccgggttcaagcaattctcctgcctcagcctcccgaatagctgggattacaggtgcctgccaccacgcccagctaattttttttgtatttttagtaaaaaaaagggtttcatcatgttggccaggatggtctcgaactcctgatctcaggtgatctgcctgcctcagccttccaacgtgctaggattacaggccaccacgccaagcgattttttgctttctttcagaggttgtttccatctttacaatatcacatttatagttgatgttatattttatattataaaatggtactgaatcttccaatgacattaagagcacttccatttatggtttaggtcccagtgtaagacaggtccttctttgaaatcctgttaaactatcacgctctgtagaatggcagatatgtaatcaatataagtgaatataaaatattacgtattttctgaaaagtgattaacaaattatgcttaaattacattcccttagatgactgtttcaaaatatgatggcctatttggaagtcataatagaatatgtttaaaggattgattttcctaaaataacctattatctattaccttgatatcattttcaagttgttgtaaatatgtaagcttatgtaaattcttgttacccattcaagatggtaatttgtggaaatctacattgatatcttctatttctttgttcttcatcttgcatctaactcagtgccagttccgaagatggggcttgaatttagctgcacctacagttatggttccatgtgattttagttagctggaggttcagttacggttggcccttgaacaacagttggcccttcaactgcacgggtctacttatatggggaatttttttcaacaaaatacagtattcacaggatgcaaaacccgagtatatgtgggtttcccaggatcgactgtgggactccccagtagctgagactatagatgcacaccaccaagcccagctaatttttgtattttttgtagaaaccaggtttcaccatgttgccccggctcctcttgaactcttgggctcaagcaatcctcccgcctcgggctcccaaaatgctgggattacaggcatgagccaccatgcctagcttctccctgcctttctaaatacaagtagaaacatactatgttcccttttgtacctggcttttcccccaacttaatatgcacagattttggtacggggaagagtgtcagggggaacagggagaggttctggaaccaatctcttccatatgcctagagacgactgtagctgaaattcatctcactagaattcttatcaccctgaagtcttttttttttaaatatcatttctatatgctgaatagcaacaaaactcttaaaagataccacccagaattagtttaggttcatctcctgtcatgaaaagtggtgtttggaaccacgagcacaagacactgctaggtacacgaaggaaggtgacatactcttgagacaggacttacctagacagaagaggaaactcaggaagtttataatattcctaacaaagattgaagttacatggattttctggtttaatgttgaatagccagaaaagtcaattaacaagaattatccatcctgtgtgagcattgtatttacttaaagttttcctctggttcagtattattttgttaggattctaagagtgaagaaaagtcccagtggagtgggagcaaaaaaaattaattaaaaaaaaaaaaaagagtgaggaaacaattcctctcccaatttcttcttttttttttttttttttttttttttttttttttttttacagagtcttgctctgtcacccaggctggagtgcagtggtgcattctcggctaactgcaacctctgtcaagtgattctcctgcctcagcttcctgagtagctgggactacaggtgccccccaccatgcctggctttttgtatttttagtagagacagggtttcaccatattggccaggctggtctcaaactcctgaccttgtgatctgcctaccttggcctcccaaagggctgggattacaggcatgagccaccgtgcccagcctcttcctttcttttactatatatttttaaagtaactagccttttaaaaaaaagtataagaggatacacagactcctgagccctctctgcagaggcaactactattaacagttgctggagcagccctgcagaacatttatctattatctacgttagcatcaacaactgtttcttttgggtgttctgtttctgttttgttttgaggcagggtcttgctctgtcacccaggcacccaggccaaagtgcagtggcactatcacagctgactgcagcctcgacctcctgggctcaagtaatcttcccacctcagcctccccagtagctgagactataggtgcacaccaccaagcccagctaatttttgtgtagaaatcaggtttcaccatgttgcccaggctcctcttgaacttttggcctcaagcaatcctcccgccttgggctctcaaaatgctgggattacaggcataagccaccatgcctagcatctccctgcctttctaaatacaagtaggaacatactatgtgttcccttttgtacctggcttttcccccaacttaatatatataacttggatattgttccacactattatagataaagcatgttctttcatatgtctatatggtagttcattgcataaatgtgccaaaacgtatttaaccagtctttgcttgatgggcctttagattgtttctagtctcttgctattatgaacaaagctagagtgggcagtcttatatgtacacatttttgcccatatagtatgggacaatttgtacgaagtagaatcgccaagtcagagggaacagacatcaccgattgccagattacttgccaacagggttgtactcgcttacagtcccatcaatggttcatgagtgtgtttgcttctccacaccctggccaacacaccaatatattttttaaaataaacatttgtcaatctaataccaaaaagtaatagtgtatttcagtgattaaacatgcatttcaatatttcagtgctcgaatatgtatttctttgattctgaatgaacttgagcaacttttgaaaggtttagaaaatatttatatccttttgtgatgtgcatttttattttggatattttaaaaaataattcaagaagaaacagataacctctgctaacctcgaaggaactcgtctcatttcctttcagaaattacatcattttctctttattttctgagcttttgggaagatcctcaactggacaatcttggtcatgctgtcaggctccttactgtgaagctttcaaagaaagcaaacccttcaggaccttcccctaaagcagagaagctttttctaccatttgtttctctttctattccaattaaagagttatttatagggaaccattgggttgtgttcctccctcccctactaatgtctgtgcctcttaggagctgatcgctactgaatagttgagtggtctctttagcaaatgcatacatctgttgatgcttacatctttcaatgcaccgccccccagttgtatgatttaacttcctccaggttcctctgaaaattttagactaatgcttccagaaacacttacccatgattctgtatattccctatgagtggaaagagcaatgcagaggacagtatgaatgcctagactccaggcgtggttctccttccaactgggtgtttggtctagcagaggctcttggtctctctttgcctttagtgagcaccttaaaaacatgtacgggttttatattctaatatttcattcctcattgggtagattgccactgtcgtaatcacccttaatatcaggtatatttgggcttctttgtgtatgtgtgtgacaaggacggaaagttatttgccctgaattaggtggtctccattgtatctgaaaggcattgtgatgaatgccccagcattgccattgttctctcagttcattaaactcagccagttgttcctataaaacaggattctgtaaaagggagatgctggtgcatgcgcttgaatgtacccacgagcagtggggaaggtgaggtatttcctgttcagtgacagggagacctgtaagggatgagctgctgctgctcgtgaaaaccacaacctgactttttcagaaccctttccctctaattctgtgatggtttgctagtgctaagtgacatggagaataaatcccccatgcctattaaagaatctctgttcttttttaaatctccactgttttttcccatcaaccagtgaaggattgtatatgatgctcaagagatcagtttcagggttaaaaaaataaaggtttaggttgttatattctattaatcaccaccacatctccctttagagctctttattttgtttttatatgtctgttcttttgccggttgctttcctgttcttgttcagtctataatattttattttattctcaaatagaacatcgtattcaattgagaattgccttccgtacctaagcctaccaagcagccttgttgaggtagtgtgggaaggctacggagtaatttggagaacacaaaggggctaaatttgtcagccttgttacccatgatgggaacccaatccttcccctgaaatcctttcttctgagaataacctcccattgttcccaaagattaagggaagaattatcaaatgattatacatattccaaggctcttgtgtccatatggaacatattattggcagggtgtttcaggggttaactggccaactgcaagcttgggaacctaaatttatctgaagctctcatatttatgattagtaaccttggagtaaccacctactctctgcctctaattttatcaagtgataaatggaaataatcggaccatccaaccccatggggtgaaggtagggagaaatgattgtaatgattataaagtttttgtgaaataacagagtgcagcataaatgcttattattacagtcattctaagtttttactctgggagcatctgaggactttaagtctataagcttgaacacttgcttgcttttcccccacccaggtgttatttgagcttgcccgctaccacgccccatccacgatcttcctggacgagctggagtcggtgatgagtcagagaggcacagcttctgggtaacagacagggttggggtttttgttgttgttgttttttgtcatggcttctcccctcttgtgtgtttgatggtcggaagcctatagacatttactagcagaatgagcccattaataagcccacaaattttctgcagacacatggaaaggtctttaaattagatcctgttaactgaatagctgatttaagtagtttttataaccggaggaaatgccattctcccttcccccgttccccacagagtggttttcaggcctgaagatcctctagccccaggatcccaggctgccatatcggttctgctggctgaaaatagccgctgtgatggcctcctctggagccagaggggctgcccctggggaatgagtcttgcccactcagccactgtgcagggccacgtctgtacttcactcctgagaggcagtcctcgacggtgtgtgaagcctgggaaaacaccacttctctgtggcatcaggttatggctcagcagggctgactttaaatatgttacatatattatctctaaagattgtcactgaatatcctcagcaggcaggaacacttctcagactgtaataagccttctgtttgtgcttccaaaagccagagtagtgttgtgctttttgttcgttcgtttttaagatcagctttctgtcttgatcagaggtattttccactgaagctttttactaaatctggcacccctggcttgaaaaaacagatctctgagaaatctcaacacagctgcatttattaatgacctttaatggactatcatcaaggcagaagtaatagtaataaaacacaattaattagcttgttggaagtataactataatataatttatgaaattttactcattggaaaccattttcccagcagggaaaagcaaccataaagatgtacccaagtaatatatgggattcatgtaattgattgaaacaggacattttcctcagcttaactggagctggtgcttgtcagccctaggctggagcactctgctttctataccaggcctgatagaagcaggcaactgcacaggcacctagatgggaatgcaccagcccaccctcatagtcactctacaaagaccaggtctccctatgcacttgttgttacgtgtgctttgtcgagctctgtccccagtttcccacaaccttcatcgagctaatgtgaagactcttcatctgctatccttgtgtgtgctccaggttctgccccgaatttccatttccctgtctgggatcaaagactccaaaattaagagtcttcaaagggtcaggaaatagggatgggtgctctgaagacttcgataatattatgttaaaggaattatagttatgggcaaatgataattaaacatatagcaaatatatgggcaaatgctaattatatattatgcttataatatataataaataaattatatatatatatatatacacatatatatatagagagagacggtcttctctcttaggcaaaggtagttgagtattaaggggcatagatcctaaaaaaacatatacctagccaggcagggggcttgtgcctgaggtcccagctactcaggaggctgagggtgtgaaagtactttcctgtgtgctatgtaagtgaaagggattatcctcaattatgtcatttttaaagaggtaaataatgctgcaggtagacacagttgggctgcatttaatctaccagtgggactgtggaccctttagttattttctccagctcactgcctgcctttggttttctttcaaataccatcattatattcatttacttgctttctatcatactgtatgtgaaaataacagcaaattgctcattttctctaactctagtatgaacggctccattggccatcagaacagaaactgttctacagtcacagggacattgctgtgaatgctgctcttgtcatgagggcgaaggctctgacacttaggagaatcacgtcttgtctctctgtaggggagaacatgaaggaagcctgcggatgaagacagagttactggtgcagatggatgggctggcacgctcagaagatctcgtatttgtcttagcagcttctaacctgccgtggtaagagaccaagagagtaaattttgaatacattttcaggagtcactaagtgcaaataaaaattttatattgaccacttcaggcaaagctgtgttgtttggctgcagccctggaagattaatgtggaggctttactgttcaggtccccaatccttgctgtctgtaccacgaaagatctgccttaacagaggaaacacaggccagggtgaccattaacaatatttaaaatggacatttcaagattaaagccaaattacatagtttgtttaaattaagtaggactttggcatagaactacaaaatgcttaaaatctccaggactcaaataatattccagaaataatatgtttgaattttatagtattaaaattaaacttttttaagttaggaggaaaatcttctctttaatgctgcacagtaaatagaaaggtaaataatctctaatggaaaatgtaatctactctcagagtcttatttaaacagtgtcccagagtggtttaagaacaattctagatgtggaattgggaaataagagatgttgattagggaaaaacaatatctacttggagaatatattttaaaaataagtataagccctttatagttctgagaatgttttcacatacattatttctttcaagcttcaggcaaagcaggagacagataaagggaatgctgttcttcccattctcagaggggaccaaggtcaagagaggtcaatccaccaacatcaacaactcttgtagcctagctgggacttgtgacctcatgcccctcacacccatctcttgctctacattcaaagatgaaaagagaaactcttctgtagtgcatgctaattatctgggaccccccccaaaccagaagtcattgaaaaaaaccataatgttcatttgtaatctgttattttaaatatactcataatttaaacctggctccacctccccttgaatctagaatactttctctacttgctcaggtgatcagcattttacaatttgaagatataggatctatatataataatatcaaagtggagtccaaacagagaaccgtcattgaaatgtgattgtggaaacttttagggaaggaatcttctttccttcaaaggtttaaaacaaggttgatcataaccactgggggtgaatattagagtcagctagggaggcagaaaaactgtaagtcttcaggcatgaatgtgggaaggtctgtgccctggggagacctacatattttctggaagaatagaggaccttctacccccagtgaatacctaagaatttgttgagaaacttattgtgctgtttcgattttcctaagcccaaataaaatggttcacagaggtcaaaaaaccaaaaacaaagcaaaaaacgcataaaaattgaataagcttataagggcttttccaaaaatttgcttctcaatgtgtcagctggcaaatacatatgtgcttttgagcttatgttccttatatcattgattgcatcattacaacgtgccttagaaccaatatgttctaactcatatatcctgttttattatgaaaaattcccaaaaacactaaggaaaggaaaaaagcagaatgaacccaccatctccccgttttaataactaacaccatcttgctcaatttatttcatctattccagcaccaccccctgccacttctttgctgcaatatcttaaatcatattcaactattatgttatttctcaaatgtacatgttgaagaaaaataaggactttttttacattactacaaagtcattatcaccctaacataattaacagtgattcctgtttatattcagatttcccaatttgtttcaaaactctctttaccattgacttactgaactggtatccaaacaaggtttgcactttgtaattggtcattcccttaagtctcttaatctagaacagacggcctcttttttttctttttttttttgagatggatccttgctctgtcatccaggctggagtgcaatggcacgatctcggctcactgcaacctctgcctcccgggttcaagccactctactgcctcagcctcccaggtagctgggactacaggcgcctgccaccacgcccggctaatttttttgtatttttaatagagatggggtttcaccatgctggccagactagtcttgaactcctgacctcaagtgatccgcctgcctcagcctcttttttttttcttttcctccacttgtcattgacttattgcctgccagagggattgtcttgcaggatgtccacactttctggattaggctcattgtgtcctcatggtagtagggttgttcttactcctgtaattagactaaaggttagatagattatattcaggatcaatagaattttttggcaaacacacttcataggcgatgctgtgcacatcacgttgcattatatctagaggtatgtgatgtcttgttgctccatttttggtgatgctaagattgatcaccgggttcaggtgtgtcaccctggttccttgcctgtacagctcccatcaatggtgtgagcatccattgatgacctctgcctgaatcagttatttcaccaggggtacaagtctatcatttcctctgatcaacagctggaattattcttgataacagaactttccctcttccagtaaggttatttggtaaccctgaaatatagttcatactagaaaagcaggatttttttctctttgatttttagttgtgagttgatgccacagtgaccttcagtggcaaccaatgagtcagccatcagcttctttctctttcactacaagctcatgacttgtttggtacaaccccattagtttcattttttccccctaaaattttattgagatataactcacataccacccaattcacccatttagagtatacgattcaatggttttgagtgtatttagggttgtgcaactaccaccacaatcaattttagaacatttttctttaccccaaaaagaaaccctgtactcattagcaaccatcccatttcccctatgcctacatcagcattaggcaatcactgatctattttacattcttgtagatttgcctgttcttatacctatgagtagaattattgggtcatacggccactctacgtttgattagttgaggaacagcccaactgttttacaaagatgttgcaccatttcacatgaagcaaattcacacttcacaagcaaaggatgagggttccgatttctccacaacctcgctaacgcttgttattatatgtctcttttattgtagccatccgagtgggtaagaaatggttttgatttgcatttctctgagacaaacgatattgtgcatcttttcatgtccttatgggccaattgcgtatcttcttgggagaaatgtcttttcaaatcctttgtccactttaaaatttttctttttattattgagttataagacttttaaaatatattccagatacaagccctctattggatatatgatttgtaaataatttctcccattctgtagcccttccttccttcctccctccctccttccttccctccttccctcctccctttccttcccttccctctttccttccttccctcttctttctttcccgccttcttccctccttccctccatcactttatccctccctcttcctctctatccatcactttctttctctcttccttcctttctgaacttttttattccttttttttctctaccttgctaaacttcccatgtgtgtctcatttcccaagtcttggacctttcagaagaccctgtacctggttattcaacagcggcactgtctaatagaaatataatagaaatatattgtgaggcacatgcatactttcaggttttctattagccacatttttaaaaagtaaaaataaattggtgaaattaatgttaataacatgttttatttaacacagtattttcaaaacattattttaatatcagtataaaaattagtgtgatattgtagtttcttttttcatactaaattggaaaaatccagcatatattttacacttacatcacacctcagtttggaataactgggtttcaatacccaaaagccacatgtggctggtgctaccatatgagagagtacagatccagagactcatttgtcttccctcatgctgctgtggcagaaatggacagttgcctcccaacatttatttcaccctcggaatttaagaatagaacttcaagttgggggttctgtttcttagtcttcccctactgttaggtgtggtcaaggccaagtttccttcttatatgtgcaggatgactcagctccattttgtacattttgctcctagaatcagccacttattcatgaagcccttgtgcctttagtgggaaatgatgttaatattcagagattacagtctcacaattaggccttttgattagacagagctaggaaatacgtatctttaaaaagaggcaaataatgagtccatgctagtatttcccattcagatttaggattaatatatttgattttatattggtatcttttctctaatagtgaaaatctcagttcttagcattaatgtaattaatactcactttatcccaatatgtacaaatactgcatatgtgtgtatatcacagagcttctcagtaataacaccaatactatcttgacagtgacattctgatgtggaaaatggtactgacctggcctaactaagatgaaagagctaatgtgggatttctcaacctcagagctactgacattttcaggccagataattctttgtggtgggactgtcctgtgcattgatgatgtttagcagcatctctggcccactatccactagatgccagtagcacctcctccccagcagttgtgacaaccaaaatatgtctttagacattgccatatgtttccttggaggcaaaatcacccccagttgaggaccactggactaatctaaggatttgataaacatcacatagagataagctgacacatattccacagctaaactcacaatgtttattaaaaaaataaaataaaataactgaacttggttttcttacacatagtttattacataattttttctgtatcttgattttatcttaacaaaataccctgccaatcttttcaaataagtatataaagttcttccttgctccctttatagctgcgcagggctccattttgtgtgtataataatttatcccaccagccacctaatgataggcatttgggttaatcctattaacccaaattaaaaagaatgctgccgtgagcagcagtgtggagaccacactttgtgtatttgctagtgtatctttggggtaggttccttgaagtagattttgctgggtcaaagggctaatgtgcatgaaagtatggtagagcctgccaagtttccccccgcagaggttgtaccactttgtattcccactagtgtcctgctttcattacttaacatgacagcaagaacatttccaatgtcattaaatcatccttgaaaattggattttgtaatggctgcccaaaattctcacacataaatataccatcatttagttaataattccttccctgttgaacatatatgatgatcccaaactttctctgttagaaataacactgaaatgaatttccttgcataaaaatctttgactaaagttctggttgtttccttaggacagatttccggaagtcagtttactgtagcagagggtttagatgtttcttaagtcccttgtgacacattgctgatgtccttctatgagaaaatagtgtattttttagcaagaatgtgggaacagatctttctcttgacttcagggtcttagatgagggagtagacttatctgattcaagcagtctgtccttctaggggaaataactaaatcataccaagtgatctaaagacccagtcttaaaatcccaaaagaaattccttacagttagtggcagttctcatctattgcatcgtccggggcactaggctattctttactgctggttgacttaccaccattttctctagacacatagattccgtctcaaaggggcaatcattttctcccttcccagcagtgacaggtgtgcagcctttgtttattcagcccttctcctccaaagagcaccttccctagtctatagcatcacagagaggaccagaagaaagaacagctcttgtgtgtcaattgatgtataaacaagcaagaagaggaataacaaatgctgcaccttcaatattactgcttaaaataatagccatgtaagaaatttagtaaacacagttagaatttgatgtgccttgattgttgagtattcacaaactcaagcctaagggtcaggaaacaaaatactgaacaggcccattaaggcaaatgtcatctttaaatacctatttaactctctgggagtttgtacaaataaggtgtgaagactaaatatatgaagcatgctgaaattcatgttttccttgctgtttgtaaaagggctagaaatcccagcaactctcttaaaaatcagacacctggtataccaagctctggatttaaaaatccctaacatttagaagaaaacttaagatccaagagatggaataaaatggttctgattcacttgcaggggaaatcagcaaggaaaagagctgtcagtcagcagtggctcacttgtgtcatcgcctggtgacttcaacttcttttttcagccaaatttgaaacccgccggggcaactgctaacagggatgtctttctgttatctatgttaacctacttcttcctacatgaaccctctcctgctggtgtaacattgctatagcaatgcatgcatgtgattggagggataagcagatgtaacccttgttctttccatagtaaccacatgcatttttgggctccaggaagaagctgtcctccctgcctgcaatcaaggtcttgattgtgccttcactagatcaacatttttccaaaagcagtctgccacaggtcagcaagcattgtgcaaaaaatgagatctagtggcctggtatgttcaggagataccaagttaaagacagttcaactggtttcccccagcagggttgctcaatgtctttaaaatacgactgtgggccaggtgcagtggctcatgcctgtaatcccagcactttgggaggcggaggtaggcagatcacttgaggtcaggtgttcaagacctgcctggcccacatgatgaaactctatctctactaaaaatacaaaaattacccaggcgttgtggcacgtgcttgtagtcccagctactcaggaggctgaggcaggaaaatgacttgaacctgggaggtggaggttgcagtgagttgagattgcaccactgcactccagcctggatgacagagcaagactctgtctaaaaaaaaaaaaaaaaaaaaaaaaaaaagcctgcctctggactcttgtactcacacttacctgagtctagaatctggaatgcagtggcacccccaccaccgtctccctccccttcagatatctgcagggctctgtaggtcaccttcaggggtctgctctgatgccacccactcagcatcctattcataattgcagccccggccccagctccctatgctgcattcttgctttgtgtttcttcctgtgctgttaccagaagtgatactaatttggaattaatggcgattaagctttacagccccttgatttcctgggacccttccttggctcatggagagtccccagcaatgtcctcatggtcttcatttttgcaaaatttgtgaaatggtagttttattgctggaaccacttttgcaaaaattatataacagttagaagattatggcagtgaaagagatctgatctaaccaacctccatcttgcctttaatcattcctgggctcaagccaagctaactttgggagacatttcgtttatagtttaaatgataataaccctttttgaaaactatgtggccttcctaaagctaatgcaagaccaccaggttagaaggatgagaggagcctgaagtcgttaacttccccagttactcctggagataacatcactattgtagaatctaagtaagattggcctttagagatgtcttttaaagtttttgcatttctgatgacccacgactccacgtgaacccaccaactagtcccatggccgcccccagaagaggactactttccatactcccattcaattgcccaccaaactatccttgaaaaagcctagcctccgaaatttgggggagattgatttgagtaatgactccatttcccatgtggcgtggccaggcttgtgtttattcaactctttttttattgcaaataaataaataaataaataaaagatactatttgcaggctgggaatggtggcttatgcttgtaatcccagtgttttgtaagactgaggcaggaggactgcttgaggccagcatggacaacatagcaagacctcgtctctacaaaaaaattgttaaaaaatcagccaggcgtggtggtgtgtgcctatagtcccagccactcaagaggctgaggcaggagaattgcttgagcccaggagtttgaggctaaagtgagctatgatcacaccactgcaccccagcctgggcaacagagctgcaacaccctgtctcttaaaaaaaaatgctattgtgctttgtgactctctatgaaaaataagataaagcagtactttccacacttatctgaccccactcctttcctcaaggagtatctcacaagtctagtgttccatttgaaaaccttttggaagacattagtttgtattacctcaccctgatctgatgaatgcatttttcattgcaattgccttcagtcctgcctgtaggctttttttttatttggagacagagtctcgctctgttccccaggctggagtgctggagtgcagtggcacgatctcggctcaccacaacctctgcctcccgggttcaagcaattctcttcctcaacctcccaagtagctgggattacagacacccaccaccatgcccagctaattttttgtatttttagtagaggtggggtttcaccatcttggccaggctggtcttgaactcctcacctcatgatccacctgcctcggcctcccaaactgttgggattacaggcgtgagccactgtgcccagcctgttattcatctttaatagtatttttgtgcctactagtggtcaaaccattttgcttggaattacttacatacaacacttcactatcccacacaataatatcaagcccatgatcttccatgtgtgttttacgggtaaaacccatatgacgaggaaagaagtatactgtgcaggatttggtaggtccagtggggaaggcacatgatgactagcaggaggttactaagcagtaaccttgctcttgcttcgttcacaccttactgtttgatctcatcagacaaaaacaactttcaacctggttattctggcattaccttttcttcttcacagggtgtaggttgacatgcgaatcatacatttcaaaccacatttaaaacattataaaattattataaccattttatagaaaataggagaattagaaaaaatacttctgatttcaccactgtgactcaagtattaccatctttgtatctacctttctggtgaaaatggtttagttatttatcatcttttgcttccatatccttctctggtaatgttttttgttcccaagagaaaaacagtttttactcttttggttattttaaagtaatagttgtttattataaaaatcataatttatatgctttattattatttgaaagtgagtagtcttcacaatagcaaagacatggaatcaacctaaacgcccatcagtgatagactggataaagaaaatgtggtacatatataccatggaataccatgcagccataaaaagaacgagatgatgtcttttgtgggaacatggatgaagctgaaggccatcatccatagcaaactaacacaggaacagaaaaccaaatacctcatgttctcacttataagtgagagctaaacaatgaactcatggacataaggaggggaacaacagaccctgaggcctgcttgagggtggagggtgggaggagggagaggagcagagaaaaataactattgggtactgggctttgtgcctgactgatgaaataatctgtacaacaaacccccatgacaaaagtttacccctgaacctaaaataaaagtttaaaaaagtgaatagtcccctgtaactataccatggaaaatgatgtaagtctctccaaactcttttacatctgtgtgtgtgtgtgtgtgtgtgtgtgtgtgtagagcacatacacagagcaacaaaaatgcgttgtcctgtagatacaagtgatatttgttctatggcctgttttttttccttcatttaatctattgtggacaactttgaaaatctgcctaatcccacataaaactccattgtatgtgtgtaccataatttatttgacttttctttttcttgagcgtttttaatctggtgccagcctgttgaacaccttttcccactaccatgactcagtgccctgctgggctccacggacactctaaggtcggggggcagttcttcgttcagtgtttagctggaatagggcaggtattattaaaaggttttttattctggtagaccgcctctcctcagtcctttggctagcgagagcaggcttgtcatggggtgtttgaatctgtgcatgttagcagttctgaattgcaggcttctcctgcattctattgggatagatgggaagtaaagagaaaacccagggaactcactgccacaccattcctcaagtcccaaggtccctagctagccagtcctcatctttccaccattcaatgtctctccatgtttatttcttgtattatatccagggatttttagttgtaagagggtgaactagagaagaatgggctactccatcttggccaaaggaaaagtcttgttcatatttttgttcataaacataatttattttacactctctatcaggggagtctatttctgttgttagtttttttctgccaggtctcatttataatggtttattatgtgttttgtaattttatattaattaataaatttattcattcatttttgagaggggggtctcactctgttacccaggctggagtgcagcgatgcaatctcagcccactgcaacctccgcctcccaggttcaagcgatcctcccacctcagggaccacagacgtgtgccaccacacccggctagtgttttgtaattttagattgttagcttacattaatgaagttgtctctatctgtgggattcttgcatgggtccctccagagaatatttgttttactgtgtcagtctttaaatcacttttagctaatttccctgttcagaattttttggaccatgccaataagaggagatctgtggtcctaacttatcagtgaacactttctcccaccccaaagtgcaaggcagacaaatttccctggtgccttccattgctagtggggagatttcctaatcaaccctttcatagtaggcatgcacccttcagcaatactgagtctttatgtggtgggccttgacgccacctcccatcttgaatgggtccaggaccttctatgccattctacatgttgcctttaaaactcaaaccttttgtaaccaagagacaaacacccctaatcagccatagcttcaactgcccagctttcattttcagcttcctctttatttttggcccttgagaattctggccctgtctccttgagggctcaattgtgcattcgaaaggtatttcctataattaattgagctttttaagggactgtataacaagagaagctagtttatctttttgctggaaacagagccagccttcccatttttttcctctcaattttggtaatatattttctggcaagagtaattgaggaatatatcttctttgttgatactgtagcaattagaagttattttcattcttcattataaagaaatgatgctctcaacccaaacatcagtaggacataaactgaactgatagctgcagactctcctacagtatcctcaggcctcatgcttctgaactcactgctcagaatgagaagtggggtctctgtggaggccacatctgtcagctgattttcaaaagtactgcccagccacatgggttcaatgaatcatcccctaaactcattgtttccattattttcactaaagattaaaatataacatcttatttccattgcccaagttgatgcggcttttctctattgattagaactaatgatgattataaaatgctaaaattttcaacaaagcagattcaccttcataaataattcctggatgttaaggaagcaggccatttaacatgaagtaagtagccctgcacctaaaggtcagtcatgtgttcaagtagtatttcttttaaaaaaaaaatctattttgagattaggttataagactggctaatttttgtatttttggtagagctggggtttcaccatgttgccaaggctagtctcaaactcctggactcaagtgatccacctgcctcggcctcccaaagtgctggcaagtgctgggattacaggcgtaagccaccatgcccagctgaactagtatttcttctttttttttttgagacagagtctcactctgtcccccaggctacagtacagtggcatgatcttggctcactgcaaccttcgcctcccaagttcaagcaattctcctgcctcagcctcctgagtagctgggattacagttgcccaccaccatgcccagctcatttttgtattattagtagagacagggtttcaccatgttagctaggctggtctcaaactcctgacctcaggtgatctgcccacctcagcctcccaaagtgctgggattacaggcaggagccaccgcgcccagcccgaaatagtatttcttgagcacctgttgggtatttattctgcatgatggagggagggggaatccacatcatatggtccataatctttggcctctggaaactggcaatctgattgaacaatcagtgggttagaaaataaatgactatgaggcggagatgcagccagcaccgtgtgattggtacagacaataataagaataaaaatatacaagggaaagaggcaatttctgatgacatatagttttaaaagcctttatgaggtagagagcacttgatctgggtctataaacatgactcgacttttgatagacaaagtgaaagttccacataaggaaaatggcctgagtagaaactcagaactaggatggcaaaaagtggattctgagaatggcaagcagaccagtttggcccaagtgggaattgtaggtgggggacagctgatgctgggctcactgtggaagacaaagtacccttcaatgcttaatcattggctccctattatcaaccacagaatgttaataaatattaatttccagagttgtcctgaccactcacttcatggtgttacatagacatactgcaaagacttcacttttaaaactgaaggttggtttctcttatgctgataatttcaacttaatacattttaactagtgaaggaataaactagaattatgttgcttccacattctgtaaaatttggaatgatctctgtcccaggaaccctggtttaacagtggagacaggacgagggacttaggaaggtacctgagggttggcacaggggctcagctgatcgggcacaaggccttgaagcaagatgtaaaccgtggaagtggccagtgggtgctgcaccttttatccagcagtgggcctgggtccagtggaccaaactctgaggtctgtgagtctttgctgcatttcacacttgctgtacaccagcagctcacacttgctggtagttttgccctttgaggtgacagaagtaccagaaaaacaaaagaaaggagacattaaaacagagtaactaggttcaaaactcaaagtgcagggactaaggggagtgctttctggttgccacaggttaaatttttttatataaatatattggcataaagaatgattcctgggtacattccacttgtccttcgtttcctcccttgtatatgattattgatgtcatgaaaagtgcattcatcaggcctggctgtcagagagttgcacttattttgtgcccacaagcagttttgaggtaaatctcttgctttagggcattagctaatcaatacagacatctgtagtgagggattgttttccacatcatctacaagactccattttcctagggcattctggagggttctggacttcctttagacaggaagtcactctggatgggacagggacagcaggaagaaggagtccctgtgaaagaatctttcttctttagcagcctgtcttttagaagcaagtagctgatccaaagtaaaggccttggaagaaaatatagcaactgctcattaccctgtgctctgccatttctaggggcttattttctcttcccttggggttttcagtctgatatcagcttattttttctttgaaatttacaggatcaatgatcccacatgccaaggcccaaccctccatattactgcctttaattacatataaggaagagggcatcttgtttctgtatattggaggcatagcaatgactatacacatggcaggcagtaaatactgctgaacggcactgaattcctaaaatataaatgtaatgatttagcttccctgttaaaagatctcccggccgagtgcagtggatcacgcctgtaatcccagcactttgggaggctgaggcaagcagatcacttgaggtcaggagtttgagaccagcctggccaacatggcgaaatcccgtttctaccaaaaatacaaaaaatagcccagcatggtggcacacgcctgtaatcccagctactcaggaggccaaggtgggagaattgcttgaacctgggaggtagaggttgcagtgagccaagatcgcaccactgcactctaggctgggtgacagagtgagtgagactccgtctcaaaaaaaaaaatcccttctctcctttttttcttttctcccccatcacttcacctttttctcctataattcagtcacaactgttaactgtctagatggactcttgatacattgagacattccaggcattctatgagtttcatctccttggagagaaggctggtaagagccttcttaccagctccaggctcacctgcttgtcctgcacctagtctatagaggaaaccctggggttccccatcgtcctcctggagggtccttcactctatgcgtcacagcctctgtttcttgaatcccttatagtcctttggtgtggtttactctcctcctttggagagaatcctccaatgctttcctgataaagagtacatgggaggtaatttttttttaggcctcacatgttgaaaatgtctttattctatcccccaacttaattgatgtcttcatcaagagatagatttctatgctagaaattatttctcatctgaattctgaaggcagtgttctattttcttttaatgtcttacattgctgttgagaagtcttattgatccattgtacataacctgttttttctctctggaagcttttatgatcctttctttgttctccaggttttgaaatttcaccacgatgtgacttgggagtccactagcagttaactgaggcataggtttagggactcgctgagttaaatcttcatgcctgcctcacagggttgttgtgagaattaaatgaattaatgtctgtaaaatgcttgagacattgcctgccacttagttaagtactagttaagcatttgcttttattaatatttcacatacagaaaattatttcctagaattctggaaagttttcttgaatgatttctttgatatcctcccttctgttttctctgtcctttttttttttttttttgatctcctattgtctgttggctctcctgtaataatgttctcatttaaaaaaccatttctttctcatttcgaatttgtgtgtgtgtgtgtgtatttatgtgcatgtttgtgtgtctttttttttctttaattgagacagggcctggctctgtcacccaggctggagtgcagtggcatgaccacagctccctgcagcctcaacctcttgggttcaagcgatcctcccatgtcccaactagctgggactacaggcatatgcctggctaatttttttgtagagatggggtctcactgtgttgcccaggctggattcgaactcctgggctcaagtgatcctcctaccttggcctcctaatgcactgaattacaggcataggccaccatgcctggccttgtgtgtctttcttgtcctactctgtgagagatttctccagctttatcttctaaattttccattgtgtttttaatttcttctatcatattttgtattctcgttactgcattttgttgtttttctctattctttttaaatggcatcctctttgctgtagtctgaatgtgttcctcaaaattcatgtgttagaaacttaatccccaatgcaacagtgtcggatggtagagccctatgggaagtgtttaggtcaccagggctccactgtcatgaacagattaatgccattataaaaaggcatgatggaggcagtttggtctctcttgtttgccttccacttgccatcatgtgaagacacattgtttccccctcttgaggatgtgccatcttggaagcagaggccagcctctcaccagacaccaaacctgctggtgccttgatcttggtctcccaccctccaaaatgacaattatgaaatttctgttcttgataaattacccagtctcaggtattttgttaatagcagttcaaaatggactaagacactcttcttgtttcatggcaatattttcttacatctctctgagaatactaatttttgaagtttcatttccctgaagaattctgttttctccaagattctttttattttccaccattaatttgtgttgggctctgtcttcaagttagaggagttccacagatgtaggtcttcttggctgcctaatgtttatgagaggggtacattaacaaaacccacaggaagctctgtgcatgtggcaaaggcttgccaactgtgggctccatgtattgagatttgactgggttactgtgttggggaactcccaatatcaatgtccttagggtctttctctttggctggtcagattgccaagtgacgattcttgcaatctcctgcctggagggcaagagtttggctgctaatagtctagggatagtcggtatctcattgcttcagtacagtacactattttcaactgagcctggtgtttcccagcctggagaccctccattttaccctctaccaaggtatgggagaggcagttcccctgctactggagggggtggaaatctgtgatctaacttttttttatgcaaattggcaatcaaaccccctattttcaacccagcctcaccctcacctctaaaggtagaagaagatactgccaagtctcttggggattctgtgactcagattatttcttgactttctttactgctgatttagaaagcagcttctcagttctactaagtttcttttactcattattatgcttcccagctttcaaatctttgcttcaatcagttctccaattctctttgcttttgtgggtttatgccattcaaaaactctttcagtggtgtttagtaggaggaagcagaggtgattgtgtttatccccaaatttaagtgcagtcttagttaatttaaagttcatcaacaatgaagtgtaatatggtttggctggtccccacccaaaatttcatcttcaattataatcctcataatccccacctgtcaaggacgggaccaggtggagataactgaatcataggggtggtttcccccatgctgttctcatgagatctcactgcaccttgatggttttataagtgctcactctgtcctgccaccctgtaaagaagatgcctgcctctctcttttgctttccatcatgattgtcagtttcttgaggccatgtggaactgtgagtcaattaaacccctttcctttataaattacccagtctcaagtatttcttcatagcagtgtgagaatggactaatacagtgtttttatttcaaccttagtaacacagacagccttctgttggaacatccttgggtatgaaggataacatatttttgtggcttatatgcaggagtgatattcaaaatattgaacaactggtgtggtgtgggtgctgaccagtcaaggggaacagcatcattcttgctgcctgctggctgtatattattgctgagtatgaacaaggaagaaaccatctgaagcaaagatgagcacatcctcaattggagtgctaggcaaagttctgctgtgaagcgtgtttttttcttcttttccttgaccctgtgccttgaatataaatgtgccttgagagggggaatgattgtgcaagggaagaggtggctgagtctctgatgtgcgatgaatgtcaacagggtgagactgataaaagaacaaagcaaatgcaaaaaagaaataggtcattgttactgtcggtaaggcacccctggactatggattctcagctcagggttagacaaacaataggagaggaaaagacacactccttaaagaaatctggttgctgtgatttaggattcagatatgttccctggaagtatgttttcagtttaaaaagaaatattgtaacatagattcagaatgagaataagaaaaaatgggaagacagtttagatattctcagtgtttttatgagtgagaaatacctggtgatgacgttttcattgttactcttttttaaaaaatatttaaaattttattttttaaaaaatttatttctgtcactcaggctggagtgcaatagtatgatctcggctcactacaacctcggcttcctgggctcaggtgactctcctacctcagcctctcaagtagctgagactacaggcgtgcatcaccacacccggctaatttttatattgtgcagagacggggtctcactatgttgcccagcatagtcagcgaatcttctacctcagcttccccaagggctgggattacaggcgtgagccaccgcactcagctcattgttactctttatcaatggttaggctaacatacaggaatttcctaatttctatcctagaaaatcaaataaacagttcacagactcacactcaagatgatctattgataataggaatggtaatttagagtaaccaaatagcctcagctgatgagggaaagctctgctttacataatagtgctatgtaatttcataataactccaaataatgtatttggaatgaaaaatccaggccaggcgtggtggttcacacctgtaatcctagcactttgggaggctgaggcgggtggactgcttgagctcagtagttcaagaccagcatggttaacatggtgaaactgcatccaaaaaatattagccgggctcgcacctgtagtcccagctactggggggctgaggcagaaggatcgcttgagtccaggaggtgtaggttgcagtgagctgtgacggcaccactgcactccagcctgggcaacagaggaagaccctggctcaaaaaaaaaaaaaaaaaaaaaatccaactctgtgtgtgtatgtgtgtgtttaatcagcatttgcaacctctagtgaaataattgattcagacaaagatcattaatagatgctaaaaccattagttgaaagggcataaggaattgggtattcctatggtgtcaaagtattgtacacagaatacttactacttgctgagagaagatgtttttctttacaacggagagttccatggccaccagaaaatcaaacaccacaccgacagtgagatacacagatgtgtggatcctgatgaatatgaaaacacatcatcatctatgcaatacgcttgccaaaaaatatttaccctaaatctcattaagcttttagaacttccctcttagagacagggaatagaggaaccagtttcatgtatcacaaggaaatcatcagacaaattcagaatgtgggacattctccagctggccctgtttcttcaaaaagggtctagggcaagcaggctggcctagattaaaaagaggtttaagagacagaaccatacatgatgcatatgtgttcactggattttgtcagaaaatgatggaaggtattttggggatggttggagtattttattttttaacttttatttaagctcaggggtacatgtgcaggtttgttgtataggtgaacttgtgtcatgggggtttgctgtacagattatttcatcacccaggtattaagcctagtacccattagttgtttttcctgatcctctcctcctcccaccctccaccctgactggagaaatctgaatatggactgagcattagacacatcacagaatcagttttgccaggtgtcataatgatattgtggctatgtaagcaaatgcccttctttggaaatgcatgctaaaatatttagggatgaggtgtcatgatataaattactttgaaataatttagcaagaataggtagatagagagatatgaagcagatatagaagaatactgatgttgaatcaagatggtatgtatatagatgttcaattgttttattctacttttatattagcttgaaagccattgcactccagcctggcgacagagcaagactccgtctcaaaaaaaaaaaaagtgtactagtccattttcatgctgctggtgaagacatatccaagactgggaagaaaaaaaaattaactggacttacagtttcacatggatggggagcctcagaatcatggcggggggcaaaagacacttcttatatggtggcagcaagagaaaatgaggaagacgcaagaagcggaaacccctgataaaaccatcagaccttgtgagacttattcactaccatgagaacagcatgcgtggtggaaactgctcacgattcaaattatctcctactgggtccctcccacaacacgtgggaattatgcgattacaattcaagatgagatttgggtggggacacagagccaaaccatatcaagaagtttaaggaaatggcctatggatgcaaaatcacataaacttggcctgacagttttgggaggagtaaaagtgagtgtctgaaagggcggttatttgcactgggcacccaggaagggccactggtgctaagttcaccaatgtaatgaagtgaggggtcattcactccagaaggactgagaattttggaagaattaatgtacttagagtgcccaacttattgtcagcaataatttactcactggcaagatcggactgaataattcatgttacaactgcaatcagaatactcatgattgctggttgttagttggtttttgtaccccaaattaagtcgcataaaattacttccttttcattagttctgagaatgtgctcttttccttttcttccattcatccttccttccttctctttcttctccttcctttctgctttcctctcttcccttccttccctccctcagttctctttctcaccaattctttctccaaataatattaattgtcccatccactcaaggcatagatgtagagtgacagttaaaatgcagaattgcttcctgcaatgctaaattgttcttaaagtacagttgttgttcaggaagtgtgtttgcagccctgtccagctccatttctggtgtgatttcagggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggtcagctgccctggagaggggcacatgtaggtcaagggcccaccatatggccatcttgtagaccaggtcttaccatgagctgatagaagcttgagacacttagaataagatccaagctgcccccgtaatgcaatgggcatcttcacgaagaataagctccttttcacttaaaaatattcagagaaggagaaacaatgtgaggcagtggaaacagcatagggtttagactcagagaacctatggtcaaatcctggccctgctgcttgttagctgtgtgacctcggagaagtcacttactctttgagcctgtttcttcatctgtaaaatgggtagcagatgagccacaaagaatgactgtgatgattacataacagaaaaactccaggtacatgtctattatgcccattatcactggtgtccattcccagggtgttgcagaaatgttgcctgcttttggtgaacatttgaacacaatgttctctgaggttcctaaatggcaggtatgatcttatttacaagaataaacgtgcctaccaaatttgaccatccttggatttgagcacaggggccctgataggctaacttgggtgttctgatccttcactggcatcttacagcatatttcgatggtgttagaaagccattctagcccagctgcttaggttatcccaacatgctagcagggtctcttcctcaagcactgtttatctgggaatctttttaggatgttcatgggtgacagatacagaatctacacagggcttctgatactgggtcctgcctataacaacgtaatggccaggagcattctgcccactgaccaatggctggttttttggctgtttcaggagactgagggctactcaggctcagatattaagctcgtctgcagggaagcagccatgcggcccgtgaggaagatctttgatgcacttgaaaatcaccagtcaggtatgggttggatcaccatgaaggtgttccaggaatttgtgtaaaaatccctctcaccagcagatggagcctggcgcctgttcttggtgccgctttacacttggcaatgcgttttttggtcaaatcatccctcactcaactcattcctccgtgggtgttctgatttggatcgactttgcttgcagatgataaactccttagggctcaggcttttatttctctggcacactctgatgttgggctggatccatttgaggcactatataaatattaaataatacctggtaacgatacatttaggtcacatttttttgtctgggccttaggggctaactcagttgcacgttaaagaatttttccccagccctctttagtcttgccttttgctgcattaacaattaagaatgctgcattatgcattattttgaaagaaggtctattagcgtttcaagagcattgatcaccaagaggtcgattgttgtgctgttactgttgtgttcttatcctagaaagcagcgacttacccaggatccagttggatatagtaaccactgccgactttctggatgtgctaactcacaccaagccctccgcaaagaatctggctcagagatactcagactggcaaagagagttcgagtctgtctgaaaccacatttaccctgacctggccacaaaggcaaccacaaagacctcctagtttattaatgtccgtgggagaacaaaatgattggaatggaaaagagaaaattatttttgaagactggattaacttgagccactgtattgttttggatagctgagatatatttattaacttaccattatcgatgtcagcaaaatattgagagtttcagttacatacatatatgtgctattgggtcatacaatggagatttttctgacaattagactccataaaattttaatgaacaattttctgtaatgttactcatttgtaaactttttaagaaaaagatgtacttagaaaagttgtgttggccacacacaggatgaccctgagttggggcagccaagtagaagctaagcttgacaggcactgcccagctgacagtcccagggtgaaggaggacggaagcagggaaggcaatgcagtctgtttctcattccggacaatattctgaatctcatcagctccccctaattctgactccatccagctttgtcagcagcaaacccctcccaaactaagccccactcagaaatgtcactgagcattctgatgctagagctaatagccagggtgactagcacaccatcaccatcagctgccagtctgattgttttgggttctggcccccaataacatcttttcactcttcacacctcacatccggtgtgctctgcccttctctttccattgccgcagcttctcatcagatccaaagcttaggatggggcacctaagcttcgagaacattcatcccaagtcttccctgctcttaggctcttccccctctccttaaggggttataaacaactagacgcatctctctcagaaacccacaatccgaggcatctactttcaacccttgataaattttgaaggcttctactaagtaatgccacttcttttcccccactagaacttacctatgggaaatcaccttcttttctcttccttgccttgtcttcatcatccctgcagacagactcttcaagaggaaaaacctccagaaagagacactttggatagctaagtatcccaaaggattttacccttttaaacaaaaccaaagcatttttttcggtatcgattattttgagattattctcaaatgcctctttaaacatcatttcatggaaaatgtcaaattgaaaatataccttatttaacaaattgaaaataaaaaagatttcatctca

SEQ ID NO: 2163 - DNA, 5525 bp, Homo sapiens
ttaataaattaacccaagtaaagtactttgataccaaaggaagccctatatgtgttagtgatttcagccttcttcctctaaatgccctttgagttctgaaagatttctgaaaatgttcggccttgtgaccttgggtaacacctgctgctctgagcctcagtttccccgtctgtaagaaatgaggctacgggactcaggaggacccgtgtgtcccagcaggctgatggggacatgtgaagcagacagacagcctgcctggcccctggggacaagctgtgagaccttgggaagccactcccctgctctgagactcaggtttctcccctggaaaacagagtgaggcccccagcctgtctgacagccttcctgagctgcagggagggtaggtgacaggcctggttcaggattgttctgtgattctatggaatagactgtacatcactcttgggttcaggggcaccaactttttctggctttttcttttcttttctttttttttttgagacagagtgttgctctgctgcccaggctggagtgcagtggcgcaatctcggctcactgcaagctccgcctcccaggttcatgccattctcctgcctcagcctcccgagtagctgggactacaggtgcccgccaccgcacccggctaatttttttgtatttttagtagagacggggtttcaccgtgttagccaggatggtctggatctcctgacctcgtaatttgcccacctcggcctcccaaagtgctggggttacaggcatgagccaccgcgcccggccttttctgcctttttctattgtggttctctttccctgagactctgttgttctgtctccaactctgggtgtctgacgctgccctctgggtctctgtccctccctcccccactggctctttttgtttgtttgttgagacgggggctccctctgttgcccaggctggagtgcagtggtgcaatcatggctcaatgcagcctctacctctcagggtcaagggatctttctgcctcagcttcctgagtagctgggatcacaggcatgtgccaccacactcagctaatttttgtattttttgtagagatggggtctcaccatgttgcccaggctggtcttgaactcctggcctcaatcaatcccccttcctcggtctcccagagtgctgagattacaggcatgggccacttcgcccggcttctatcccctgctcttggtctctgtctccccactctggatttctgttcctctcttctgcgtctctgccataccccaccctccaggtcattgtctccctctccctgagtctctgtttctctccctttgggtctctgtctctctgggtttccacctcttcctttttctgggtctctttctctatccttttggctctgtccctctatcatgtctggacagagtacagttttctccccctctcccctttcccttgtggctctgacctccatgtctgagcataaaactgtaggggagaatgggagtgaacagcacaatgaagtggatgtggggtaaacaggaggagcatccacctcttcctaatttacccagtcgcctctggatgaacacccaatcccatggatacagaatccagtcccgccccctacagcgagctggggagccagctcggcacacctcccagagccctcgccactgcatgctcccagatacatgatgcttccccactgctatttcctttgggtcctggtgctaccactaaatgcaaaacagcccgatgtggccctatggaactcgttcgcacagtccaactcaacccaacttcctgtaggactcacatagtgacacaactcaatggaactcaattcagcatggccctatgagactcaaacagtggcatgacccaactgaactggccttacaaggctcatatggttgtacaattcaacacaactcaactcgctgtggccacgaaaaatgtccagccacacacctctacacagttaagcccaacagaaccctacaagattcatttggtcatacaaacttaacccaatgtgacctagaaagctcaaattctaccactggactcttcacatttctacatgactcgcaagttcacagaacctaaaataacatgcccctggaagaatcacagagctacacaatttccaccatgtctcaacgaaacttaacaccacacacattcgatctcaacaatgccatgggggaccatctaacttgacccaacatggccctaggggacccaccaaaccacagaatcctacacaatgcagctggaccacactatcccagactcacaacccaaccaaacccaacactgacctaggaaactcacaaaatgatacgaccaaacctatctcaacactaccccaaaaggctccatgagctttgcacaactcagagtaatatgaaccaattgagtcttcattaacacaacacaacccattgccattcgctgctgcttcaggaggtacccacaggagctaccaaaccacacaacccaagacccaacaagactcagtgtttccccactcgttacgacttaacctagctcttcctaaacccaatcccctccccccagccttgccctccaccctgccctccctccctccctctagggaggtgtgaggtcctgcagacctcaactgttcctcacacttcggtgaccaggtgtttccctgggggtgcccagagtggaggtggtagctcaggtacctccccgtccaccagccccccattggccttgccctccagtgggccacaaggctgcatgtccacatggctgaacatcccagcctcttcgccctctgtctcccggtgataaaagtagctgaaattggagacaatgacgggcactggcagggaaatagtcagcacgcccgcaatggcacacagagagcccactatcttgccacccacagtgacgggtgccatgtctccatagccaactgtagtcatggtgactaccgcccaccagaaggactcagggatgctagtgaaatgggagtccacccggtcaacttcggcaaagtagacggcgctggaaaagaggaccacaccgatgaagaggaaaaagatgaggaggcccagctcacgcatggaggcccgaagcgtctggcccaagatttgcaggccctttgagtgccgggacagcttgaagatgcggaagacacgcaccaatcggatgactctcaggatggccagtgacatggcctgctggcccacccctcgctgccgggccagctcggtgcccagtgccacaaagtagggaaggatagccacaaaatcgatgaggttcatcacgttcttgaagaagatagccttgcttggacagaccaggaggcgtaccagcagctcaaaggagaaccaacaaatacacagcgtctccaccacgaagaacgggtcattgaagggcaggcggggtggatttccaggcatttggctggagccattcagcggagcggggaactgcagggaggaaagtgttcagggagggtcaggctggggctaggacacggggacagccttaatcatcatttaaatacccagctcctctttacacattggtcagtagccgctgcgccaaggccctccgtgacctggttatcccagacttcctcccaggatcccagggatcatccctgggccgctgactttctggttgcctgacctggtgggtggctggagacgtggtccctgccccttcatgcgtgggaactcatgtttgagtagggtgcaacctcttctctctcaaagtcccgcctccagtgttgattttctagatggggagcatccctgccctggccccaccaccttgtgcctagcttttccttgccctccacagtcccagcccagagtataatgcggctgggcgcggtggctcacgtctgtaatcccagcactttgggaagccgaggcgggcggatcacgaggtcaggaaatagagaccatcctggccaacacggtgaaaccccatctctactaaaaatacaaaaattagccgggcgtggtggcctgcacctgtaatcccagctacttgggaggctaaggcaggagaatcgcttgaacccgggaggcagaccttgcagtgagccgagatagcgccattgcactccagcctgggcgacagagcaagactctgtctcacaggaaataaaaaaaaaaagaccttctctgcaagccgagccctaggccccctcctctggcccctcaacctggctttctttccatagattcctcctactgtcgcccctcgggctccagcaccctcagctggagttattcagggcctggctttcaccacccagccgcacagactccggagttttcaggctctccttggcccccctcagctgtgatttttaaggttcctgtcctcctaccccttgcatcaagggccctgccctcttcacgccgggtttctcactgacctcaaccccaccttctgatggggcaggtcctccgacccggatcctcaggccccgcctcccgcccaccctgtcttcggctggcccacccctcgcagcccctggccccgccttatgattggccaggtcccctctggaccccgcccatctcctcccaaaccccgcccgtctccacccacgccccgcctctcaccgggccggctgcggctgcagcagcaagccccgtgccgtcgcggtcgtcgcggaagtcaggcagcgtctcgaggcagaagacgacgatggagacgaggatgaccagcacggagactacggcgagcacgcgcgcggcctgagagctctcgggaaactcgaaaagcagccacagctggcgggcgaaggcgcggcggggcagggggcgctcgggcggcaccgggcagccctcgtcctcgcgcaggcgtgccagggccgccgcgcccagcccgtagaaggccacctcttccaggaagacgtcgagcggcacgtgcgccggccgccgcagccgcccaccggactggtagtagtagagcacggcgtcgaagctgggccggtgccggtcgaagaaatactcgcggcgcgcgtcgtcgtagaagcggccgcggcgcgctgggtcccctagcagagtgtccgggaagcggcccagcgtgcgcgcccgcgtctcgaagcgcagcccggccacgttgagcaccagccgctcgcagcagccgcacggcggcgggcaccgcggctccatggcgcgcgcagccccggcgacccgcgaaccgacgtgtggccccgacgcccggccccggtgcggccccgcctcggccgcctcggccgccgccgccgccgccccagcccggtgtccggtgtccggtgtccgcgcgtaaaaatagcccggcagggcggctagggcgcgagggagggggcactgtgaccccggcggggcggagggcgacagggcgaccgcgcgccctctgccgggacgcccgccctgccctgccccgccgccgccgccgcccgcgcctgctctgcgcctttcccgtcccggggtcccctttctctccgtccttctgccgccgggatcctgtcctgcgtctctccaagttt

SEQ ID NO: 2164 - DNA, 2729 bp, Homo sapiens
attattatatcatcatcattattaccctcaagttgctccaggagaactcctattcaacctccaaaaccccatgtggtttcacccatcctgcagagattgagctcaaaatcagagaattgtgattttgtgattatttgatgagttcccaaactggggtccttagatcagctgggccatccctgaggtctctcagcatccagctctgttattttcctgggcatgggtctcaggcccggccagtccggctgaggagtgtgcagacgcaggcagtgtcaattcgaatccatcgccagcccacacggccctgggcatcagcggtcaatgcccgcacataggactgcttggccttgcactcagatacccagtgcctcctgtccactccccggcagccccctccacctgcccccgggccaccttcctcagcgttatcagccttgcagcgggtttcaaagaagtactggcggaggggactgccgccagctgcaggcacctcgcccaacacctccacctcgcgcccacgcaagtccacagcggtccggcggtctgtcacccagccactgactgcatcgcacacagccagctcaccccgacgactcgctggtgcagtttcgctcaccccacgccggctgcggttggccggggcacctgctgactcccgaaaggccccagcctccagcaggaagagcagagggggcccagcaggggcacccctagacaggactactcggggggagagaaggtcccactcaggggccagaaaagggggcaatgttgagggtgggggttgggactcaattggcacactggggaggaggaaaaggaggaggatggggagggagcatgaggggagagggagcatctctcggagcacctggagacagaaagagggaggctgggattagagaagggggtaaaaacttcagtggggaaagaagttgggaaccccaggggaggcttgcctgccaggattgtggggaagcccttgttctagaagtttgggggaccctatatctagggcttgcgtaatgcgcaacttgtagattaataataaatattcaactactacaggccaggcactgtgccccacacctctaatcccagcactctgggaggctgaggcaggtggatgacttgaggtcaggagttccagagcagcctggccaacatggtgaaacctcatctctaccaaaaataccaaaattaaccgggcatagtgctgcacgcctgtaatcccagctactcagtaggctgaggcaggagaatcacttgaacccaggaggccgaggttgcagtgagcagagagtgcaccactcccctgccacctgggcgacaagagtgagactctgtctcaaaagtaaaaataaggccaggcatggtggctcacacctgtaatcccggcactttgggaggccgagatgggcggctcacctgaggtgaggagttccagaccagcttggtcaacatggtgaaaccccttctctactaaaaatacagaattacccgggtgtggtggcgcatgtctgtaatcccagttacttgggaggctgaggcagggcaatcacttgaacccaggaggtggaggttgtggtgggctgagattgaaccattgcactccagcctgggcaacaagagcgaaactccgtcttaaaaaacaataataataataaaataaaaataaaaataattcaactactattacttaacagtaacagatgttgaaatacaggctcagagaagttaatgatttgtgcccggtcacacagccagcaaatggcagagatgggacttcacctctgggcaactgcactctgccgtccttcctgtgcaactctgaggaaccgacagtcttgcatcttggaggatgttccaaacaattttttttttttgagacagaatctcactctgttggccaggctggagtacagtggcacaatcctggctcactgcaatgtctgcctcctgggttcaagtgattctcctgcctcagccttctgagtaggtgggattacaagcacctgccactgtgcccagctaatttttgtatttttaatagagatggggtttcaccatgttggccagactggtcttgaactcccaacctcaagcaatagtcgtgtcctggcctcccaaagtgctgggattacaagcataagccaccatgcctggtcccaaacaaaatttttttttttttttttttgagatggaatctccctctgtcgcccaggctggagtgcagtggcacgatcttggctcactgcaagctccgcctcccaagttcatggcattctcctgcctcagcctcctgagtagctgggactacagactcaagccaccacgcctggccacattccacaatttagagaaaggtcacaacctggaatcctagggagaccccagttcacctcaaaactgccactaaggaggtaaaacgctgcccctctgaggcaggcttcagtttccctgtgtgtgaaattgacctggcgctgggagaggctggtggaggcgcggattttgcagtttccctacaacattctggaagcctgtggttctgggaaagggtggcgtggagaagactgggaaacagtcagtagttaccagacctgtcagcacctcctccgcctcggagctctggggctgggagtccccaggcttcggggggcccctgtggaggacacaggtggccccctccttcctgacatctcaggagagggagggggcaaccacctagg

SEQ ID NO: 2165 - DNA, 95539 bp, Homo sapiens
cccgcgggggaatcgcagtgagcagcgcggggcgaggccgccgcggacgccccgtcggatgtgcccttcgctgggccgagcggcgcagggttggagagggaagcgctcgtgcccaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggccccgcggggcctgcgcgcgcgctcctgctggcgtcggggggtgagcgggcacccggcgtgaccggcccatgggcgctcggtctcacgcccgcttcgcagagctcaccccgccagctcctgctcggtccccagtcccctgccccgagccctcagggatcgcaccgcagtgcgagcggctcttccaccctctggtttctccccgtttccggtcaatatatttaaacttcttaacaaccacggcttcgagacgatccagggtttcatctattaaatcctccgtgggcctgagacacctgagtgctcattactctgtggtttgggaagctctcttaagaacaagctgttaaaaacccccacttgtggactgtgtccccgctggccacaggcctgctgtggtcttgggtgtcaagcactaaaaggacaaaccgttgccaaccacttccctttctggaacctcttaactgcctgcacctccctccccgctttgtctcccagtggcattcaacaagactctgtgctttttttgtgctgagccgttttcagtgagtactggaatccgtgtgagagctgtgcccttgttttgagttcttgctgaactgctcgccctccagcaagcctctcgggagaacagagcgcagctgagaggagcaggggtcccagctccttcctcgttggagctgccacggaggcacctaaagcgcccccagtcttcaccagcattccaggaggtttttgatataaacggtggactcttcctcagtctttctgcgaagtgctctgcaaactcaacttgaaagcctctcttcccaggaacactggcctctccaatgcagacatggaagttgctttcactttttaactgaatgtgtaacattgcagcgtgcattattctgcatgtcacattgtggttcttttgtgttcttttttcttagcataaatccagggatttacagggttgctgactgaaagccagcagttcagttcataatcccattagcagtgtaaagaactcattctcaacagactcttacaaggataattattgcaaattttttgaaaattaaatgaccacaaaatcggggggtggagagtggggaaacatcctccaatccagaaaaacctagcactgctttttggcctctccttagtgtattatagacaagtggagcattttttttcccctcaaaggtcatatgttgacctgacagttgtttaaaaaacaatgaaaaatctttacagcagagtttccctaaatatttttgtctttgttccatcctaagagatgcagtttacatgacccatttgttttcttgaaaaggaaacaaatgcagagtgcactctatttcctattgtatttaatttctttctttctttcttttcttttctttctttttcttttttttatttttttgagatgaagtctccctgtgtcgcctagtctggagtgcagtggtgagattttggctcactgcaacctctgcctcccagcttcaaacaatccttctgcctcagcctcccgagtagctggtattacaggcatgcaccaacatgcccggctaatttttgtatttttactagagacagggtttcaccatgttgcccaggctggtctcaaactcctgacctcaagtgatccacctgcctcggcctccgaaagtgttgggattacaggtgtgagccactatgcccggccctgatttcctttttattaattcactggtcaagagccactaaattggttccatgatctagtatgacgatctgtcatagttttagattctccagaagctttctctgagacaaggattccagtgcaagtaggtcacctgagaagccacatcaggacacagagattgagggttggggcaggcaggtgagcaagcaggaagggaagacagccaataaaggtgcttatctccgcagccagaagaagccctcaggctctacaaactgtgtgtgtgtgtgtgtgtgtgtgtgtgtgtgtgtgtgtgtttgcgtgtgtagggcatgtgggtgggcagtggcagcagctgtacactaagagctgtcacccacagtgtgtggaggtcctgcatcagagccaacagtgagaatgcaagcatgtgctacagcggagtccctttgaggaacctcctcactgcccagcaagcaaagaaaacaagcaagtttctggtcactgaaaggggaacccgagctctgtgatagtgccagtcgagctggaggacctgaaaacaagaagagatgttagaaaaaaggcaggtgaatggagcctttaaagagcaagttgacaactccacccttccaataacagatatattgtcacctgttcagcttcagttttagtgaggtggagaggctggatgtggagatggagatatttttacttcttcctgtttaattggtgccttttgtttctttttcttgcttaattgccctggttagaacctccagtataatgttgaatagaagaggtgagtggacacccttgtcccagtcctcaccttagagggaaagttgttagtttttcaccactaagtatgaagttagctgtgggcatttcatagacagtcttaccaggttgaggaaattcctttctattctgttgattgtttttcatcatgaagtggtgttgaattttcttttcttttcttttctttctttttttttgagacggtgtctcgctctgttgcccaggctggagtgcagtggcgcaatcttggctcactgcaacctccacctcccgggttcaagccattctcctgcctcagcctcctgagtagctgggattacaggcacatactaccccgctcagctaatttttgtatttttaggaaagactgggtttcatcatgttggtcaggctggtctcgaactcttgacctcgtgatccgcctgcctcagccttcccagagtgctggaattacaggtgtgagccatcacgcctgacagagagtacattttaaatgttcttgcctcaaaaatgataagtatgtgaggtaaagaatatgttacttagcttaatctagtcattccacaatacatacatatataaaaacatcatgtacactgtaaatatacacaattttttgtgaattaaaatttttttaatgtttaaaaagaatcattcctgctttctgagagcaccccatccatagcaacctcctgcttccttagaccttcccctaaattactcaaccaaagtccaaatcctataataggctctttctaacacccccttactgagacccccatagttccatatggtgtctatcctcccttgctacaatgagtgataaactcaacttattcaactacaggtgcattcctgtgatctttggctgaagggtaatgatgcaagagatatatgtccccctcccttctacactacttcagctcaatattcccccagcccacaggacactcccaaaccctttgccgatgggtccttgtacctggcgagcacccttcttggtggagtatctctaagactactcagtctggcaagtttcttgatatctgtgggaaacccgtggtgctgtgcagcctgcccctgtgaagtccctctatgtccagccagtacagggccagaagccagcctgcctattcaggagacatctaattggacaacggaatgcttgtctctttttcttgcaaacatcacagacctcttggctccgttatccttgtcttcttaggagttgggggtggggcggtgattaaggggaggagaaacctgctttctccagtaagctctcaccccaaacctgtttatatgtgcctgtgtgtgtgggggggtggggggatggtgtgtggggcttgtggtgcttgtggcagggacatgtagcattgaggagcattctggttcaattttttttttttttgagacaaggtcttgctctgtcacctaggctagagtgcagtggtacaatcatagctcactgcagcctcaaattcctgggcccaagcgatccccctattcagcctcctaaataactgagattacaggtgcataccaccatacctgactattaataatttttctttgcttttgtagagacagagtctcattatattgctcaggctggtctccaactcctgatgtcaagtaatcctcctgccttggccccccaaagtgctgggattataggcatgagccaccacacctggccctggtccaatttttggtggctctgctttagaatgtggggacacgcagaacctatagttttgggttgtagatcctagtgccattttttaggcaaaggaagagttgttctattcaacagtctgttacaatagttatctatcatctttattatttcatttttttctcctttctctccttcatcgttatcaccattagtaagtcagagattgtcaggtgatggggtagggtgtatctgatcacccaaactcggataaacagtgcatgaaaaggggctaagccagtggaaaccactttggcatgttccagctgccacaagaagttcagcttagctgaagcaaggtgagtatgtggagaagtgggaagaaatgagtctggagagagggcagatgacagataatgaagggccttgcacactgcacccagagctttggactgcatcttatagatgactgtgaactgttgaggggtgcaggggagaggcaaggtcaggttgtggtgttggaaggtcattacagaagtaagagggaaatgaatcataacagggacagacttgaagaaggaatgcagtttccacaatgcaggggctacagtcagcctatgctgttcctttatggtaattaaaaaaaaccacctctactgggcagatgcagcactgagggttcaagacttggcaagcaggtggttgctttgtgtgaagaaaaaggcgtccctttctccgatgaagcagacccagtccacatgaagatgcgtggcccagcaggtggagaactgaattatagttttccttgctccctgggctgggtgcccttgtgcagtatgcaaattgcatgcccctaccggggagcgtggcctcatgctaatagtgtgtctggtacagaattggcaatcaattaaaattttttttcttttttttttttttttttttgagttggtgttttgctcttgtcacccaagctggagtgcagtggtgcaatctcgtctcactgcaacttctgcctcccaggttcaagcgattctcctgcctcagcctcctgagtagctggggttacaggtgcccaccaccatgcctggctagtttttgtatttttagtagagatggggtttcaccatattggccaagctggtctcgaactcctgacctcaggtgatccaccaacctcagcctccctgatggtattacaagcatgagccatggcgcccggccgattaaaaaattttaaaagtaaatggaccaaagggaaaatcaattggcagctcctactgccaactactactaccatccaggtaggaattagcaagggcctgaagtcagttgtggcaatgggagtcgaagtagagacagtatcatttgtctatacctggactcttgtgagtgaaagggagcactgttcatgattatgctgggacaatgggcataaatcaagactgtcctggacaatagagacatattgttacccgaaatagagatgaagagatggacaagagatcttaaagaagtagaatatgcaggtcctgtaaagaaactgactggaggaaagtcaagagaaaccccaacatttctcccttgggggactcggtgccagtctctgccacagccagtttgtgttgggggaagaggatgagcttgattttggactcgttctttacaaatcaagactgccttttgtggacagttctggagaggaaggaggggggctccctagcgatcatatcacattgtatcagaggcattgcagggcatttggctgagagtaagcccttgaggtaaagtccctcactgataacatctcactgtgtaataaaggacataaactgatttcttatcagtattctgcatctcatctcttaaaagaggtactgccatgcaggaaaatagctaattatataattgaaaaggcattaatagcctgtaaaattcaatattagagacacagaacttgaaggactcgctagaggtcatttaaagccaggtgactggatccattagccctgatcctaagtcatcaggggcacagaaatatctaaagaaccctcagaaatcatcaaggaagatttttttttttgtgtggtcagtcttgtgttctgctctgttatttaactgcctttcacatcaggaagatttgaggtcactgcataatagccaacttccaaatatacacagttgaaaagaaaatttagattttaaactgtgatcctgactatattgcatatatcatgagaggcttttgaacccagaatagcctcatttcctgtcttaaaattcattatcttaacactttaactttgcattaacacagacttttacatttacatttccctgtaaaataaattagaaaacatttctttttgtgacaacaagtagaaaaaaatgtctttgggttattccataattaggcttcatctttcttttgttatggggaaatgatatgatcatttggtggcaaatgatgcagtgccccatattaatctcccagtggcccgatttcataattcaacttggcaaagtagacaaataaaaaataaaaatctctcctcatcatcgtaagaggctcgggagaaagtcaaatcaggaaaaataaaatattttcagtggttttttcagacttcactatgaataaaactttgtgcccaggaaggagtttcttgggtgtttttgaatgtttaggaggatatttatcctgcaagcattgattcctttccttctgaacagatgatcagctgggatgttaagatgttaacaacatttctttcatgcatgctagtttgttttattttgttttagcttgttaagatgttagaataactacattcctttcaccgatgctgaagattcacctttttaagaaagagtcactgatcacatgaatgacatagatgttgctttatctgcctctgcagtgcagctacctggctggtgtcagcctcttgggtgaataacaggcgaatttcaatattgtcagagtctatagctgtcaagcttcagatctaacttccttaatgctaagccacttccctgtgtagtgtcttctcataacatcattgcttattggtaatgcttgctttaaaagagaaatgtggatgtgtccgaatagaggaaatcctggaaaactttaagtccctcttctttttgattcttgttgagtggcattctctcaggccatttgagtatattcccatgccttattgagaaatagcatttttaggttttccctgaggttcaaaggttaaatatttgtcctcatgttacataaaattgggtcctggaagcccatgtgacacagtagagatggtgattggcttgaatgtcagggtcttcaggagcagggcaggttccctgtggctttcttacagcagggcaagtgatttgggaatgagatattcaagagacaggagggaagatacaatttcaagaggaaggaacaagtgtctttgggctgcagtaaaatctctagcgttctgtgtgtggttcctggtttcaggaaggaatggggcaggttagggcatagctgaggagtgtagtgggggcttgcatggcctcaaagggtcagaagtagacccaactgaaggtcctgttatcctggtagatcttcagtgagaggtttaggaggggctatgtggtggcaatgatgcctgtgtaggaaaacctcctacctctttagccattgaaatgaagagatggacatccagaagtctaggaaaattggcttaatgcaagaaagcaacactttccagctttatgtgcctctcagaactcatcttgctaaatctttttgggtcacttgcaaacacaattggtaattctataccaattgtgtttgcaagaagaggataattcgtgactgaataaaagctattctcaggcataaggccgagtgtggtggcttacacctgtaatcccagcactttgggaggccaaggcaggtggatcacctgaggtcaggagtttgagaccagctttgccaacatggtgaaaccctgtctctattaaaatacaaaaattagccgggctcgttggcacgcacctgtagtcccagctacttgagaggctgaggcaggagaattgcttgaaccctggaggtggaggttgcagcgagcagagagcacaccactgcactccagcctgggtgacagagtgagattctgtctcaaaaaaataaaaaagtattcctaggtgtgaatgcaccaaaccaattagaacatacatcattcttaatctgggcctcttgcagcagctctggtcaattgagggtttatactcagataaatatcattgagttatcacgccctgtttaatgagaagaatgccagacttcttataattcttcataaagccattaccaacctgccctctgtgtgcctcactcgatccctgtctttgacctcctgatgtgccaagttgaatgactttcggtctcccagaatagccgtcctctttagatgtctcacatgtgatttcttctttctggaattccctgggaagacagcttttacctcatcccaagcctctgttttctttaggaatacagccttgcctcctctgcccacttcccttctgggagttgtcttgctattgagttccagccaagtctagaatcctgtctgacgccactcctctctgtgtagacgtctgcccagtgtctgccccggaagtgcagctccctctctctgagccgctctgagtttggttgctgtcttggactgctttcacttgtccctgttgtattctccacaaacatgtccacatgccaggctgagctctttcttccactgctgtagcgggctcgtcccacagagctttattcctcccagtgagcccctcacatcctagcttcaggcctttcccagcccatctggccacccactgcctttgctaagccctttctctttccctgagggcttttagggtaggaagaaaaataaactctatgactggattcatttggaatttggctgtcagagtcatgttctcttcttttgggtctatttaaaaagcatccagcgcccatgggaagcaataacccttcccaaagggctaaggcaatctgctccgacccccggagcatccttcctcatccttcacatctcagagcagacatcggtctctgctggaagagtctttctaaccttcaggtctcacagaggtctcccatgcccctcactcagtgcattctccattttagctttactgcactgtatataaccaccagatctcaaggacaatgatagctttaaaaactgatttgccattgccgtatctccagcactcagctcaataggtgcatgagtgaatgaatgaatgaatgatttctctgcacatcttccactgattagctctctgttgcctaagacatctcagttaccattcattcttcagactttgttttttattcctttcttctcttattccagtttctagcacttgttagctatatgaccttgggtaagtgactaaacctctttgtgcctcagttttatctgtaacatggagtaatagtattacccatctcatgaggttgtggggagattgaatggagcagtgcttggcacataataaaccctcaataaatatgatgattgaattatttcctgtgctttccttgatgttttcacaggattattaaccatgattttgttaaaattgactaatagaatagaataattacttgttgcaacttctcttgctctcttgctaaattgaggagaattatatagttttattttccttttcctttgctcctccacttgatccctcccatatttttggagggactcaggcttttgggtggggaggtggtgagtagttcctcctagggctgaattactttgcaggtaacacttggaatattagagatacctaatgttggacttaagtttgaaagtctttcaatagttttataaggtcaaaacaaacttttttaaagcaaccctacgtgaacactgataaagttaaaatgatgactgagaaaaagtggtgtcaacttaaataacagagagatgccgtctaaaagaaataatatttacttgggaacaggcattgcaataggaatacatgtgccaataggaatacatgtgaactatgtgtgtattcaggaaggtaaaagaagacaatggcttttaaaggaaaatgagagggttgcatagttgttttgagataattatcctgggttataaggatcaataacaagggtggtgccggttcaaggttggacaaatcttctgggcagatgtccttgccgaagtattgtttttatataagattgtgatggtctttgtgcaaggttgtggtttttgctgaatctttagtgatagttcttgttattaggcgtttgtgtgtgataaccttcttttcatggccttccctggcttcttttgttagggtttttaacacaagcgtctccattttgattccaacaactttcacagtggaaacttgtatgtgtagggctggtcattccagcccaacttgcaaagactttcaagctggacctctgtgcatccgctaatggggagtctgtgggaggatagtacctcttgaagagtgcagcctcctgtgtgcccatggggttcttcgtgaagagtttcatggttgctgcttcagaactactgagatttgggaattctcctttcttgttcttttaaaataagcaataagtcaaaggggtttttgactgcccttttttttttttctgggggagagtcttgctatgtcacccaggctggagtgcaatggcacgatctcagctcactgcaacctccacctcctggggttcaagcgattctcctgcctcagcctcctgagtagctgtttacaggtgcatgccaccatgtctggctactttttgtatttttagtagagacgcggttttatcatgttggccaggctggccttggccaggaggccttggcctcccaaagtgctgggattacaggtgtgagccactgcacccaggcttgactgctttttaaattctcaatctcaaagaataataaataatatttgaatagtaaccatactagttttagccctgtgttggttaattttatgtgtcaacttgattgagctaagagatgcccagatagctggtaaagctttatttctgggtgtctatggggctgtttctggaagagattagcatttgaatgagtagactgagtacagaagatcttcctcgctaatatgggtaggcatcatccaatcccctgagggataaaatagaacaaagaggcagaagaaaggcaaattctctttttctctgtctttgagctgggatatccatctggcctttggacaatggagtgcctagtttttgggcctttggactctgggacttaaactgattactgcacccccttcccacctgctgtccaacctcctccaggttctcataccttctgcttcagttttgccatcagctccctcccctggtcctctggtctttgtactctgactgcattacgccaccagtttttctgggtctcttgcttgcagacagcatatcatgggacttcttggcctccataatcacatgagccaattgtcctaataagccaattgtcctctttatctctatctctatctctgtcttatctccaactatatctctcttattggttctatttctttggcaaaccctgactaatccaagccctctgatgatgagacacattttttgtttttcaaaagtagttctggtccttcactttaaagggcaaagtggacctatgtccactttggttctgctcacaaacaggggttgattccaaggggctggagtagggctgttttatccatctttattatcttccatggagcagaagtgatggcagttatcaatatccagtctgcatttaatcaccccatttgaagcaggtttatggcaagtctgcctttgctctataggaacaacagtaaacagctgactggcccaattttttggaagatgagtgtctcctacgaatctcacaagcattgcatgttctacctgttgcaatattcgtctttttggaaaaagtgcctgcagatttcaatgtaacttgcttaatattcatagattcttactctcttctcttccaggaaaatattgttaattttaaggtgagtatcagggaggttgtaggaatttgatcaagcagaaccatgataagaaaagccaacagatgctttggaaattccttataattctggccttaataatggaaggaatgacagttttattagttttctattgttgcttaacaaatcactacaaagttttcagcttgtaggcttgactgggttctctgcctaggctgaaatgaaagtgtgggctgggttgggcttttatttggtggctctgggaagaattcacttctaagatcattcaggtttttggcagaattcagttccttgtggttgtaggactgagttccctgcttccttgctggatgttgttggacagctctctggtcctccttgcacatggcccctccatcttcaaagccagcaatatggcatattcagtctttctagtgcttcagatctctctgacttcctcttctgctactacccagagaaaattgtgctttcaaagggttcatgtgattagagaagacttacttggatcatttcccttttgatgaattcagagtctactgatcagtaataatgtaattatttttgcaaaatcccgtttgccaggtaatgtaacatagccacagacatgatatcacatcctattcctagtcctggagattagggcaggaaatcttgggtggtcagtttagagttctgcccaccacagttgtcaaatattgttttctcaaactaactctttgctgaaactgagctctgggatttcccttgcttgtttttgtttgcctgtgaaccatacagttggttatgctatatatctttttttttttttttttgagaaagaatttcattctgtcaccaaggctagggtgtagtggcatgatcttggctcattgcaatgcccacctcctgggctcacgtgatcctcctgcctcagcctcccaagtagctgggactacaggtgtatattaccatgcccagctaattttttgtagagacctgtttttggcatgttgcccaggctggtcttgaactcctggactcaagcaattcacccacctcagactcccacagtgctgggattataggtgtgagccaccacacctggcctatatcttatcaatggaattgtattctctggctcaaacaagatgccattctccagggcacttattcctggggttcatctattggttttggactttgaggtttggtgtcctccttgcacatggcccctccatcttcaaagccagcaatggcatattcagtctttctagtgcttcagatttctctgacgtcctcttctgttactacccagagaaaactttgcttcaaagggttcatgtgattagagtaggctcacttggattgtttcccttttgattaactcaaagtctaatggtcagtaataatttaattattttgacaaaataatgattttaaaatagaattattttaatttaaccaaagcaccaaagcaccatttttgcttggaccacacaagggagagataagagaagcagaaagcagccaacacaaccttggctagcttccaaacctgtgtcttttagtgttacaagtacatatagaattgctgctgtattcacagaccaacaattatctcattaaataacttcccaagccttgatttagccattatgaaagatgttttgataaagaacatctggtgttgttttcaattaaatattgcaccactaaactttgattaaaaactgatttaaaattttaatagtccctcctttagaagatggcaaaatgcaaaaaagaaaaatgtcactcatttaaattgtttttttctctcctttgttgctctattttaactggattcccattaatgactgtttaaaacccacacaattttggatgcagtaaatagagatacataaataagattaccataccaatactgctgttctcactcttttactactgatacttcattttgtttttatgctttaattaaattgagtatattttatgtttcagtttgctttaaaacaacggcagtgcacataattgacactatttcatcccatgatagaaagtgctgaattgaattaaacataccagttccatttccctttacatttaatctgtggcaaaactaaggcagaaataatatgaactatatttcttctccaagttgccgtggtaggtgaaaataactaaccatctaataattactaataaaggctgaaatgaaatctttactgttagtgtaactcttatctatataaaaatagatatttagtggtataagctaattttacttagtaattttccccaagtggcatgtaacaaataataaacacataattgctattccatgtactccatatcaagcataaatcttcaagcacaaattttaatatatttttactcagactatcaggtttagcctaagtatttatagtagggaaatgatattatgcaatgtttctatagaatagggattgatgaacttttgtaaagggccagatagtagatattttcaactttttgtgggccatactatctcacaactacataactcagctgttacaatatgaatacagccatagacgatatgtaaacaaatgagtatagctgtgttccataaaattttatttacaaaaactggtgatgggccaggtttgacctgtgggctgtggtttaataggctgacccctattattgaggataatgaccaagtgctagctaatgttcacagctgagaaaaatcaataggtcagttcatgaattaaggtcccgcatatacttttgttatcgtaggtatttttttgtttttcttgcaatagtttgtcttaatttaatctgttgattcccatgtgggaatttcctccccaatcttgtattttaaaatagggacctatgctcatccacatttccgcaagtctaaattaagtcatcatataattaccgtgattaaaattacctatcttctcttctgcagtggttcaggcaacaattgtaacatgtttatcttacacaaacttggattaagtcaggccagactttgcaagctcttggcttcataccatttgatatgatttttctctgcatccccacccaaatttcatctcgagttgtgatccttggtgttggaggaggggccttgtgggaggtgattggatcatgggagtggattcccccgatgctgttcttgtgatagtgagttctcaagagctgatagtataaaagtatgtggcacttacccttttgatctctcctaccaccatgtgaaggtgtttgcttcctcttctgctatgattgtaagtttcctgaggctcccagtcatgcttcctgtgaagcctgaggaattgtgagtcaatgaaatctcttttctttataaattacccagtcttaggtagttctttatagcagtgtgaaaatggactaatacaccactgcactctgttgcccaggctggagtgcagtggtgccatcatcactcactgcagccttgaactcctgggctgaggtgattctcccacatcagcctcccaagtagctgcagctatgggtatgcaccatgatgcctggctaatttttaaattttttgtagagatgggggggtctatctatgttgcccagactggtcttgaactcctagcctcaagtgaccttggcctcccaaagtgtgaggattatgggtatgagctatggtgccagcccccattgtattttagatatcattttggttttgggaggcaagagggtcaagtacagtgatacggtttggctgtgtctccacccaaatgtcaccttgaattgtaataatccccacatgtcaagggtggggccaggtgaagatcaatgaatcatgggtgtggtttctctcatactgttctcatgttagtgaataagtctcatgagatctgatggttttataaatgggagttcccctgcacaagctctcttgcctgccaccatctaagatgcacctttgcttctcccttatcttctgccgtgattgtgaggcctcctcagccatgctgaactgtgaattcattaaacctcttttcttcataaattacccagtcccagatatgtctttattagcagcatgagaacaaactaatacagtaattggtactggtagagtggggtgctgctgtaaagatacctgaaaatgtggaagtgactttgatactgggtaacaggcagaggttggaacagtttggagggctcagaagaggataggaagatgtgggaaagttttaaacttcctagagacttttgaatggctttggccaaaatgctgatagtgatatggacaatgaagtccaggttgaggtggtctcagatggagatgacaaactgttgggaaatggaacaaaggtgactgttgccatgttttaacaaagagactgatggcattttgcccctgccctagagatctgcggaaatttgaatttgagagagatgatttagggtatctggcaaatgaaatttctaagcagcaaagtgttcaagaggtgacttgggtgctgttaaaagcattcagctttatgtattcacaaagatatggtttggaattggaacttatgtttaaaagggaagaagagcagaaaatgtgcagcctaatgatgtggtagaaaagaaaaacccattttctgaggagaaattcaagctggctctagaaatatacgtaagtaatgaggagccaaatgttaactgccaagacaatggggaaaatgtctacaggggatgtcagaggtcttcatggcatcccctcccatcacaggtccagaggctaaggaggaaaaaatggtttcctgggctgggcccagtgccttgctgctttgtgcaatcttgggacttggtgccctatgtcccagccagggctaaaaggggccaccgtaaaggtcaggctgctgctttagagggtacaagccccaagctttggtggctcacacgtggggttgggcctgtgggtgcacagaagtcaagaattgaggtttgggaaatactgcctggatttcagaggatgtatggaaatacctgaatgtccaggcagaggtgtgctgcaggggcaaagccctcatttagaacctctgctagggcagtgcagaaaggaaatatggggtgtgagctcccacacagagtccccactggggcactgcctagtggagctgtaagaagagggccatcatcctccagatcccagaatggtagatacattgacagtttgcactgtgtgcctgaaaaagccacagacactcaatgccagcctgcgaaaacagccaggagcggggctgtacccctcaaagccacagggtagaagctgctcaagaccatgagaacccacctttttcattggtgtgacctggatctgagacatggagttcaaaggagatcattttggagctttaagatttaactgccctgctggattttggacttgtatggggcctatagccccttaattttggcaaatttctcccatttggaatgggtgcatttatccaacgcctgtaccccaattgtatctaggaagtaacttacttgcttttgattttacaggctcctaggcggaagggacttgccttatctcagatgagactgtggacttttgagttaatgctgaaatgagttaagactttggggaactgctgggaaggcatgattggttttgaaatgtgaggacatgagattttggaggggccaggggtggaatgatgtggtttggctctgtgtcccccccaaaatcttaccttgaattgtcaagagaagggccaggtggagataattgaatcatgggggtggtttccctcatactgttctcatggtagtgaatacgtttcatgagatctgatggttttataaatgggagttcccttgcacaagctctcttgcctgctaccatgtaagatgtgcctttgcttctcctttgtcttctgccatgattgtgaggcctccccagacatgctgaactgtgggtccaataaacctctttcctttataaattaccatgtcttgggtatgtctttattagcagcatgagaacagactaatacacacagtgagaaagtcaagaagcatttctttaatggactttgaaaactagatactatgattttgccaataagcaggaaagacatttttctttctttttgattttgtgcatgatggttgttttccatatacaaaatgtagtatatgcctgtctcacattcatgtcatattcgcatagtgactttgccacccatagctttctataggtgcagtatttgtattcaagaacagttactgacttccacatcaattgctttgtagcggaatagctgcctcctggtctatagtggctgacatgaattcactttttaagggggctattgcctcaataaaaagttagaatctggagatgttgatttgcagaggagtgtacacacctggcctgccaaacaactttcatcatatgaataggctgaggtggcttacacaaaaacaaaaaaaaaggacctctttttcttaaagcactaatattttgttgtgtaggcaacattgccttacatgtttaaaacatattgtttttgggaggaattaataatatgtattattgggttgttgggaggaattaataatatgtatacataattttattgagggtttattatgtacctggaattttgcacatgttttctctaatctttacaataatcatatgcagtaggaattactggcactttacttgcacagaaaggaagccttaactgacttgtggaagatggcaaaggtggtaaagaggagttgggattcctgcttaggcctctttggaagcaaagctcttgtctgtctttctcttatgatactttctgtttttttaggagacagggtcttgctctgttgtccaggctggagtgtagtggcacaatcatagctcacagtatccttgaattcctgggctcaagcaatcctcctgtttcagcctcttgtgtagctaggaccacaggtgtgtgccactcacctgatggggtcttgctacgttgcccaggctggtctcaaactcctagcctcaagtgatcctcctgcttctgactcccaaaatgctgggattacaggtgtgagccatcatacccagacagatatgttttgatatagctccaggccagtggttctcaaagcctgggccccaccctggagtaatttatttacaatatctagggcaggatctgggtgtgtagatatatttatagattttattttttagagcagttttaagttctcagcaagattgagcagcaagtacagagagtacttatataccctcttccccacacaggcattagcctcctctgcatttatagaaagctatgagtggcaaaggcactatgatgatggcaatatgacatgaatgtgggccaggcatatattatatttttcatcccccagcaaagtggtacatttgttagaattgatgaacctccatcgacacatcattatcactcagaatccatagtttacattagggtccactcttggtgttttatattctatgggcttgggaaaatatataatgacatgtatgcaccattatagtatcatacaaactctttccactgccctaaaaatgccctgtgcctgcttatttatctttccttccccactaacccctggcaactgctaatccgttttgctgtctccatagtttttccttttcctgaatattacagagttggaatcacagcacatgtacctttacaggttggcttctttcacttagcagtatgcatttaaggtttctctcaggatgtggagagttttaaaaagcaccccagggaatgttaacatgcagccagttttgtgaaccactggtctcaggggtgaaatctagaaacagccagcatttaggtaaagactgggcttctccttgccgctaagagggcaaagttgatcttcatcgcccttgctgtgtttccccatgttgctgagctgcccagtggccttcagcaggaagtcataccctcgctaggaacacagctcgtcatggcctcttgtacctggaatgggtgtcagattctggccccattcttgtaaataaatctctgggttatccctgctaaggatctttgggtggcattttattatctgattcttacctttctcttgcaaagaagcctggagcaagtccttagcagaggttgaaccaaggtgtttccgactttgggaaaaggagtggttaatttagaatgacaggatctgggaatgagatgaaatctgagttgaattctgaaataaggctataacatctatagcatgacagtggggtagggctgtttgggatgaggctttctggaaaggagggaacagtttgagacaagatctgaagcagggaagacagggtgacttaacaaaaatgtgagtgcctatcagagccaggggttttgagtagcccacaggaatggggtagtgatgtgttgtacatgcacttgcgggagataactctgcaaaggctgatgagtcctctctgaggcatgttttagtgtcttcttcacctgtagatccctggagactcaccacctctcataacctttggaaagggtagcttctgactcttcttccttgacatggcagattggaccaaggctgaatgctagaactagttttcagtttagttttagcattcagccttggttcaatttctgtatttgttggttcagatgcccaggggagatcatctagctggcaagagaaccaatcagatggtctcatgtgagcatttgaaccaacaaatatagaaatttcatagtagagggccctgattgtgaaccatcatgcatttaataagtgctgattatctgcctcatgctgttctagggcctattgatacagggatgtacaaggcaaagtccttctttcacagacattaggtttaaatgggaaaatgcacaagtaaataaataagaaaatgtcaggtcataacaaaggcaatggatgaaacagggtcctttgaccgagtgtaatcaggagaaacagatgtcatcaaatggtgggcttggggggagatcagagaagacccttgaaagaatgtgacagggattaatagatatggagtccaaggcaaaaattaggaaaagagttgactagagcatgtgtgtctcatgacagaactagagttggggggagctttgtggtccctcgagatttagggagccacaggtgattcctggttaatttttggttcctttgagccatttcctcccttgcattcttttaataacatctctacacacacacacatacacacatacacacacacacacgcacctacacacaccctctcctgagctcgcttaagtggatcttgcatcttgcatgccaaagtgcttaaaaacagggataaattgaggaagattctgaatggtagtctgtggttttggactttgttctgtctcagaaagggcttttgagcgctatagagtgtctttatgcagtggtgtcagggagaacacattcctttttcgaggatggaaagctactgattgtactgaagctcgcattcctctgccaactgctggaacaggaaaaacaaccatcatcctgactgccagcagtctggccagacaccacctgttctcagtgcctgtgtggggtgtttagcttagctaggcagctccaacagcacctggaatgcaaaaacatcctgaatttctccaaacaccacagcaggactgtttaaacagcaagacattcaggaaatagtcattatctccacacctcctgcattcaatagggtggattgttggatgagcttcagagggcagctccagtgagtgccaagtcctcccggaccagatctcccatccacatgcatgtgccacctgtgggccaatgggtctgggcttctcaggttattggagaggaagttgggcttgattctgtctccctgtgtggagtcctttctgtataccaaatgaactgtcagcatcagcacaaaaaatgggtgcagacttgtgcagggaagaggaagactgctgctgttgcacatattttctatagggagcattttggactattattagggggaaaaggtggaggtgggtgggcgagtctcatctgtctcatttgccttgggatagagaaaggatgtactggtagtcatcagccagtgtcttccttcccttcatttgccccatttttttccccatatttggcaggagtccaaagcaaaccattgatgatcaagcactggatgacagcagtttggtctggttaatattctcatcaaggaatgaggttggtaattaacaactatatgagacttccaaaatactttcattttacaactgcctattgtaaccctctagtgtaccctgatgtgcatacctgttcttttgcggttttaaaactttactgaaaagccaaacactttattcaagtgaattttacagatctggattaggaagcagatcaactgagcttcttcctaggaagaagctaaaagatgctggaataaatcagaaatatggcacttttaaaactcaggtttccacctactattattttaaaaagcatcaaaatgtatatcatttttggtcctaatgaagtagagccccttatgtgaaaataaaaacaaaagcaaaacactcttcgatggtgggggccaatttggtctgaatgttttgatgactccagcatgcctgcagttcatttggccccaaccagtcccagcaaggtagctgacagaggcctgaagttggcagttgcagtcagctgaaattctgaaacccagcaacacatcacttagtcccacttactgagaaaaaatgatttactctatcatatgcactgtaatcccttaatgcctcccaaaatgtatctggtttggaaaatctcacacaacctggataataacacatatttcagaaaagagaatgttttgttaacaagaaaggcaaaacaaaacacagtaaaatcaccctgaaaaagccatgtaagctgcttctattcctagtgactctgagggacttggtataacggaacagtgctttgtagctaggaaaaatggaaaatcagtgaaatggaagacaattgcaaataagtcaaaatattatgttaatgataagtgtatgtaattgtctcttgttctgaacataaaggagaaggtatatattttttttcaagtgaagttagttggtttctccctactctcactaaaaatgtgttgagtcaatatttgaagaattggcacaaaccattagccagcccagagaacccatgtgcctcagtgagtctgataaggtggtatcccaatatacgtcaaataagagtaaggcctctctgactgaagaggaaggctggagacccacagcttcgccccttgctagctgcttttgagtatcttctgtgaagcaacttgcaaaccatggctctactggatcattgtttgatgactcctaatctttatttctttttctgtcttcaccagtctactctcactccatttttgtcttttctaccacccctaagctggtgttttccaaagctagtgctcacagcagtgctggtccctgatgaagttcacactactatctgaagagtggtggaagaaaggcacaatttagtgagtttttgcaaagccaaattgttctatttaagacttttttttcattatgagataatatctgcttattttttggttgttaaaatgttcttttttaatgaaatgatgagaatagcagatttttaaaaattcttttttttgggcaaaatagaaaattactagccctatattagtccccaggttttttttttttaattaaaatcacactttttgggtaaaattccaaaatctaggcatcattattttaaggtacatttaaaaaatttaatggatacataatattttacatatttatggggtgatattttgttacatgcatagaaagtgtaatgataagtctgggtatttggtgtatccatcaccttgaatatttatcatttctttttttttttttttttttttttgagatggaggctggagtgcagtggcatgatctcagctcactgcaacctccacctcctgggttcaagtgattcttgtgcctcagcctcccaagtagctgggattacaggcgtgtgccaccatactcagctaatttttgtatttttagtagagatgggattttacctgtttgccaggctggtcttgaactcctggcttcaagtgatctgaccgacttggactcccaaagtgctgggactataggcgtgagccactgtgcctgaccagtatttatcatttctgtgtgttggtaatatttcaagttatctcttccagctattttgaaatatacaccttgttgctaactatagtcactccactttgctatcaaatattataacttttaacttctatagaactgtaagtttgtacccattaactaaactctctttatccctcctcacccccacataaccttctcagtctctggtacctattattctactctctacttccatgagatcaactttttttagctcccaggtatgagtgagaacgtgtgatatttgtctttctgtgcctggcttattccatttaacataatgacctccagttccatccaagttgctgcaaatgacatgatttcattctttttatggctgaatggaactccatcgcgaatataccacgttttcttttctttctttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatataccacgttttctttctttagtttaaaaatgaaagcaaatttgttaagaaagtaaagaaataaaagaatggctaccccatacgcagagcagtagcatgggctgctagactgagtatacttgtagttatttcttgattgcatgctaaacaaggggtggattattcaccagtttttaaggaaaggggtggagatttcctggaatgagggttcctccatttttttaaagactatatagggtaacttctggacgttgctattgcatttgtaaactgtcatggcgctggtgggagtgccttttagcattgctaacgcattcataataagcatataatggctgggtgtggtggctcatacctgtaattccagcacgttgggaggcccaggcaggtagattgcttgaggccaggagttcgataccagcctggccaacatggagaaaccctgtctctattaaaaatacaaaaaattagccaaacatgtggtgtgcacctggattcccaactacttggctgaggcacgagaattgcttgaacccaggaggtggaggctgcagtgagctgagatcatgccactgcactccagcctgggcaacacagtgagactctgtctcaaaagaaaaaatagcatataatgagcagtgagaatggctagaggtcactttcattgccatcttggttttggtgggttttagccagcttctttaccacatcctattttatcagcagggtttttgtaagctgtatcctgtgataccagtcctgtccacctcttatttcatctgtgactaagaatgcctaacctcctaggaatgcagcagctcttagccttttttatccagcccctattcaagatggagtcactgcctctgacatatttccccccttccttttacaagggaaccctcaatcctaagggttgtagagggatgaaaactcatcttctgtaacttcttcaggctaaataggggcaatgataatcctgcctaactattagggtatttgtatctaggacagagaagaactcaatcagaaagtgtcaatatgctgagggtcattcataactctgagttccaacaaaaggtgatatctggaagattaataagtgttcaatttaagaaaatgttgagtaagcttatcctacattcctacaaagggtacaacagcaatatatgccacaacagcaaagcaaaataagtaaaattatcccaagtaaactaaatagctttccatgaactgggcaattgtgggaaccaagctgatatggagttgctagctggttccagtgtgtgccagaattagaatactgatctagatttttacattacccatcccttttgtttcttctgagctgcagccagagatcactggttgattcacaggaataatcagggttagtctaaattgcaggaaaaaacttaaaaacaactgatgagattagaatctaataacaagtgtaccatggtttttgaaacatactttttctcttcccagttctcattttgattaaaaacaaatcatgatagcactgaattgtttgcaaaataagctttagtcttagacttggcctgattatttatataaagtgtaggaagaataactatttttcacatagactttttaagttggccctgatggaactctgttccataaggaatctcagataagcctttttttttttttaaagccttgagcccagccatggctttgtgccattaaatacctatatgagttgggtacattcctctctcttgaggtctccagacaacttggggctcctaagtctgtcaggaagtgacattctttacttaccacaggtcaggaactctgtacagggactgtgtagacaaagaatgagaccagttttctcaaggggcttttattggctctataagtcaactttgattctttaaacaagtctgtctgtacctgaaagcataccattccagtaaaagccttaataaaataatcagcatttccaattgtgtcctgttacaaaagaaaacagatcattattacacctatgcaaataacgatattgctataaattaagaatacttacaaataggccaggcatggtggctcatacctataatcccagcattttgggaggctgaggtgggcagatcacttgagatcaggagttcgagaccaggctggctaacatggctaaaaatacaaaaattagcctggtgtggtggcgggcacctgtaattccagctacttgggaggctgaggcaagagaatggcttgaacctgggaggtggagattgcagtgagccaagatcatgccactgcactccagcctgggtggcagagcaagactctgtctcaagaaactaaaaaaaaaaaaaaaaaaaggaatactttacaaatagtttccagattctggagaaatcaggtagagagaaacaaatacgcttccaattttgtttatagaagtatactttactcaattgttaaaagctgtaaatagctcaaaagaaaacttttcttctctctgaaaacaaaacaaagaatcagtaacattttaagcaaaaaattataaagggattatttcagtcttctattagttaagttcatgcagttaacctccgttctgcttgatattcatgaacatttcagctttccatgagagtcctgaaagatttttctctattctaatgtcacaatctccaaagttatcagaaacctgcattcaagagcacctgtcagagtcccatagctgattataaaactgccttttaaagaggatcaaaacaagataacaattgtctgtggatgacaaagtcttagggcagccactattaaagccacaattgactagaaattttggttacttctttggcatacaacaactttacataacaattataattgtaaataatgtacactaagtcagaattataggagtttcccataattttggaatatataccaatagcatatttaatgaatacagaccaaagaaagccaaacaccattttatatttgacaatgcttcttttatgattttataccaaataaaccaaaaatagtaagtcatttttggactttaggggacttaatatctaaaagattatttatttggtcagaaaaagacataatttacaatatgattttggaaagtttgtcaaatatcaaaggtttagaagacttggtactataaaatagaatttcaggtcactgtaagtcattcatttagccaaaatgataactcaacaattttaaaaaggcaataacctttactcattattagagaaaagacttagctttccaaacaatctcttttctttcctttctttttcctatagtttatttaaaaggcaaataaaatcttttattatttttaatattacatgaaaattttgttcaagagaaaaagggggatgtttccataccttccaggtggccaagagcacgtgtctctgatctaaaagtgcaaagagctgagtattcccccataactgctattaatatcagccatcttcaaaagtatatttcctacctacttattacacaccaaaactctctcataatatgaagtaattcctgatactctccaaagctgaagacgtcagataatgcaatgcaaaacagaacagagccttagattttgagagggatctatccactttcaattcctggggtttcatgaggaaaatggtgttttcctccccggcagagtctgtggtgcctcttctgtttttcccaaggagtttcaggctgttagaaattatctttggataatttctctcatgtgtgcatcaacagtggcaagaagacaaaatggagaaaaacaattaagtcagctgagaagagaaaaactttttcttcagaaaaataagatccagtaagagaaaaaaacataaaggcctttaaaatatatgtatagcatgtatattgcttttaatttagctgacttttaaccaaatatcttattaccaaagtctatccagaataaacagcaagtatttctggcttttgaactttaccaaaggtaacctcccaggtgctcagagaaaggaaaacccaagacaggaagtcagaagttgtatatggaggggaagaggatcagtaaatggcaaaggtcacacaaatatcaaccagaaagttctcattcctaggctgaaaatggaacctgggctgccattgtgaaaagacaaagccttagctcctaagctacaacattgggcagtttcctctgccctgcccagaaggactctagaggcagccaattttgagcctgcaaaggcttttaactgctcaagagaatttttagagctatgacatgaattccaaaattcctgtctctgaattttggcagagaccaagagcaagtactgccatgtggttatgaggacaagctcctaaggacataagacaagatgagagggaaatatcatctaattttttgtttgtttgtttcagggaagcaaaatttggtaactgaccagtttgctgggatggcttggacagtggacttatgggatcctaggcctgtgttctatcctaaggtacccctccttatgacagaatgatacagaaagacaaattcatagcataaagtccaccggatttgttacagtctaacactagactcacagattattttttcccattgttcaaaacgttgcagaggaggtgaacagtgatttctttaccattcacccaaccagtttgcacagagagcgaggccagaaacctgactggtaagaaattcttacccttttgctggcatgctagatttctgggttcccttttcctcagcacctgtagtgaccctttttgccacattatagtcctgggtgccaagccgcaacacaaaggaaaatcatctttttctgtttcatagaaccataggcaaaagcctatcaagtttgcaagatgccacccaaggggttgcatgggttaaccaaattcacatttcccattctggccagagcaaaatacatgtgacaaaacacagacattagccaccctgtttagcacccaatattgaactggtgaggctcaaacttgccccgagttgggccctgttatctttaatccattcaaagtggggtggaatgacctctaaccaggagtttcaaaatgtggcctctgggtaagatggaagagcagatggcctccttgagtaacagaaaagttaggaaaaggaaaggagagaaagagagagagaaaagcattgcttgcagtgtggtgaggaaggtgagcagctcagggaggccagagaaagacccactgttacccattgcagagacggtgaatcaaaagttcaggcagctgcttgtcagtcacaaaggtatcttttccagcagccccataagctctcaagtttcttcctttgtggagagaaaagctccccatgtcctgtgatcctgtacttgcctaattatgtcacccatagccatcagcaaagagagtaaggcagattaattcaaagagaatagtggttaacatcccataatgtcaaatccatttttaaccaagagactttactgagggggacctttaaccccctaaatcttaggaaggactctaaccttcctaagttgggccttgaaaccaagtttggtcaagtgtccttgccttttattaagaggggcctttagccctctctgtcttaggagggattctaaccctcctaaattgggtctctaacccaatcccatcatttaccctggtgaaatgtacccgccctcttacccaaagtcagccaattgatactgcagtccatttcctttgagttgggggtcttctcactatagtctcttcatggttttccaggaagatgttatgggaaaggggtcccaatccagactgcaagagagggttcttggacatcatgcaagaaagaattctgggtgagttcatagagtaaaatgaaagcaagtttattaagaaagtaaaggaataaaagaatggctaccccataggcagagcagcctataccacattttctttatccattcgtcctcttaggtagattccatatcttcgctattgagaacagtgctgaaataaacatacgggcacaggtatacacttgatatgctggtttcttttcctttggataaattcccaagagtgggattgctagatcatgtggtagttctattttcagttttttgagaaatcttcatattattttccatagtggtgggactaatttacattcccaccaatgatctacaaatgttcccttttctctgcagcctcaccagcatctgttattctatgtcttttcagtaagagccattctgactgatgtgagatggcatctcattgtggttttaatttgcatttctctgattattagtgatgttgagcattttttaatatatctattggccatttgtatgtctttttttgcacaatgtctattcatgttctttgcccactttttaatgggattattattattttactgttgagtttttcgagctccttgtgtatcctggatattaatcccctgtcagatgaatagtttgcaaatattttctcccattcaacaggttgtccctttactctgttgattgtttcttttgctgcgcagaaactttttagtttaatatagacccatttgtctattttgtttctgttgcctgtgcttttgaggttttagccataaaatctttgccttcaccaaagtcctgaagggtttcctctacgttttcttcaagtagctttgtagttttgagtcttacatttaagtctttaatctctcttgagttgattttaagttttttttttaattttaagttttggtagagacagggtctcgctatgctgcccaggctagtctcaagctcctgggctcaagcaatcctcctgcctcagcctctcaaggtgctgggattacaggcgtgagccactgtgcctggccttgagatgatcgttggataagatgagagatagaggtctagtttcatttttctgcatatggatattcaattttcccagaaccatttattgaagagactgtccttctcctaatgtatgttcttggtgcctttgttaaaaaccagctgattgtaaatacatggatttatatctaggttatctattttgttccattgttctatgtgtctgtttttataccaatatcttgctgttttggtttctatagccttgtgatatattttgaagtcaggtagtgtaatgcttctagctatgttccttttgttcaggattgctttggttatttgggctccatataaatttcttttggttccacataaattttaggattattttttctgtttttgtgaaaaatgactttggtattttcacagagattgcattgaatctgtagattgctttggggagcatgtttattttaacaatattaacttctaaaattcatgagcaccaggtatctttctatttgtatcctcttcaatttatctcactggtgttttgtggttttctttgtaaaggtctttcacctccttggttaaatttattccttggtattcttttggtagctatgtaaatgagattcttgatttccttctcagctagattgttattggtgtatagaaaggctactgacttttatatattgattttgtatcctgaaactttactgaatttatttatcagatctaagagttttttgttggaatctctaggtttttccagatatctgatcatgtcatctgcaaagggggataatttgagttcctctttacaaatttgaatgcccttaatttctttctcttgctggactgcaatggctaggacttccagtactgtggtgaacaggagtggtgaaagcaggtgatatggtttggctgtgttcccacccaaatctcatcttgaattgtagctcccataatccccacatgttgtgggagggacctggtgggaggtaattgaaccatggaggtgagttttcccatgctgttcttgtgacagtaagtttcatgaaatctgatggttttacaaaagacagttcccctgcacaactctcttgcctgctgccatgtaagacacacctttgctcctccttcacctccaccatggtggtgagtcctccccagccatgtggaactgtgagtctattaaacctctttttctttataaattaccaagtctgggtaatttaatatagccccatattagtcttcgtgagaacagactaatacagtgggcatccttgtcttgcttcagtttttagaggaaaggctttcagcttttctccattcagcatgatgttagtggtggatttgtcatttttggcctttattatgttgaggtatgttccttccatgcctagtttgttgagagtttttattatgaagatattttaaatgttatcaaatgctttttctgcattgattgagatgatcatatggtttttgtccttcttcgatgctctaccctttctcctgttctctaatgatgcactacagaaatgatccttggaagtacagtcttttaaggtacattttaaagaccttctgtgttttattgaaaaaaggaaatatgcctttttaattataatgttatacatattcattaaaaggatttagaaaatacagatatgatagagtctgtaacattaaaaagtatgaatgtgtaagtaatcacaccttttcccattcccttccctgtcaaaggaagacaggatctagtgttctgctgagaaaatgtgaggttgcagaactgtaaggacagaaagactgaaataatttttagtcaaaagagcccagagcaattggaagaacagaacagaccccaaagcagagagctggggtcagatggagagaaagaaggacaaaattttgtatgtatccgcctagctgtgcgctgtgaaactgagaagaaatatatatatatatatatgattttaaagatgttttcacaagtgtcatgccatctagtaactcttcccactctcttcaaaagaattccataaaaatgtacattgctttttaatgttttcttttgggttttggattcttttgaatgcaaaactgtattgtgactcatcatgaaatacccagttttatttgggttacaaaaaaagaaaacattaaaaattcataattccatctttagactctactagggtttaaaacatggtaaagatagtatgtatgcatatgtttatttatttttttgagatagggtctcactctgttacccaggctggagagcagtgtcacgatctcggctcactgcaatctccgcctccggactcaggtgattctcccacctcagcctcctgagtagctgggactacaggtgtgtgccactgcacctggctaatttttgtattgtttgtagagatggggttttaccatattgcccaggctggtttcaaacttgtgggctcaagtgatccatctgcctcccttccaaaaggctgggattacaggcatgagccaccctgcaaggccaagaatttttttttttttttttttttttttttttttttttttttttttagaacatggctcactgcagcctcgacctcctgggtttaagcagtcctcccatctcagcctcccaagtagctggaactataggcatgcaccaccacatgggctaattagtgtttttttttttttttttttttttttttgtggagatgggttttcgctttatttcccaggttgctcttgaatttgtgagctcaagagatcctccatccttggccccccaatgtgctggggttacaggtgagagccaccatacctggtccatttattgtcttttattcctctgaggagagcacacacacagaaaatacatcatggtcttttcaagcacgtagagcttgctagccactggcttcttctcttgataatggctctaatgtcataattagcttggcctcttctagaatgttcctttctgataaaggcattttggctgtaggaacttgtgaccaatgctgtaggtgcaatctcagaggacttgagacatcaaaaccttttgtttcctctgtgagagagaattctcttctgtgtagagaattattgatcaaccatctttagtttaaatgattatgtgtagctgctagttctaaataatacatggattcccttctgtaattctctatacatgctttcaccaaaataaataaataaatgatgaaaactatggaagacaaaatcctacattattttgaaacaacaaaggctaaaataggggcaaaacccccttcaagtcctttcaagagggttgaaaggaaacttcctttccttctgtttggacctcaggggagattcttatcgtttctggaatcccatgcctgcttatgtttcccagatgttctttcagataattaatccctcctccaatttattcctcctcttctccctgcacccaacagaaataggttgaaaattcttgcacctttttgataagagagaatggacataaaaagcatctaatgactaaaaatcctcatataaatgttgtagaatcatttcaatttttaatagaagtgtacctgttaaaaaaggactagagaatccaccaaatatcagagtcccttggtcttgcattccttagtttcttactcttttttctttggtgatcactgtacctccttccttaccctttctctcttgtccatttctggagagttgctcttgacttccaggaatttcttggcatttctgaaaacctagttcccctcgtccccttcttatccccatggtgtctgatattacttttaatatcatcttcagttatctctgttgcatgttggttccattaatatgtgctgaatagctcctttttgccaggcatgtctcttggaactgaagattgatgcaaagataaattgagatcatggtccctgcccttgaaggtaggagaaaggaaagccccacattaattcactatgcagaatctgactgagatgtcaacaacccacactgttatacagatatgacggcaggtgggggagctggggaggacacttttgtctgcatgactctaaagatctgcctgtttcccctccactgtgctgtcctccctcagctatggctggaaggctgagaaacaaatccactacagttggggaaaaggaacgaccacattgtgagcatccgctatgtgcctgtcactctggatatatcgtttaaaggatataaagtagccattgaattagtgtctgcactttctacatggagggagggttgagatgttttaattaggtgacccagatgcatatttagaggctgtgagtgagaacacagaggacaggaagcatttatagggtggcggtttagggttaaaaagttcgtatttcaagatacagcaggaggcaaaatggacaaggccaaggaagagtggaagtggaaatactatgtctcagagagcaaggggtatagtatttttcctgagataggattgaagaaggggcaatggataaagagatacattcaaagatggagagaagagcatttggagaatctatccccagcaggtttttaccaaagccagtgggtccaatgatgaaggttacattagatcatttcaagggtttggtgtcataaaacacaagagacaaactgtttctattagtagtagaaatgggaaggagcaaaacagatacacactaagtaggtgggatgccagcagttcagtattacctttataatagttacataaaacaagccaggaaagaaagttagtgaatatgggctctgggtcattatagaattcatttagagaagaagaatttcagttagtagccttcctgaaaagagatgataaagaggccaggattacgcccagggtctaagtaccggctgagtatgaggaaattgactctcctccaactctggggtagaagaaacatgattggatcagagggagagagatgattgagtcattagttaggcaaagcaagagctgacgacaatgataaagcactaatgcatccaagagattttttttccccactctagtggcaattttttacactttaaaaaaagaaagtgaagtcgactgatttgtcttgctgactttagaaagcatttaaaaatcttttaatgacactcgattatgttaaacggtacatttctcctctttaatttctgcttgcctcaagtgtgtccacccacttgtcctagtttccctgattaggcacctggtggcaaccaatgatgtgagttacaggaatgaaaaggcataaaaacctactttaggttttactgaagttccaggaggctgggcgtggaggctcccacctgtaatcccagcaccctgggaggctgaggtgggaggatcgcttgagctcaggagtttgagatcagcctgggcaacatagtgagactgtctctacaagaaataaaaaaattagccggtgtgatggtgcacttgtgtagtcccagctattcgagaagctgaggtggggaggataacttgagcccaggagttcaaggctgcagtgagctatgattcagccactgtactccagcctgggcaaaagagtgagactctgtctctagaaaaaaaggttccaagaatgtcatggggaattttatcacttctattctctggacatttcactgggactaatttctctcataaattggatgggtgttttccttgaacagattctggactaaattgggaagtggtacctaagtgccttctttgcctcttttctgtgactcatttcctgctcttcatgtctctctccaatctggatgtttcatattctcataaaggcttgtgctcagtgcctgtcaacttagaagacacctccgctaatgtggagataatagctagccctctaagagcttagcttctgggattcttacaagggccattcagagacctcactttgattgaactcaaatgaaacaatgtttttttttttttggagacagggtctcactttgtcacctaggctggagcacagtggcacaaatatacctcgctatgatctcgaactcctgggctctagcgatcctcctgcctcatcctcctgtgtggctggaactacaggcatgcatcatcatgtccagctaatttttttctttttatttttatagagacagggtcttgctatgttgaccctggtctcaaactcctggcttcaagtgttcctcctgcctcagcctcccaggtcctgggattataggcacaatccactgtgcctggcctgaaacaaatctttaatggtaaaattttaggtatcataataggttgctggagaagtgttctggattaaggaaactttgggagtcctttgaattctaccctgtgagaagcttcacacacttagaatttctgagctcaccagactctgatgtcctagttgctaggagtttagagtaacatgaagctgacacttggacactgttcttttcctctgttaatcatctatgactaaccaaccacattctgcaggacttaaaagtattctagtagccaaattagctagtagtccttaatgcttttaagcatcagaaagtgaaaaatatcaaagaactattgctgcatttgaggagctagaatgaagtttggtttggcttgaggagaattgatgacacccaggagtatgtgctggtttccatttggttcccattcacaggcaaacggaaagtacatacagcctggggtaggtcaggccagcagatatttaagttgttcagtagtggctgggcctgggaatatggggtgattttgaagaattaagttctgcaaaagattcaagagtacaaagctgtcttcatcttagtcaaatgcaggcaatcaatctgtcctttgcatgtaataaactgggaccttagaagtgaagattaaataatctgggatggaaaattggttggagaaggtccagcctgacctacatgtagacatttctcctgccttgtcttgtctcttgctacaaatcatcctgcaaggattaggtaacagcaacttcaattcacacacctttgaaggatggtgacttcagcattatccacggtgaaattcacagccaacaatcaatacgtattttcaggcaaagaaccattattcatttctgttatcggacaatctcaggcagaaatcatatcttttgtgactggaatgcacagcattttcaactgctttattactgcagctgagaatagggctttgcgctgactggcatttagctgctgaagttttctggactggcatttgcattggggtatccaggacaagtgtgggttttgaagggaagggaacgagggggagaagaaggaaagaaagagccgtctgcaggtaaaggccatttttgttagcttgaagcagcatgatttgttatcattgacactgagtgcaatgttgatttaacttttgcactgggggtattgactttacattgaaaagacagacaccaaccattgtctgacaatgaccaacacaatcagaatttcagacctagcatgatgtagaggaggaaagtctgccagaagacaaaggatcttgtcctggttctttgaagaattagttgtgtgaagctagccaagttgctttacctctttgggcatcagtttttgcatctgtaagaagatgtagaatacttgacttatgttcccttccagctctgagaggctttgactctatgattggggttctgttttactcttcattaacatcataaattcataaaatgagggagattgctaaaaaatataaacacaaatatgccttaatccacttattgaagtgccaactgctggctgatttttattttcaaaatcatctattaagaagggaatatgatgaagccattacttagaagttaactagtttcctacacacttttcagatcgtggtaatgatattcaccaacatttgtatagttctctaaagtgtgcagaagattccacatgcaccgtctcattttcttcttccttaatctataactctcagttttgtagtgcagctgaggagggagatgaaaacactgtttacattttttacatcggtttacattttttttggcaaaaaagttgtgttttgtctgaagaatgggtttattaatccagcagtgttcattgagcctctatgaagtgtcaagacctgtgctatagatgaggagatcaggatagacatggtgctacccttgtggagttcacagtgcagtaacaagaacataatcaacacatgattggataaattagagagtggtgagaattttgttgcttcatggaaactgggttgtccaggagtggtgatagaacaagggtactataaccttcccatggctggaaggaacacagtgctcactcctcctctgcaaatgctgtttggggatgtaagttggccatctcaggtcaattttcaggggttgcatcagcccggcacacgaggccccactgattttggtttgagatgcccttccaatcgaaagcccattttcctgtttcacagaatgaaagcaaatactcttaatggggccgttgggcttcaagtctgtgccaaacaattggctttcccagcactttcataaccacgcagctctggatttttcaggagcccgtgcaagactagtttgttgtataaaacgcatccaagaatttttcctcatagcactgaatggtaacttggtggcactggctttgccccacattgtgctaaaatccatgggttcactctctcttttttttttgagacggagtcttgttctgtcacccaggctggagtgcagtggcatgctctcggctcactgcaacctctgcctccagggttcaagcaattctcctgcctcagcctcctgagtagctgggattacaggcacatgccaccacacccggtttatttttgtatttttagtagagacagggttttaccctgttggccaggatagtcttgaaatcctgacctcaggtgatccgctcaccttggcctcccaaaatgcttggaatataggcatgagtcaccacacccggctgggttcactcttaagagatgaattcatcctgtcgttcattatggccaagtcttcacaataggaggcggggcacagtgactctagggtgtgtgtggataggctgcccagtgttgtgtttacattgaggctcatctgcgattccccgtgcctggcatacagcctagcatacagtaggtgctgattacacgcttgcttatccaaaacactactcaaatgtattgctttttactgttttttcttttgtccattttttttgttaattaccaaaataatttatatttaattttttttatttcaatagatttttggggaacagacatgaataagttttttagtggtgatttctgagatattgatgcacccatcaccccagcaatgtacactgtacccaatgtgtggtcttttatcgctcaccccctcctaccctttcccctgagttcctacagtctattgtatcattcttatgccaaagtaatttatgtttgaggtaaaaaaaattaaccatataaaaatgatttaaaagtgaatggtccttcatccccttccacagaaattaccactgtaaaccatttgatccttttagaccttttcaacacatgcatgcattcattcttctcacttcaaaaatagtatttaaaacacagcttgaaactggttatttttacttatcaacaaaaatctgacttttttcatctcagttatattgatctatctgaatcgtttcacaatgcttcatggcataatgcaacataatttgtgaataagtttttctattgaatgacactagttgtttccaatcctttcccaaaggatcgtttgtcaaaatgctttaatgaatttcttgattgtatacatatattttgataattgtgagagcatttcttcagaatatatttctggaagtaaaattgttagggcaagaattatgcataagaaactctttttgtagacactgataaattgcctattaaatgctgtatgaatttctactttaaaatgtttttggtgttagtgataagaaagtcaacccagtgcagaaaggaaatttaatggaccttgtactgaaaggttcagagtgtagctggtttcaggcttggtttgatacaggctcagaaatgatgtcatctggctccaggttctctctcctggcctctcagctcttattcctctttggtggcttcatctcaaacaagtttccctcatagtcttaaaacatctctggctgggtactgtggctcatgcctctaattccagaactttgggaggctgaggcaggaggattgcctatgcccaggagtttgagactagcctgggcaatatagcgagaccctgtctttgcaaaaaattaacaaaaaatttagccaggcatggtggtatgcacttgtagtcctagcttctcaggaggctgaggcaagaggatcacttgagcccaggaggtcaaggctgcagtgagctgtgattatgccactgcattccagcctgggagacagagtgaaccttgtctcaaaaagcaaacgaacaaacaaacaaaaatcaaaactccccaaaacctccaaaacccaaaccaaaccaaaagcaaaaaacaaaacagctgtggaactctaggcttcatcatttcaggttttagctcagtgaatacaggtttatttcccagaagttccagtcagtgtctcatttgatttgattggtcacgtgttcgtctctgaaccacgtagagtgtccagggccatgaaggcttttgttggcccagcctggagctgggtgtagagtcagctgcaccagaactacatgggctgagagcagggcaggatggctcaccaatgaaagttggtagctatttctggaggcagggtcagtgtgtagagtgtgaagtcaataaaggtggatggagtactgtggagacagattctttcctgtggacttatgagtgtaagttcagttttatcttggtctttgggaaagctgtcactgaggatcaatttggtgatatgacttaatgacattccttacaccgctaactgggacgacaattatgtactgctgaagtgtgtttaagggttatccttagataagattggatttatagctgaaaaagaaacacagtccctttaaaagaaggaacagatgaattaaagaacaaaaacatcttaatggttttgttaagattgctatggaaataactgaatgcaaatttcattttaagtctcttgaagttagcaatctattgagaggagagaagtttgcagcaggatttttttttttttttttagagagagagagagaaggaggaggaggagggagaggaagaagacttaaagttggggcaaaaactcttatggttagggcaaaaagagtttgaggttttttaatctggaagagacctgtaagattgtttaggcctatggttctcaaatttgagtgagaatcacctggaaatgttcttaaaacacagatttctggggtgcatcctagagattcttccttagttggtctgggaaagggtcaaatattaacatttctgataaattccccagtgatcctcatgccaacattgtggtggtgaaactggtcgaattttcccatagaactgatatttacaggtttttttttttttttttttaaacaaatgtagaaattgaccctccggggttttaaaacttgaaattttcgtttgcctcatctgggttgcttcctcaggaaatgagccctcaggcaagagactaaaagtcaccagatcactgcaactggataatgacagccagacccttcatttgtcatgattgcttgtttatcctgccctaattccttcccgcctatagctacattccttctaccagtacagaaaccccccagttttagttggccagggagacagatttgaggctttgtttcctgttctccttggctgctgagccaagtgaaagccttcttctttggtaatagtcattgtctcagtgattggcattctgcgtggtgaacagcaggacctagactgacctttggcattggggtaacagtggctgatgctactggtggaggaaccacaccttgagaagcactgatctaggcaccttccactcctctcagtctatagatgggaaaatggaaactcggagaggtgaggggctggctcgcggtgactctgggagaaagcagaggagctggggctagaatcacctctcctggctgcttccctgccctccccttctcccctcttctctttcctctccctgcccgccccttcccttgcctcctcctctctcccccattttcctcccctcctctctctctttccctttccttccttctgtaaaggaactgacccctggtctggttaatgtcaaggttacagagtagagtcaggaaagaacccaaacctcttgacttccaggttggtgcttaccccacgtctcaagtttcctgctcctggagaagcaagacaccaggagattatggggtttccctctcagtagctggatctttctgaaagtgtttttctttgaaggtgagaacaaagacagcctgcattattaggcaggatgtccctgagacacatgacagagggaggctgtcagcagtaacaaagaggctctctggtttgggaaaaaaaggtgcttgtagttgttgtgggagacgaaaaagcgtttctttgactttcttatatttagtacctgggggccttcaaattaaactaacaaagacagattaacagcaggaaaagaaaagcatacagttttattcgtattttacgtgcatgggagttcacagaaaagaagtgaaactcaaagaagtggttagttaggctccagggctaatatcgcattttaacaaaagaaagggggtttaggcttcagaggatgagacagggtagggaagtgactgaaaaatatatgggagaactaatggaagataaaaccttattttagtggggtctgtttttgcagactcctcttggtgtcaactctctgtctctggtgatgactgcttttgctccccggtattggggtgaagggtgggacactttcacaaagggaaatttacaccctgcttttaggcagacaagaggagggcagagaactcttcctgcatctgttgattctcaattgccttcagctcaaaataatccttatgccaaagtggcacgttttgaagcggcatattctggatctcttcattggatggaggattcacagacttgccaacatcaagggtggtgaaatgtagatgcatgctaaagcagtgtcccagtgtcacagggtgagggaatcagggccatgctcatccagcccaggggaagctaagcttagattaaagggacttatttaagagcctagtaaaattaaatttcaaatgatttttattaaaaaacttaccttaattgtgtattatattttagagtctagtatttactgatgttgcttaatgaataactctattttggcttttagaaaatatctgtgttatccatacctatgtaaaggatagttatttttaccactagataattagtaagtgactattatctaccttatcttatcccaattacaggcaacataactaggaagaaataaatggcttcgggcatgctggacttgcgaacacaaatttatgaagtgacagctagtgtcatgatgctcctgcctcaagatgacctcccaacccagagcccggctgcttgggtgaaacattttcccctccctgaattgtcttgcaaaatgtaaacacacattgtcactccgaaggagttagtttatcagatttcttcccttggtgataggagggatctagggcaggctgagcagggaggtgaggtggaggatgacagaagcacagacagggatgcctggggcttgtgactcacccacaggagtacagcaagtgcatgtgagacgcttctcaggatttatatgttagcttttctccccaattttggaaggcaaggaattgtagtcagcaatcggccaggtgaggggagtatttttggtgcaagggactgtccaagggatactgactgcagtgtcctcccatcttcactgttttcttaaagggactcactccttccctgattttctggtgtcctccaggttcatcagcagttatttggatggtcttctgatgtgcaagcccagcgtggtaggatgtggtagaaagggcgtatcacacactgatgctgcatcagctcagtttaacctcagttctactgccatgtgacccgagggccagttataaaccctcttagagctttggtttccttagatgcaaaaggggacaaatttatatatatgtacacacacatatatacacacatatatatgcacacacatatatatatatataaaaaatatattagtgcagattaagggggtaacatgtaaagtatctggtacaataaaatctaggccattgcagtgtaggtttttggaagctgatgctgagatggagtttgggttgcaagacatttattagggatcagctcctgcgcttagaaacggggggaagcaagaactgggcagagggacaggttgagctgtaatgtgggccccggagagccttggccaacccgaggagccctgcagtgagtattgtccatctgcattgtcccatgaggggctgagatggccagcccttagagccttgcttcactcagtcaccagacctggctccctgagaaggaggtgttctagggtgaggcaactccagctgcagaggcagcccctgagctgctgtcagaggctgcctgctctggccacctcctgcagctgcacagcaagtgcttcctgaaggatggtctgggtggctcattttcatgcctaccacataggcatccaacagacatgtctcctccctgctgccagaactatcctcttttttttttaaccttttctccaccttctttctgttctccatctgtcctcttctcttgcacctgcttcttccatccatcctctccacagtcctgggagcttgtggctcctctgcaggggccctagaagtggtgcgtgcctttgctactctctctgccagtcccactgcagcaggaagcatccgacacatttttgtctcacgcagataatgtacaagttacccatgacttctcttttactttggtagagggaagaaaagaaccaggctttattctgcagaataaaacaacacagatgctggtgaatgcactgtcagcccatgcctgccagctgggaccaacaataggagaggaggcactggctgcatcgctaacagatttccaagaacgctatgggcagccaaaaaagccatttgggcttgtttctttttcctctgttgcctttctgagagataaagaggctgatggatcataaatggagatatgaatttgataacatttggaaagaggttaatggaaaccaacgtacaaactacagaataggagaacacggcagatttctaaatgccaatagcatttagaagctgctcttaaagaaaatttgaaggtgagcaggcggtgggcagaggatctgaagcagctgcaagggcctcacatgagtttggaaatgtcttcctaatgtgatggatcctggcatcattccacgcagacgccaggtaggtgtccctgtccacagctctctgagctcctgggataatttcaaaacagcagagagtgagggcatgtgcatcatttgagcacatcatagagggcaccactgattcgctgcactggaagtttgtttgctctatgtgaaatctcttatgtctggcctagaagcctgcatcaaggaactgggaaacaccaccggctccctctgtgagtggcaaccatgaaatccaccctccagtggcctcttgtggactgtggactaacttccttcaggggtcccaggaagtcctagggaagtggaaactcccttccatatcccacttcaagactcagccattgtgcagaagaggccaatagcaagaccccaatttagttccatgcctgaggagttcagcctaaaatcctgaagttgcacagggttttactgtcttattccattctctcaacaatgctgtttcattcgcgaggacaatggcacttggagagattgagtgacttcctcaggtctcaccaattgtaaggagcagggtaggtcctgaattctggcctcttctggatccacagggttctggtgcatggttatcctggttctgatttttctcaaatcagagaagacaaggggacaaagacatttaatcccacggaacctcatgtcagtctcactaagtaaccagggcttcagaggatgccactagtccttgcttgcaagtagtcaggcattatgctgctgcctgctagactgtgttggccactagccacacttggctactgagcccttgaaatgtggccagtctaaactgagatgtgtgtgtgaacttcaaaggctttaaaaaagaaggtaaggctgggtgcagtggctcacacctgtaatcccaacaatttaggaagccaaggagggaggattgcttgagcccagacatttaagaccaggctgggcaacatagtaggaccctgtctttacattaaaaaaaaaaaagaaaagaaaggaaaaaaggaggtagatacctcattaataattttgtattgactatatgttgaaataatatttttgatatgttgggtgaaatacttacatttaaaaactataatttatatttataataatgtaaaatataataaaaatttattttacctaccttcttaattttaacaattgtgcctactagaaaatataaaatacccatgtggtttgcattacatttctattggattactctagattcatctgcatccctaaatgtctttagtctatttttagcttctgcttcttcactctatatcactgttactggtagcgagcgactgggtaggtcatctgctttagactttgaaatttaagaggcagttcacagaatgacggctatttcacactcaggtgagcatggtcataattgggtgctcataggggacttggcggtttaatgtcaatgaagaagcctcctaggggtgatgcctcattcattcaacaaatatttatgttaacagcttctttatgatggatgattatgctaggttctgggactatgtctgggagcaagaaatagtcacaggcattggggagcttatcatctggcaggggcagtagacattgtgatggttaattttgtgtgtccacttgactggctacagggtgcctaggcatttggtcaaacatttttctgggtgtgtctgtgagggtgattttggatgagattaaaatttgaattgatagactgagcaaagcagactctcctccctaaacgtgtgtggtgcttgtccaattggttgaaggcctgaagacaacaaaaaaactgactaagagggaacttccttggcctgactgcttgagttgcaacatcaatcttctacccttgggctgtgacttacaccattggctctcctggttctcaggcctttggattcagactggaatcactccagcagctctcctaggtctttagcatggcaactgcaaatcttgagatttctcagcctctatagttattgatatgatttggctctgtgtccccatccaaatctcatctcaaatcataatccccacatgtcaagggagggatgtgattagacatgggggcggttcccccatgctgttcttgtgatagtgagtgagttctcatgagatctgatggttttataagtgtctggcatttcccctgctgaaacttctctcttctgccgccatgtgaagaaggtccttgcttccccttccaccatgattgtaagattcctaaggcctcccagccgcgtggaactgtgagtcaattaaacctctttcctttataaattacccagtctcaggtatttccttatcgtggtatgagaacggattaatacagttgtgtaagccagctccttataataaatctctctccctctctctgcctctcatctatgtatgtatgtatctgtcatctatctcctataagttgtttcttttgagaactctgactaacatagacattaaataaacaatttgtatactgaataattatataactactgcttgggggtgtggttgtgttgtgtggtgagggggtgtagaaatgtctaggggttgatcaaccctaacaccttccagatgaccctaggttctggcctttccccaaagagtcctggtctactcagtcatctcccacaatttggccatcttcttgggtcctcaggacaataaatgacccagccagatctctaccctaagtctgacttaggatggaaaaatgtctccttatgcctttatcagtcttgacttcaggtcagggaggccagaaaaatgaaatctgctctattttgaaagtttccttcatttcctttttatgatttaaatttatttttataaagtgaattgatgaaaacaaacacctttaacacctctacccctcggtattctacagatttcctgtagttttgacagtgaaacaaaaaacgtcataattcttcacatacttcaatactattcttgcagttctagtcttgcattactggtggagagtctgggggttggagatgggggttacattgtaagggaaagcacatagtttggatgtggtgagagtataatgagattagcgtgcatgtccagctgtctatccactgtctatctaaccatgggtaagttattcaaagttacctcactacagcttccttgtttagccagtggggctcataccacatacctggtgggtttctggaagaattagagataaagtgtagaaagcacctagcaccactctggcatataatggatacccagtaagtggtctctattgatatttttccttgttccttggccctagactggtcaggttgtcagaggaacagaatttgaccacttaattagaacaatgtttcagtaatatatgactgcataacatacaattccaaacttcggatcgtaacatattattatgcacataaatcctatgggtcagaaatttgggcagtgcatgcaggggtgactgtctgtgctccaccatgtctgggttctcagtaggaaggcttgaatggttgaggcctggaatcatctagaggcttcttcacatacatctagctgggatgactcaaaggctgggatcagttgggaccactgaacaaagcacctgtacccagcctcaccacatggcttgggaatcttacaacagtgcaactgagctgtgagagggggagtcttgaaaaggggtgtctgaaagtgagcattctaaaggagcaaggcagaggttgcaaggtttctttgatcttgccttggaagccacacagtgtcatgtattctgcttctcttgtgacaggtgaattaccaaagttagcgtagattcaagctgagagcaactagattctagcagcaaggccacattgcagaagagcatgtaggatggaagatattattaagggcatctttgaaaaatggcatcagctacaaagaacaacctacattagactcctttagacttgtttgttgggcttctcaaaaggaaacagtggagcccaggagtttgagatcagcctgagcagcatagtgagacccccatctcaattatatataaaaaaaggaacagggcactgtgcagttcccttctcaaagggaacaatcacattgcttatgtcaatgtatcttcagagaacaagtttcagcaacattgttgaaatttgcctgaggtaacactgtaagttgatagtgaattagaccctgaaatttcagatattgactatattcaaaattacagtgtatttttaaaaaaataacagctttattgagttataatttgtataccatgtaattttttcatttaaagtgtacatttcagtggttttaatatattcacagagatgtgcaaccttcatcacaagcaattttagaacattgtcattacctcacctagaaatgaaatatctagtgtaacaaacagctgtgtttcagccaatcacaagcaactaataggattcagccaatctcagcagccaactcatcacaccatgtccaaataaggcagatgcctacctgtagccaatcaggtgatttctctgctttgcttgcctgttcagcctttaaaatctctctgcccacactactgggcagggctctctgaacctcttctggtttggagtgctgcccaattcatgaatggttctttgctcaaataaactgttaatttgtctaaaagttttttgctaacagcaatactggaagaattgtactcactgcaaaaatgtctagcatatgttttgtttagcttctaaaaataagattgacattttatttcaacttatcaacaaatacaactccaaaacacaaataccctaatcattttctagtagctgttctccaaggacagaggtgagcttttaatgaaactgatttaattcttcacaacatccctgggggtggtatgggagaagccttaaaaaaagtcaggttttattgaaaacactacctggaaaaatagaattgagatacactaatagtcctctcaacaccaaaaaatcctagatgtgggagatcttgcttagtcaaccctaacttggaacaagagtttgcatttgatcacatccagtgatgacatataattttatccttctccaagctcttttcaaggatcattgtatctgatcctcaaaacattcctggaggcccactttactgtgatattacagatgaggaaacaacccaaaggagctgacatatttaagacccaaagtgactttgacccaaagcctgccacccacaccattccagaccccaaagactagtctgctttttattttcacacttattggagactttctttcatttgcccatggtagtgtttctctttctagaagcttctttattgttttaagatgaaaaaattcatgaccaatttccagaacctcaaaacacaaagcaactgcttattttcctgagctgctgcgtgagtcagtgattcccagtgttgctgtgcctgaaaacccaccactaatgtcagcgccttgtgctgttgagttgcacgcggcgcccctgcagtccagggctggggctagcccggcgagcgcgcggcaggcagagcattcccggacgagtccggtagatggtagcattgtgcagccgatgcgtcctctcccagcttgcgtctcatttttccctctccccctttcctgggctcagcggtgaggctcaggtaccggcgccgccctgatgcctactatgccgcgccatctccagatggtccgcacctggcgggtcacgacgagtctcaatccacagcatggggctgactcggactcaggagtttttgtggctccaggcgtaaccgttgctttggataaaattggtccagttcacttgaccaaggagaagtgcagaggaggataaacgtccccatcccagtggtgtcctctcccgactcctttcgtgtagtgagctttatttttagagactcccgcgcctgccagccgctcatgctcgggttccccaagcggaggggctccgcgtgcagtgtgatgcccactgtcgccggcagagggcaccgtcgtcacacactgcgcaggagccggcgcgggaaggcggcggggctgtccttcccggtcagcgtcctacgcgtgaccttgggacccgcaaatgtctgcgccggaggcattgcctcttcccgactatgggggatactgcacggggctcccgatggcctcttccacgcctggcccttcacttcttgaagctcacccttttcttatttgatctttctagaactggcgctctctcccttcaaattctgtcccaccttggctaggttctggttctgagacttctgtctccctggctgttactttccgtttttcaggaattttcttcctttgccaatcctttaaacgtccctgatcccaggattatttgttcttctaagactcactctgcgcaccctcgcaaacccaccgccaccctcttcactgccttgtcttgacgacaaccacattttaatctccagtctaagtttatcttttgagctacagacccatttcttcattttgccaggccaatagggactgcttggaaataatgcttagaaagcagccagtctaagagctgctatttcattgaggatggtagtcaaggttgtcttctgtctagaaatgctttgaataacaagtgctttgctttcagccagctggtgtttctctctgaagccttcttcaaggtaaaaaaaaaaaaaaagaaagtttttagtgcttacctagagatgcagtcaccaaacttaaccttcccccccattcccctcttctgctgaggaaaccatgccaggccacaggaccaaaacctcctttgctagctccctctgtttagacctggacaggatacctaccttaaggcgacaaaaatgcgtgggaatgggccaatcagagtcttttgagattttgggactggaatgttgaaaagaatggtctggtgaaaatatggagagctctgtagcttctctgtagcgaagaatctgtagacaaaggggtgtgtaaaagatgagttgcctgagggagcaggctgaggtaggaggaggacagagcagacagaggtagtggagagggccagagtgccccagaaagctctgtttcgttcctcaagaaactcaacagtctcttaattttggaaggtttttctttttaaactttttaaattattattattattttttttttttagagacagccttgctatgttgtccaggctggtctcgaactcctgacttcaagtgatccttccacctcggcctcccaaagcactgggattgcaggtgtgaaccactgtgcttggcctatgaaggtttttctatattctgtccatagccccttcatcttgagccagtgcagaactgtagctaattcatgaagaagcagaggacatgaaaaggaaggaaagggaagacgggctgctgacagaatcagcaaggtttagcaggcagctccactgggctggcagagttgggaggttagtggctgttgtggtggtcggggaagcagagaggttaaattccacattcccatgaacttaccactccccttcctgaaaatccccacatcccacctattgctggatcttagcaggttggtcagccatgactccaaaagtcaaatgcatttgcaagtgtcactagacttgtggagtgggataataccaaaagacaaaccctgtcaagtatttatggaatgcttattttataagcatttaaggaaagggctgaggtgagaaataaaactgagtaagataagatgcctaccttcaaggagatcctcagggaacacaggcacttgaacatagcacgggcactaacatagaattaagttcaaaatgccacatgaatacatacaggagaagggaaaattaactccgcctttgatgagggtgggaaggagccagggagaacttcaaaaggggaggtgacttttgagctggaccttgaaggatgagtaggagtttgtcagacagagaagagagatttgcattctagggaaagagagcaaagtgtcaaaagaatacaagtgcatggtgtataggaagacttttagtactgtggagtatctttgttgtatgcatatggggttggggttggggttgggggtgtcagtggcagcagatgacagggaaaaaggaggcaagggccagaatgtgaaggaccttgaatgtcaagattaggagcttggacttgatcctgaggacactgtgaagccacagaagcttttaatcagggagtcttatattagctgcctttggaaggacaaccgcagactgaatagaggatgcctggaaagaggagagagcagaggaggtcagtcacatcgcctgaactcagctgcagctgataaactttctagcaatatcctggggcttagagaagaacaggcaggctgtacattttaactgattgaagcattgtcctcaaggagggctgatgaatccgtgcatgctcaccattagcacggagggtcatggttctactactgagccacagggtgctgcattcattcattaattcatccagcaaacattcattaaatgtctccaagggcccagtttagtctgtcctcttcagcctcagggattggttccaccataccgagggtaccaaatccacaaatgctcaagtcccttacataaaatggcatagaacagttggccatttggtagattcaccaaccaagaatggaaaatatgtacgtacagctggccttcggtgtcactgggtctttatcagcagctggttgaatccatgcatgcaaaaccggtagatacagagggccaactgtacagctttggtgctaaggataacatgggcaggaagtaggcatggcccctgctatcatagagtctgttgttgagggagagagacagctattaatcagatgatttcatgacctagtgcataaatttcccatttggaaggaaaagaatatagttcggtgaaagtgtataacaaagaactccccctggcctcagctttggctaagatgcagagcactactgggaatttaccaggtgagagcagggggttgcaggagaaggagcagaatgtgcaaaggccccgtggcctgaaagaacatggtatggttgaggaactggaagactgtgtgatagggcatcaaaagaagactgagatgagctagtgagagagacaggagccaagccattggatcttttcctgtccaggtcaagctttagataaagtatttgtttagaagaataggtcagttaaatctgaatgatgcaaagctgagaggacaagtggaacatttgaattgcagaatcaagatttaagacaatcttgcaggtctaaattaaaagtgatggaattaaacaaatgtaaagttctacatttatgttaaaagttttaattgacttgcaaagctttgtgtataaggatgcttatcactgcatatttatagcagtgaaaacatgggaaagaagaaatatgcaactgtaggaaaatgattaaatatgcgatgtgttaaaaaaaaatgagaacattagcactgaaggttacttgggttcaaatgctagcttcttttactagccgtaggtcattggacaagttacgtaaactttttgtgcctcagttttcttatctagcatatggggttaataatactgcctcacatagtagatactaaataaccgctacatcagttttagctattgtcattacctagtagtattatgtttacaaatatgtttaatgtcattagaaaatgcttgatagataatattaagtggggaaaaacatatagcattatgcagtttaataccattttgttgcaaattgtgtgtatttgtatttttgtgttgcttatgtcttttgcttcaacttggggtgtaagaaatgatcacatgtggccaggcgcggcagctcacgcctgtaaccccagcactttgggagagcgaggcaggtggatcatgaggtcaagagatggaggccattcttgccaacatggtgaaacgctgtctctactaaagatacaaaaaattagctgggaatggtggcatgcacctgtagtcccagctactcgggaggctgaggcagaaaaatcacttgaacctggcaggcggagcttgcagtgagccgagattgcgccactgcactccagcctggtgacagagtgagacgccgtctcaaaaaaaaaaaaaaaaaaaatgaaatggtcacatgtctccactgaactgagtcattgatctcctcttcccagcaccatgagaaccatcccctgaccagctgtgacagcgcagacaggaatggcccaaggctgggtagccaacagctttcaccagtctgcaggatggtagcatgcatagatttatcagcattaacatgctcgtttctctttcccagtgttttcctttctgtgatacatttaaggttccacagtcccagtttattcaggctaaaggatcagtgatactcccaaatcccttgtagagacagcactggaaaatatgatgggtccaccgtgggctgcatttgctgttccctaacaccagtgcctgctaaaagcagctgtccacacagccttgagctatcactgtctgtgctgtcacagctggtcaggggatagttcctacggagctgggaagagacctcttctcactgtcttatgccagcacggctctgggttctcaatgtttcagcctcttagtttgtcctcatatatacgattctcaaaccatgcccatggggctgcagtggctgctgcggtagaaggttccagccttggcaatgtgctatacctacaacacctccccactaacaccaacaatttagtaatccaggctcctgcagaggacccactgagcttatcagagatgtttggaaacgagtgaacctaaggagaagtagttgggagtcttgatttgttttctcctaggaggcttctagcccccctctcaaatgggctcaactatttagtacttcccagtgacatttggccttggtatcctggggaacaaatggggagctgagaaaaaacattgcctgtgactaacattcctgcctttggtcgatgagcgcctctgccttaaatttgcaaagctaaaagaaactgcctgggtgattgtttccagaacaaaaaaatgtgtcccaggatgacttgttagacatggaagtggctggcaacttttaacttgcagattttcttgctaaaagtttaaaattctgtctcattggggatactgctacatattcatgaaaaagaaattgactattaagaactacaccacaatattagccatgcctacctttgagtggtgggattccaatggactgttttattttttattttgttttgttgttcagatttctgacaacaaatatgtattactttcacaattagaactatagatcctgccaataagtttacttagatccgtcctatttgtttcaaatgacaaccccatccctggcaggcagatttggctctcccttggtaccagtgagaggccactgggtctgtaatacaggagttctgtatagccacagagaaggaggtttgcagttaacctccattctgggctctaactctctctgagttctaagtcctccaacaaggctgccattcacagccaccccttcccaaaggctgccattgggaagtgtgtgtagggtccccaagtccaccctcaggtttgatgattcactagaaggagtcagagaacgcagaaaagctgttatactcccagttatggtttatagagcaaaagatacagattaaaatcaacaaagaaaaaagatatacagagtagagtcaaggagaaattagacagaagcttccagatgttgtcacccagtggggtcacatggataccacttaatccccccagcactgatgtgtggcaacatgcataaagtattgccaatttgagtcttggtgttcagggtttctatgaggggtaagtgacataggaaaagaacacttatgtggctgaccttagctgctgaggctgcagcttccccagaggtcaaactgatggagcatggtcgggtgaatcaaaccaaggatttgccacacatcaccttgttagcataaactatctgttgtggcttagggatccaggtatacaaagacacgctttttttcagacaggatattccaaagtctgacaggttatccccgaggagctggtcaagggccagttcctttttttggaatgtgcagagtttgggcactccaagcctccagtgttaatccttttctgcaccacaggtcaggtcttacaagcataggccttgcccttctgtctgtatctttttttttttttttgagatggagtctcgctgtgtcgctcaggctggagtgcagtggtgtgaactcagctcactgcaacctccgcctcccaggttcaagtgattctgatgtctcagactcccaagtagctgggatgacaggcttgcaccaccacacccagttaatttttgtatttttagtagagacggggtttcatcatgttggccaggctggtcttgaacttctgatctcagtgatctgcccgcttctgcctcccaaagtgctgggattacaggcctgagccaccatgcccagcctgtctatatcctttgcatacttacagttttcctgtttttcatccttttctacatcatggggtctgagccaggtaagcaaagactagctttattctcctcgtggttttatacacttgtggagccggggggctggaactccattactattgttaggctgtttgtccccatccaaatctcatctccagttgtaatccccataatccacatgtgtcaagggtgggacctggtgggaggtgattggatcatgggggtggttttccctatgctgttctcgtgatagtgagtgagttctcccgagatctgatggttttgtaagtgtttgacagttcctcctatgcacgatgctctttcacccgctcccggggaagatgtgcctgcttccccttccaccatgattgtaagtttcccaaggcctccccagccatgcagaactgtgagttaattaaacctgttttctggataaattacccatgagaatggactaatacatctatgtagaaacttggattagcttgacattctcatagtcaatattttgtacttctgaggctgtgttcctgctccactctccctatgaggtcttcctgagaccccttgatgatgggctgcattggctgtatggctgctcagattagggtttggagcatggatggcctatcctggggtcacagacctgtacctcacctggcctgggaccagcctctctctcctggcataccttgggatgaatgccactaccttgcaaagtactttactcccctgctgggtacaaagccttaacacctgtgaagacgaaagaagtctggggattttggttgaccatgagtacaaatgaaaaaaacagggaggtagtcattaagaaactattagacggtatgatctactggaagagtgacagctttagtgtcaagacagctgaatttgaatccctgcttagctattttccagctctgtgaccttgagcaagttattttctctgtaaatttcaatattttcatctatatcatgggaatattaaaatgggccatggttaggattagaaataatgtatacaaagtggctagtccagtgtctagcatgcagtcggttgtaataaataatggttattgctaatattatttggctgtatcaacagagtagctgtttctagatcaaataaggtagttgacacacttcttagcttcatctggggaaacatattcaatttgggaccctccactttgtgtgtgtgtgtttgtgtgtgtgtgtgtgcgcacacatgcatgattaaacatttagatatttccaaggatggtggtcggaaaagcagagaatctgaaaaacatgtcgtatgagggaaatgggaatgtttatcttggcaaagagaaagttgagattgaattgcttttaactgtttgttgggtcaccctgtagaagtggaaatagacacatgggttatagctctgaaggacgtaattagactcagtggggaaactgggaggccagatcctgccagaaacaattctagccatctaacaattagagctgtccagcagtagattaggctgcctctgaattgtcctgttcctggaattatcagaagatgtgagactagtgggagcactgggaaggttttggctttggatgggagcctggatgagaatgaactccaaggctcctttgtctgtagtggccatcttgctcgtttttcttgttaagttcctgtaggaggcaccagtcataaaaaccccttgatattaaataccattatagctctccctctccctctccctctccctctccctctccctgtccgtctccccacggtctccctctccctctcttgccacggtctccctctgatgctgagccgaagctgtcctgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagccttggcctcccgaggtgccgggatggcagacggagttgcgttcactcagtgctcaatggtgcccaggctggagtgcagtggcgtgatctcggctcgctacaacctccacctcccagctgcctgccttggccccccaaagtgccgagattgcagcctctgcccggccgccaccccgtctgggaagtgaggagcgtctctgcctggccgcccatcgtctgggatgtgaggagcgtctctgcctggctgcccagtctggaaagtgaggagcgtctctgcccggccgcccagtctggaaagtgaggagcgtctctgcccggccgccatcccatctaggaagtgaggagcgtctctgcccggccgcccatcgtctgagatgtggggagcgcctctgccctgccgccccgtctgagaagtgaggagaccctctgcctggcaaccaccccgtttgagaagtgagaagcccctccgcccggcagccacaccgtctaagaagtgaggagcccctccgcccggcagccaccccgtctgggaagtgaggagcgtctctgcccggcagccaccccgtccgggagggaggtgggcgtcagccccccgcctggccagcagccccgtccgggagggaggtggggaggtcagccccccacccggccagccaccccgtccgggagggaggtggggggggtcagacccccgcctggccagccgccccatccgggaggtgaggggcgcctctgcccggccgcccctactgggaagtgaggagcccctctgcccggccaccaccccgtctgggaggtgtactcaacagctcattgagaacaggccatgatgacaatggcagctttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccacccctgtgctctctgaaacatgtgctgtgtccactcagggttgaatggattaagggtggtgcaagatgtgctttgttaaacagatgcttgaaggcagcatgctcgttaagagtcatcgccactccctaatctcaagtacccagggacacaaacactgcggaaggccgcagggtcctctgcctaggaaaaccagagacctttgtttacttgtttatctgctgaccttccctccactattgtcctgtgaccctgccaaatccccctctgcgagaaacacccaagaatgatcaataaaaaaaaaaaaaaaaatacgattataacttccaaggagctgcaaacacccatggaatgtaaaacacgaaggtctcttatcctatacctagctttctccctagaatgaaattttaacttggtttgggagagagagagtcccagccagcatttctctttagaatgattaaagtcttgggatccatctggactcattcattttaactattccatttcccaagaatatcatctcattactttttcaatgacccaatattttcagcacaagtgaatgagtccagaaagtcatttcagccatcgattatttttggtaaccttctgatctgctctgaatcccttttcttttaatttccatttatgtcctcgtgtctcgtcatctgttctaagctgaaaatagtaacttggcttgaccttattatctaccatttaagattttatagtctttggttaaatctcatcttaataagtgttcctaggctatagattgtggtttttcctttactttttttttttttaaaggctgttctttgtcactcctatctatgatgacaggaccaacattatggcccttctctgagtatgccagaatctcacttcatctttttgataagaaccatcctcaacatcagcttagtaagttatacctatttgcttagaaacaaagaacacctcctctttagccttgacctgtgtcccaattctgtttctgaatatacctaaaatcctacttacatgggatttaaaatgccactgggtagggcaacgtaccaagtggtattagttaaatcttaatgtggctgagtttgtcagcttcttagaaataagttttgacaactgagaagagattgggcaatagaactctggatttttttttttttgctagactataactgtaactataactataaaactatatatatacatatacatatttgagacagggtcttgctctgtcacccaagctggagtgcagtggtgcaatcatggttcattgcagccttgacctcctgggctcaagtgatcctccctgcctcatcctcctgagtggctgggactataggtgcatgtcaccatgctaggctaatttcaaaattttttgtagagactgagtcacattaagttgccgaggctgaccttgaactcctgggctcaagtgttctgctcaccttggcctcccacattgttgggattacaggcatgagccactgcgcctgaccaaagaatgtcttttaaagcaaatatttattgaatgcatagatgtgattggcagtataacattgaaaaaatcatgaagaagacacagtagtggacctcaaggacctgctatgcaggagtgtgggggtttgggttaagacctgagaaaacatggaaaggagagtttcagatcattagtgacaaacttcagattttgagagcaggatctgggtggcctaaagtagttttcatactcagaagtggagagaaaggagacagaaggtggtagaaaagagtaattttcttttggctccctggcgtgcttttttttcatggatgaatcagagtttctttagattttcaattatctttctagtgtgtcctgcctagctgggcattactcaaaacccatccagtcctctgaggcttgaagggacttctgatgcatgtccttagggcctgtctttgttggtaaatccaatttgagaggaggcagcaaatcaacaggaaaggaaaatatttccctttcttaatggtaaagccctcctctttgttctttgtgccacaaagtcttttttatgttccaggacccagctcaccttccacgtccactatggaatcttttctgatcacccagctggactcgagctttgggtggctgcagtgctgtctgctgtcaccctgagtgcctgagcactcctatggtgcttaccagtccctggttggcattacaggttttcctttcctgtgtaggacaggaggctggccatagtcatatcaccatcatcaacctcaaatagtcagagaagggcgaccaggtcaaggtgctgaggatgaagtccagtactatgccctgccttcagtccagggcttacaatctgggctggtctttctcaaacgggtttgctggtgttacttgaggtctatgaattctgtgagaactttaaaaaattgtgtttatctgtcaataataataaaacattttatcagttataaatacagaaattatttttttataatgataatttgctatggagaggcattttcttatttatttatttatttatgtaactttaattttaatttttttgagacagggttttgctctgtcacccagactggagtgcagcggtgtgatctctgctcacttcagccttaatcttccaggctcaagcgatcctcccacctcagcctccccagtggctgggaatacaggcgcacaccaccatgcccagctagtttttgtaatttttgtagagatggggttcttccatgttgcctagtggtgaatttacttttttttttatgaccatattattcaggggttttacagacaatttctggtaccgaaagactattatttctccagaagaggttcttatattactcaaatatgagagacattggtttagtcaatttcattctgtcattaacaaattcattcattcatcaataaacatttatggtacgcctatttattagatgccaggccgtttgtcaggcacatgagcaagtggtcaggacctgttctgggctccagaatcctcactgctcttcctgacttaccaggtagcccctaccgcagagttcaggctatcgacttctctatgcctcactttctccaccactaataaaagggtaagagagtatatctatttttgtcttttggaggggtagaaaaacatatcctaggatttatttagttatttattttaattaaaaatttttttaatattgccctgagaaagcagataccttaggatttaaaaaccaaacaaaacccaatcgaagtattacttgtttccaaatttggtgtttttgagtcagagacaagcgctaaattcacatttctttccacctcccactaacctcagtgggagggatccaggacccatggaaggtctcaatcagctctaacagaaatgggtcctacaccgtagagcagatttttcacaagagctgtttttagatttgtttatgccgccaccgacctccaatttcacatttcagaaactcccgtggggctgaggagttactccctgggaatcttctctgcttagcaggagctcaagagcagagtgctgatgggtctcatgtttaaagaacaatctgtcacaaagctaaggggcttattactcatcctaacactgagcactaaataaacactggagtagatagagacataacctgggacctttgagcatagagctgatatgaatagtcattaaagtagcacattggcaaacccactacccactggggccattcttgttggaaaagtctgatcatctggcatccagttgcaatgcaatcagtaagaaccattccatggtgcttaaacatgtcagagtaaatctctaacagggccactaccaccccggaagagtaagtgggatgcactttgctttaaagggataccttcctttctcaatatgctcacagacagacggggagccaggatcacgcaatccagttgggcagatttttttctgattctgagcgtcgcatttagcagggcaagtttttgttcccaaagcttcaaggtctggagccagacctccactggtacatgaatcacactgtgtttgggcatcctagaagacatagggtgggcctaccagtgggccagcttatttaccagggcgtgcttgctctctgtggagcaagaactactagggcttttatggggacatgctgccttcattcatccagcaaaaattattgagtgtctactttgtgccagacaccacactagatatcagagacacagagagagataaggcccagttcctactttttaggtgcttataatccaggtggagacacagacaaataacaacacagagcagtaagagtgatgacaagggaaatggagtccttttcttcttgccagtcttggagggttagaaaagccttgttggaaggtggatgttcaaactgagacccagagaatgtacgagttaataggtaaaggcaagaggatggcaaactgtacaagtcccaaggcgtgggacagcatgtagatctgaaactgcacatatttcaagattggctgctcagagagtgcaagatgatatgttgacaaatgagacagaagaggtaaacttccttgataacattgccccttacttatttttctctgcactccttccccaaagcaggtatggcaggtacatctgtgtgtgcatatgtgtgtgtgtgtttgcattaaaaaacaacaactccagcaaacgtttcaattcaaatatttagtttgcttggctgaaaactatttagaaggtaaagtgtttgctccaggtcgggttggggaaaatatcacatgtgaggctagttatcacaggggctgtgacctggtccttgccaagcttccaaatgttcggaagaagttttagtctttaagaaagcaagctaccagggactctcagtatagaaacagaaaggactgtgccagagggatgctaggaaaaaccctcacagtttgcctcatatgaatgtaagacctctgaatgaatagttgtgtatcctatgggacctacagaaacagaaattgtggtcctgtgaataagatggtgacttctatgtgacaacacagcttgttaaatcaagctggcagatgtaattaacaataagcacagtataaagtcttagcatggcagtttacatagtcatagaatgttgcaatagttaacatattggttagatattacaataaagtaacagtggatttaataaaataagaggattatttcttctctcatagaagtctgagctggtaggtggtccaaaggtggtaggtggtaggcagctctgctttatgagtttgtacaggacccagataccttctatcttgttcaactaccatctagggttgaagatgactcactaccaccatgtccaacctccaatttgaaggaaaatggaaaggggaaagttgaaccaacagtacctttatgaaggcatggcctgaaaatggaagattatcacttctctttgcatcacactggcaggtaattggttgcttggccacatgtagctgcaataaaggctgggaactgcagtctctagttgagcggggtatgtttagctagagtttggggtgttattgccaaggggaagaagagaagaatggatagtggtgaacaattagtcaactgtcatagatgtttatctctatcatttgatcctctcaacaaccttgttagaaagcaggcacagattatttaccatcctcatttttgcagatgagaaaattgaggtggaagattaagggactccatcaatatcatacaacgaagccacatggcatagtgggacaactgcaaaaacttggtcaggaggtgccctggttgggcacagtattaaccactgagttttctgaaatgtattcctcagcctgggaacagaatttcccagtgcttgcagcttctttcaagaaaaagcttcccggtaatcacgggttagaggtcggaggagcacaaattcaagggcattttgaacatggccccacatggatgtgatctggctaacccatctttttttttaaattatttattattattattatactttaagttctaaggtacatgtgcacaacgtgcaggttcgttacatatgtatacatgtgccatgttggtgtgctgcacccgttaactcgtcatttacattaggtatatctcctaatgctatccctcccccttccccccaccccatgacaggccccagtgtgtgatgttccccaccctgtgtccacgtgttctcattgttcaattcccacctatgagtgagaatatgcagtgtttcgctttctgtccttgcgatagtttgcccagaatgatggtttccagcttcatccatgtccctacaaaggacatgaacgcatccctttttatggctgcatagtattccatggtgtatatgtgccacattttcttaatccagtctatcattgttggacatttgggttggttccaagtctttgctattgtgaatagtgccgcaataaacatacgtttacatgtgtctttatagcagcatgatttataatcctttggatatatacccagtaatgggatggctgggtcaaatggtatttctagttctagatccttgaggaatcgccacactgacttccacaatggttgaactagtttacagtcccgccaacagtgtaaaagcattcctatttctccatgtcttctccagcacctgttgtttcctgactttttaaagattgccattctaactggtgtgagatggtatttcattgtgcttttgatttgcatttctctgatggcctgtgatagtgagcattttttcatgtgtctgttggctgcataaatgtcttcttttgagaagtgtctgttcatatcctttgcccactttttgatggggttgtttgattttttcttgtaaatttgtgtaagttctttgtagattctgggtattagccttttgtcagatgggtaggttgtaaaaattttctcccattctgtagtggctaacccatctttgcctcttccagtccaagcacagacaatgagcagagaggaggacaatgtgggttaatggaaagaacactggattggggtcaggagaccccaagaacattgaattggagtcatttttagctcacatcaattgcatgcctgtgaagtgacagctactgagcttgacactggcatgtcttctcatttaatctcagaacaacactgtgaggtagatgttactatgtatatcttacagaagacaaaactgaggcccaaagagctgagtggcccaaagttatatagcttgtgagaggtagggctggaattctaacctagaccttctgactgctaaccccaagcccttctacaaaatcatactgttctttacgccaagtaactgctgggcaagctggaactgaaatgggatatgtcaccagtcacacggatgacccgtaacacgtctacctggggcccaggtacttaggttgtgtactttgtgagtctgctttttgtgtgtgaaggaaacccgtatatcagaggttggatcccctaaattggccttacccacacattctgcttgatctaccttctctgggctatgcttttttctttgttaattttcttctcttttcaaaattgctgaaggaatgtatgttcataaaattcaaataatgtagaaaagtcagagatcaattaggatgcttccctaacctctctaactccttttccagtccctttccagaggagaccactttcagcagtctggggagcacctttggatgtttcttgtctaagcatttatttttgtcaagatttttaaaaagtaaaaatgggaatgtgtgtgctgttttgcagttcactttttccacttcacaataccttgggtttatctttctataccagtatattaaaactgatctcattattgctggtggacatgtgttgcactagacacacacctgacttcaggtcctgctccgtttggtattttatgatgtgtggttaatggtgtggagtttagatccattcaacctccgtcctgaatcctggatccatcacttattagctgcgtgatcctgggaaactgacttaatggctccatgcctcagtttcttcgcctgtaaagtggggttaatatcggtaacctacctcataggatgctaggaggactgagttaacgcatgtaacacatttacaacagagcctgcaacatatgctatatgagtgctagatgaggtttagctattcttttcacacctgaatactatttcataatatatttagtctattacttgacatataagttgtttgtgattcttttttttttttttttttgctaaaacaaacactgttgtgatcagtatacgtttacatatccctttgtgcacatgtggaagtgtttctgtagaataaatttcttggaatagcattagtgggcctgagggtgtggggattttcagtggtaacatcagttggtgggctctgcttgaccatgcttttcttggttcactcatatcagctcacccagtagcagctgttgggcatcctgccagtgtccttccgtcacatgtccagtggttggcagagctatgtggcagtaagcattcctctttgtcttcccagggcctggccctttgtcagcgttcattagactggatggcttggcttcctggtgatcctgatggagattctgaattgctactttatgtaaagcatggtgcccgggggagacatgcccagggccaagaaccttgatcagacccacatgcccagcgtaaggctgaggatgagattgtacaagtggtcaagagaatcaacatggtttcacccttgaatcagtccaggttcactaggggttccatgacatggcactttttaacttggcgatcatgtctttgctcagtgatatggggtaggtgtggatgtgatgattcacacgatgcagggatcgagtgcacctcccaaaaaacaggaagtgaaataaagcggcactgtgtattgctgctatgacatttctcttgatcttattaacacaggaggggctaagcaataaatgtgataatctcacttggggaatttggggttggttgtttatccaatccttgaacatttattgaacagttattttgtgtcagacacggttattgatgttggggtatggaactatggactaaggcataatttcaacctttgaaaactccacagaagctttaagaacccttgaggagacttaatttttcaagaacaatgggaatgaagatataatactgcaggtggggcctgagctccaccctggatgaggctgggggatgggtatgcatgggattattggggtcccttcacacagaaatgctcactggagaggctttcctgtacaaatattagaaatgtaaaattacatgttaatttctttttctgtgcttagaaaaggtgcaggatatataatttagaaaaatgtaaaggaaagttaaagatcacctataactgtctcatcccaatgcaaccattgtggaatgtacgtgtatttatttctttatcatgtttgtatgtaggtgcattttaaaagcaaaattaggaatcatacttcatattctgctttgtgacttgctttgtcactcaaactgcattagaagcatttcacaaatctttgaatattcctttactacatgatatgtaatggattatggtgttctgttatatattatagtcaagttagtcaattaatgatttgaaagggcacactggttaattattgttgtcttttctcctacgcctcctggttttggcttttattattttgtaaagatgcaggagaaatcttgagttctgagtggttatcccatcctttgtgaacactgctgtcaggcacacaaaacaacatgggctgggcatggtggcgggcgcctgcagtcgagaggctgaggcaagagaatctcttgaacctgggaagtggaggttgcagtgagccgagatcgtgccactgcattccagcctgggcgacaagagcaagactccatctcaaaaaacaaacaaacaaacacacacacacacacacacacacacacacacaaacccacaacatgattccagtttctatgctcattttagaatcctgcacctgaccaccacgcaaaaattcctctggataacttcatctgggccttccctccggtggaactggaagattgttttccaaactccactccttttccatttgtgttgtccactcaccgagtgccccttcttctttcatttttagacacctcggctgcagctgactccagaaacatattccctctttaagtctcggctccacaggttgcctcttctcctcatcatttctcgtttctcaccgtgaaaatctttgctttctctctttatggcttcctgagacccgaaaatagaggtaatttaaatttggtaattatgatgacaacaaaacaacttatgttgaaatgcagagtttaaaatgccagagtttcctactgttgagatctctctgccttcattctgtggataccgctgtgggagcttacctgagtctgccccagatcaggaggccaagcatgaggcgatgagaaacagcttctgcacagaggtggtgacttctacctcttgggggatgggggctggtcagccagagctaccacattcaggttcagccccttcagaccttcctaagctccaggtggaatctttgccttcccaccttctggaccctgcacggggagggtctcgggctgtagccacgaggcggcattaggcagctagaatcacagagtggggactgggggatggggtttcttctctgacagtggttaggtgagtcactctctgtgggctgctcatggcagcctcttcctccatccttgaagcgggccttccaaagacttcacctgctccgttataaaaggctttgagttctgcaagaggcagctgtgaatgtattagcatcctgctttctgtatgaacatcctgctttctggcacatggctaggccaccgcttaaacaaccggcgccaattcacagtgaaaaaagatctgctcaaagctggtttcagaaggaggacacgggaggcgtataatatcgagcccgtctcccgacggtgccatctgttctcattaaggcagccacagcgccgaaggaagggcctccaggtgcacacaaggaagcctgctcgccttgttatcctctcagagactttgccttttgttttgtttagttttgtttttgtctggcaggctcaaaaagacactgttctactttccgcagaagaatcactctcacattttaagaaattaagtctctgggaaaaaaaatattgtttgagagggcttgtaatggctccttgaccacatgctgtgcctgccaatttataacagagaaatattacagaagttgggatccaaggttggtgtgcacagccattgcttaaagagggatggatgcttcctggggacaatgatcttcccccgggccccccagcatttattcaatctggagagaattgtctgccaggctcccactcctacatcccaggaagagctgggcacattcatcatcttgtgtattcagaaagtgatgataattcctctgagagccaactgggctggggagggtgtgatcaaacttctgctggcaatcagactgcctttggggaggggagtctccattttgcaggtatgtctctactgccagtctgcagggaagcctacccagtcaacaatatgttaccatgaaaatctccttttgggggtatcttatatcacattatagggaaaggcagaggaaatatcaaaagcatttggccctgaatttaaaatgatctttccgtagatttttatagactttgttttacaagattggtgtaaggcctaaagcatgtcttcaggcctcttacatatcctccttctctctgggggtttccttcctgcctgccctcaacatcccttaccacacacctattctgtttctccccacatgcatggtttgtatattatgtcctgtcagtcaattcctactaaaatgttagctgatgttagggtattctcgtgggaagatatttgcattttaataggtggcttgaatatagaaaagcttcatcctaaagttgcaaaactttaggggaaaaacaggcaattttggatagagtgagggatgaggggatgagaagggggaatgtatgtgaggtcagagacattctcacatctcactgtgcatcatccatagaacttgcctttcttttctctcttttttttctttgtccctgacctcagagtaaatggcacctcacacactcttgtgggccagaaagaaagtctttcataggcagataggaaataagacagcagtttttccaagagtactgaaatgcaacaagtctactggtctgttgagttaaaaaatggtcagtttggttgttcttgttcatctagttcagctgattggttcggtagaagcaatagagtactgtactacagtatagtaaaactgttgcttcacagcagccatccctaaactttttggcaccagggactggtttcatggaagacgtttttttttccacagaaggggcgggagatggttttgggatgaaactgttccacctcagacaagatcatcagctattagcatattagattctcataaggagaacacaaccgaaatcccttgcatgagcaattcacaatagggcttgcacccctatgagaatctaatgcagctgctgatccgacaggaggcggagctcaggtggtaatgctgctcacttcctgctgtggggccctgttcctaactcataccagtttgtggaccaggggctggggacccctgatttacagcactaagttaccagtttccacgtcggtgggattggcggaaacttttcaagctctgtgtgatggagtaacacagggtagaaagagtacccttgtgaaaagcctggctgcatctgcccctttataaaggagacaattgaagctaatttatttttaaaacacaaaatgaaatttggtttgaaatttgaggaggagatacattgatgttgcctctgagaaggagtcaaagaccaataaaaggtggttctttctgttcccaaacccagaagccaataggggccacagaaggagcacagtgccacggtgaccatgctgcagcattgtcagatttagcaagaagaaatacagggtgcccagggaagtttgaatttctgatgaacactgaagactcttttagtatgtatgatttttggaacatatttatagaaaaaaattatttatctgaattcaaactgagtgtcctatatttttgtctggcaatctggtaccatactgcccctttgtaattccttgtatatgttgttaaagaataatttttctgaagggtaaaattataactcttgtatgattataaaatgaacatgtgtcaaagatttttttagttcactgattaatgagcgaatcagtaagatgtcacaactggttagaagaattcagaacacacacacacacacacacacacgcacgcacacacacaatcaggaaaggctgaactgaatttgttaatagttgcaaaactacccaaattcctaggacaataatcaactgcattccactgggcaaaattaatttgcgtttctatggacaagaatcatttgcattactctcagttttctacaacttgcagtagttgtaaaataggccaaagacaatgaacactacagaataaccaggaagggtgtgttagaacatccatgaatcatctttgcctatttcaaagcctttcacaatggaaacatttgacagtgttgtgctctctcctatctcgggcctttgcacctgatggttcctccacttttttagttgtcttgaacttacccttgactgtgggagatcaggatatgccactccaaaatatgcctctttggcatgaggattgttgagctgaccgcaaataaggagaaacacatgcaggaaagcaccctgctctttccctatttgcctcaaatcaggacatacatttatgaagacaaaagacatcccacctcctcttgctccccaggcaaacagagattaaccacttaagacaactttggatccttacatgcctggagagagcaccagaggaacctacattaacaagcttcaccaactagcctttatctgccaattatttgcctttccaaaagttgctgcccctaaggactcaaagttcttttcctttgtgtcacaaatctaaaaacgtactgttccttgttgaagatactatataaattggtattcaaagccacctcttcgaaagtttcttattctctgggtttctcccatgtatgtatgaaatatacgtacatcaaacaaacatctgtttgtttttctctcgttaacctttttttttttgtttgttacaggggactgttctaagaacttataagagttaagaaaaaaaattatcttcaaacatcattacctctggaaagctcttcctgacccacaaactaggttgggttcatgtgctacaagctctcacaggaccatgtttccttcattagggcatttatgtgagtttataattcatcctccttactgaggtttctaagtccttgcatgatctgacccctgcacccatcagcttccctttcaataactgtgctctggtcatacttctctcccttctgttcctcgaccataacaagttcttccctgccttaaggactttgcacctgttgttccctgtgcccggaatattttttctcttggctcttgcaaggcatgtttcttttcatccgtcaggtctcagtttgaatgtcagaaaagcctctcctgattatcttatctaaagatgctcccttctccaccctcactttctattctagtgattcctcagccttagcacagattagaatcacctggcaggcctgataaaacaaaggttgctggggcccatggccagagtttttgattcagcaggtttggaagcagcatgaagttctgtgttttaccaagttctcagttgatgctgatgctgccaggatgggcatcactcttggagaaacactgctctgagtgttttctttcaacacctgacattattttccccctttgctgatttgctttctgtctcccatagagctgaaagttccacacgagcagagatagtgatgctcctattttctgattcatctacggtactaagaacagtgccttatataaaagaagtttaatgattatttgatgaatgaatgaatgaaccattttctatttttttgttttgtattgtaacaaagggtttgcttaccaaattactgttgaactgaggtgccagaaccaagttatagagattggctttcatcactaagatatgtttgtggaagagtagttgtcttaatttaataaaccacaacaatatttgaccagtaacttgaataaagacaagtgcctactgcggcctacactttccattagcacgccttcctgcttagggtcaatgtcattaaccaacagttggttagatgacatcagggctttaggtgctattgacaggtctcaagaagatatgagttttgccaagactggtagctatgatgagcattcagaagacatatatggcaagtggggtgagggaagggcttgtgctttggctttaagcatgcctcatggatgaagcagcttgggtaaaggaagggagagagaggaagcagggagaatccttcctccaagctaggttataggcagtgctctcacatccctggtcttggcaggtcctaactccaggcctcctgatgcccatattctgttccaaagaccacagtccaggctttagggcatagcctcaggctctcctacccactaaccctctaggttctgtttgtttccccccttctactctcttctatgccattcctctaggcttttaccttgccatgtgacaggcttatgtggtaaactaatgggtcctaatgactgccacacacacacacacacacacacacacacacacacacacccctatatataaggccacatgcggtggttcacgcctgtaatcccagcactttgtgaggccgaggcgagtggattgcttgagctcaggagcttgagaccagcctgggcaacatagtgaatccctgtctctacaaaaaagttcaaaaattagccaggcatggcggcgctcacatgtagtcccagctacttgggagtctgaggcaggaggattgcttgagtccaggaggtcgaggctgtagtgagccatgttcatggcctgggtgacaaagtgagaccctgtctcaaaaaaatatttatatatccatatgtatctccttggggtgtgtgtgtgtagtgagacacaatatggcatagtgcctaaaagcatatactctgaagccaatcctatgtttgaatcttttttctgctaaatactgtgtgtccctgagaaagttgcttacccattctgttcttcatattacggggttaacaacagcactaaatcatagggttgttgtagatataaaagcgataataattgtaaagggtttagttcctgtgccttgtagctaccaggataataggcctaatagacagcaccctatggaaacagctttccattttaacaagggactttggtaaacacatgcgctgagtacaacactcttggaagatcagatatttgatggcattcagatgacagcatgtgagcagatgcctattctgtctgggtgttaggggacagagcactaggtgacttggctgctgtctctgatcttaaaaattgctcagaccctggcaattgaggataagacaataatagcaatgttgtattcaggagcgttgctttaaataatccttctccctaatagctttgcccctggcgtgtgacaggtgtttacattattaagtaaaagcatttaaacagcgacctccttggtataagggtgaaggagattaaaatccaagcagtgctccagctatttaaatcaatgagacttgtcagatctgtaacacatgagctacttagagggcgcaggcacctattgttttggagcttcgactaatatctcaatatgctccctccctccaagtctagccaggccctgggatgctcattaaaggctggtctgaccacggcctctttccctgtggaagcagcattaactaactcttggctagatgcgtggcaaatagttatgctattagggaggatcagagcttgagttgattcctgcttagagaaatgaccttgcacggaattccagcggttaagttccttagctaaccagaagcagggaccataaacattgtccccttcttccgctagggggtgctaaaccaggctgcttggctttgcccacagccatcctttcttgagttgtgttttcccagtctttagctatgacattgacaacttcaggtccacctgctgcattgaggaaccaagtttctgaaacttaaatctctctcttttttaaagcttcatgctctcatcatgaacaagaaacctctctcttccttagtaatcaaacttagatccttcatttgtgtcaacggaagggaagtctccacgtaagaagagcagctggaccttaaagatccaactcttattcctcaagatttattgtccccttggaggtctctagctaatttctgcaggtcctacaaggctggcttcagagggagctgattcattattaattctccagttctaagcaggcgaacaaggtgggggacacttgaaccttttaattccttggattcacagctgagccaggctggccacaaaaggaactgcacacaggcagggttacaaggcaaagtttacttttcttcaatttatggcctcatatgtctgcctgtctgactcatggaatgttgccaggtggagggttcctgatgccaagagaccgcttaagcctcatctgtggaagtgctggttcagcagagggtgaagcactttcttcctgggtggtctcaagttctcttttcctggtgattgactttgggaagttcttcctgtcacaggaaagccctacttctatccatagcagcaggtgaggccacagcctttagtctctacatgacttctttgtcaaaatgcaacatcaaagggttcacaaggaaaagagacccatgcaaataatccctggctgctcacagtgtcaggaccagcagcacaagtatcccctgggagcctattagaaatgcagaatctcaggcccccagcccttttgaaacagaatttgcattttaacaagctgcctagatagtttgtgtgcatgctgcagcttgggaaatagtgacagagcagagagacagccttttgtctacactgtctctttccaccacaagaaacaactgcattaaagcttggttcaaggaaaagtcctgtgatgtccctgtcctttggagctgaggaattaacatgggctctgtggggtttttctggaggatggcagaattgttggggatgcttgaacttctgaaaatgtttgaagggagaaggaatgtaacgaaccttctgctcagagcaaagcaatgagaccgcatcatgggttagagaccactgcacaagttgctttgcttatttctataattgtggtcagtacctctgccatctgccatcttcctacagcagtgtgtaggcctctaggaggctttagcaagatcagcacccaggtggaggcctcttagaagaaaaaaccctgtcaaagtgcaggggactcccagacaatgcaacattcatttaggccaatcaattctgtcaaaaattcattcgatgaaaatagtaccaagtgggtactcaactgcttagccaatttagtctccacagcaactctgaggctacaggtaaatacagtctcaggcacggaaggaaatctggtatttattcagagaggcagtagacatccctctgtccctgacttgctagctatgtgacccaaggcaagttacttaccttccccaaccagtagcttctccattttaaaatgggttatcagaaggtattgatcttctgggtgtgttgtaaatgctaagcttactattcattctaggccagccaggcatggtggctcatgcctgtaatcccagcactttgggaggcccaagcgaggggattgcttgagccctggagtttgagaccagcctaggaaacatagtgagacccagtcccagcaaaaaataaaaaaaaattagctgagtgtggtggtgcatgcttgtagtcacagctacttaggaggatgaaataggagaatcacttgagcccaagagctcaaggctgcagtaagccatgattgtgctatttcactccagcctgagtgacagagcaagactctgtttaaaaaaaaaaaagcaccctgtaatgctattactcacacgtaaagtcttctctataggaggtaagaatgatatttcaggagtgtaaagaatcttgatgtcaccttatggaaaggggatgaaaaagaagatgaaaaaggcttgttttcattttgccagagtcatggattccagttccaggtctgttttgcatcaccatagtcccaaacaagtgtaacatccagagcccaggaggaattctggatgaaatatcagccaggagcaggagtgtgacagctgtaggtcacttgggccataaagttagttaatggggaagacagatgaatgagtgtattgtggcaacatatcagaaggtctgaggcataaatagtgttggaaaataataagacagttggttcttgaggatcaacattgcagggaaggagaaatgcacaacaaaagaccatgttgtgtttttggatggtggccggggatgcacattcactgcccctcccctcttcaaccccactctccacatcccgtgacctggtgggatgccagtggtcatgagatcccatcacatacatgagtttcaagagtcactaacaagcttgtaaagaacaggtactttctaaggaatattcactcttgcagctgtattcctagggcttaaatagcacactgttttccactgacaaatgatttcgggtagggtgatctcatgaacttgtactaatggcagacacatttgaatttcttttttattctgaaagttaactgctgaaagcaaatgtgaaaaaaaaattatctccctctgttttatctctgggagaagataaaaatacgaggtgttttaatttggcagtgatctgggcgccttccgctggcctgtttttcttttgcgaagagctcccactttcaggactgccgtttctttgatcttatattctgtctgtgttcaggtacccctttgtgcctacctgaatcgtgtgtaacaaatcatcttaattacttcaggcctggcttcctcctccagttctcattttctgaaattcctgcgatggttaccaaataaatcagtgtggggctccagcccttggaaacagcacggaggcaccagcagcagccagaggaatttcaaagttagttaaaaggcacaggaggagtgagggaattgattgagaacctccctacccaccatgattttcagcctggagagttagtgctgcctgtactccaattccatgtgctttgcggggctcagccctcacacttttccccgtagaagagagaataattaatgccgtgaccccttggcgtggtagctagagccctgctgtcatcagcagtgccccaaacgcagtaggaacacgtaccgtatttcaaagcccaggcaggcagagaagggggaaggaactggtggcgcgctgtgacctgcgggagctccccagcgcagccagcaggaggcccaagctaggcggagagagggtcgtggggaagcgggccgctcccgggactcgtcactgggttggagctggcccgcttgagtggctccagttccaggaaggccgggtggcgtggggctgtgtttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggggctgtgttttaagtggccgtttgtaagaagaacctctggcggagaggtgctgaggcaggctgggctgtgatcctgcacgccaggcggcctaaggggaggtaattgggaaccgcgagctgacactgcggaaaaaccaaacaccgcatattctcactcataggtgggaattgaacaatgagaacacatggacacaggaaggggaacatcacactctggggactgttgtggggtggggggaggggggagggatagatttaggagatatacctaatgttaaatgacgagttaatgggtgcagcacaccagctagcacatgtatacatatgtaactaacatgcacattgtgcacatgtaccctaaaacttaaagtataataataataataataataaaagaaattggtatttactaagaaaaaaagtgagagttctgtgtaggcctttgaaaaacacaaatctcttacttggggagacattccagtttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttgggtccgatagaagtttcaaaatcaaaatttttcaccatcctcgttgggtgatggtttgtagaatatttttgagggagtcttgtttgaggcggacagactcactcatctggtacactctttttcgagaacatggtgataaaataggttggctctaacgagaaggtgtcattccgccactccctttcccaagagggcttcgagggacactcaagtgaccaggatgtggcttatcctgtgatagccatctgagaacgttgttctctgttctttacttgcttctagtcagaaaacatggcctgtgttaggcaccctaggggataaagtgaattagacctggacctgactccagttttttcttttaaaactcactcgttttttcttcaaaaaataactcccccggtgtttctaatgtacagctgttttttgttgggaattactacattaaattatctctaagactcttctcatttcagatattttttggtttcctaattgtctaaaatttttaattatttttatttttattttttatttttttgcagacgtgaggcctccctatgtcgcccaggctagtctcgaactcctgggcttaagcgatcctgccacttcagcttcccaaagtgttgggattacaggcccgagtcactgtgccagcttcccctagttcttgagctcttctagggccactagattctctttcaccagcatgaagtaggatcattttagttagggtcaaattataaccttaaatcccaagtgacactgttcttttgtgaccactaacccctcaaaagatttttttttttctgatttcaaaacttctcctcctaaatcatcctgcaaattttactgaatctctactgcatgccagaggccccattctaggcattggggaaaaatacagtggtgcagacaaggagcctgttctcatggagcttacattctagaatcggatccagatcgttatgaatttcccctttattttgttttagtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggaggtgaggcctttgggaggtaattaggtcatgaggaaagaaccctcatgaatggaattagtgccttttagaaagaggcaggagagctagctcatttgcttgccaccttgggaggatacaacacgaagttggcagtttgcaacctggaagagagtcctcgccagcacctgaccatgctggcaccctgatcgctgactttcagcctccagaaatatgggaaatttctgttctttataagtcacccagtctatactactttattatagcagctggaactaaggcacttgtttatccttcatctgtaggaaaatgctaaatcagataatggcaaccactgtgaactatattatctctagggtattatggggtctccatggcaggtgagagaaatatctttttataactaaaaatgttgagcactctaaccatttggatgcatattttttactctctgtatttaaaagttaagtctcattttctacttgtagttgacatctgttgttatcatttacttctctgttacatgcagggaggatacattccctagtcttccatttttgtgtgtagggactttttcagaaaacactcctagctccttggtttcctgtatcccccttttcccttcccctcaagggaggaagcgtgagctacttgatgggtgagtttgggtgcagtggctgagcatgtgactctcagcccctttctattttctctttgtcacctacaagtgtgcaaacagctttctatgctcttccatgccatacatgacaggagcaggcccccatgggagactgcatgtccgtgatggggcaggcccatctaattcaggaagcaagctcatttggttaacagacctaaagccatgttgtaaggctgacattttagggcttttctacttggctcctgggtctttctctcaactggctccaaactaaggtggggcattgagctttctcaaaccccaacagtacccatatctcaattccctagagaaccaccttctccagctcatagtaagtttgaattaagtgaaactgactctacacatgagacccacaattagctccccttggctacaagatttgtttaaggatgaacatagggcccagtcagatctaatgaatcacagtgatgttttcctcgttgaggaactcttaattttatctgctggacctaaaggagggtgtagggattacagccattgctgccatcccattacaacatgaagccaagagatgtagaaaaatgctcctgatgccattggttgagttcaggtttcagccacatctgaaatgtattctacccctggacttttcatcttaagtgaaacaataagttccctttgtgcttaagctagtttgggtccgtttcctactgctttcaatggtaaatggatcattctttatattattttcatattgttagttttaattgattttagatcaccacagatcacctcaattactcacgttagatcccaggagctagaagcgattttagaaagtgttaatagcaggaggatacttaggttttaatgttgagatgttaattattttaggcaccttttattacctatttactttgtctatttatttgttattttttggtaaacaaatctgatggggtacttgactatagtaagtctttaatcaaactttaacaatgcaatcagttcattttttccttttgattaactggagaagagcaactcttggtctttaaagtcatagtgatcattataaatatcctcaaggaaacaacaaactcttgaggaaagttatttcagttacatcccaacataagagactggaaattttttaccaagaattctggtagaggtgtaatataaccaggagggtgttgtggtttggatggacaatgagaagagagaagggccttctgggaatggggaagaaaatcagtggagttaagagtgaggcacattcatagctgctgaggtggagatggcaagctgtccaaaaaaaaaaaaaaaaaatgtgagctttccctttcatttttcatagcattgctgctgggaggtggctgctcatccagggactatatttttcaacactctttgcatctagatatggtcatgtgacttgttctcaccagtgaaatgtgagtggaagctacttctatgccaaggcttttaaaaagtagcctactttcctggtacgtttcctcctttcatccctacattgtccttctagtggttagtaggggcataaactcgaagcttggctttctgaatcactgaatgagagaaaacttgctttgattttttttttttttttcaagagacaggttcttgctgtgtcacccaggttggaatgcagtggggtgaccgtagcttactgcagcctcgtactcctgggctcaagtgatccttctgcctaggcctcccaaaggtgctaggattacaggcatgagctatcacgcccagactggactattttgtgaaagggaaataaagttctattgtgtttggccactgtattaggctgttcttacattgccataaagaaatacctgagactgggtaatttataagaaaagagatttaattggctcatggttctgcaggctgtacaggaagtatgacactggcatctgcttctggggaggcctcaggaagctttcccttgtggcaaaaggtgaagcaggagtaggcacttcacatagagaaagcaggagcaagccagaaagagagagaggcagggggagatgccacacacttttaaacaaccagatctcttgaaaactcactcactatcgcacggacagcactaagccatgagggatccacccccatgatccaaacacctcccaccaggccccaacgctagcagtggggattacatttcaacatgagatttgggcagggacaaatatccaaacaatatcggtcagtgtgcatttacagatatatttgatacaaaaagatctcagtgcttctcaaagtgcggtttccagaccaggaacatcagcctcgctggagacttgttagacatgaaaattctcaggccccactcttgacctactgaattagaatctcggatccagagatctgtgtatctgacaagccctccaggtggtcctaatgcacactcaagtttgaggaccactgccttgtgccgtccctaccaacttcatcaccgctctaactgatcagtagacatgggttgtttctctcctcagctttgccttttctggattaaactctcaaagtgtctaaagtttctgagcttcattagcaatggtgctgaaagttaaggataatgttgaaaaatcttgtgcatgagggaagacatttggtgagtttgaagttctgatgaattttgagaaaaagaaacatcctgaaagcttaagatagcttaaaaacaacttttgttcagttctaaatattagcactttttataaaagggcatatatcctacctagaacaggggtcacaacccagatgccccccaggtaatctaatccaggggagtgggccaagtggagggcagcgaacagtatgaagcaacagctgattgttaagagtatgggcccagtgacttcaggtctaaacattattaaaaagaactgcagatttgcattttcattttacatcttctggtttgtaaatgttaactcacattacaaaaaatccaaatccaagaaacaaaaccaaaaattttgtatgggttgaacatgcctgagtgtttaatttggcccctgggctgccagttttacaacctttgtctggaagtaccagggaagcagtcaggttgctaatgtctcctcttactcattaggaggcaaaataacttttacacaatcatgagctccaaaagggagacgaataagagctgtacaaagtagttgccaaggtaacatcttgctgatcagaaaggggcgacaattgggttttatgtagacgcagtgggagaatgaaacataatctttctctgtcttctttctgtttaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttttctggggaagattataccttggtatgttttcaccactgtgagatgaaaatttgagaacagtgagagacagatgcttgcctgaggagttttattttccctttaatccttatcaaatatccagatattacctatattgccttgatctgctgtctgaaggtgggtttctttgattgtttgaagagttctgggcactagaggtgcttactttgtgacgggagcaaataacaaggtgttgcccatgacatggtcaagcctcttcttcaattagccacctatcttgggcatgttttcatagagatatatctcatcccttttaataactgcagaatcttggacatttagaggtctccaaatattggttgtcatttatggtgtatcgtgtttttgttattataataacgttgcaataaataccctagcaacctatttttgcttacaagtagagtattttcgaagaacaaattccttcatgtgaaactgacgggtcaaaatataaaaggattaaagtttcaatagttagttaattgccttacaatggaattacaacaatttatacttccaccagtaattcatgaactctgccttaccacataatatttctaatctttcccaatctgatatggagaaacatgttttattattctatttttttttcactaaaagagagactttgaacacccctccatatgtttcaaaaacacttgtagaccaggtgtggtggctcactcctgtaattccagcactttgggaagtgagaagattgcttgagcccaggagttcgagaccaacttaggcaacaaatctagacaagggagaccttgtctctacgaaaaaatgaaaacattaactgggcatggtggtgtgtgctgtggtgctagctgctcaggaggctgaagatgggaggactgcttgagcctgggaagttgaggctgcagtgagctgtgtgatggcaccactgcactccagcctgggcaacagagtgagaccctgtctcaaaacaaaacaaaacaatacaaaacaaaacttttttttttcagtgaatgtttctttatagatttcaacttctaaaaattgttggcactttttttgattgactgaagagctcattatatattaagcaatgtagactttttttttttttttttgagacagggtctcgctccgtcgcccaggctggagtgcattggtgcgatctgggctcactgcaacctctgtctcccaggttcaagcaattctccccgctcagcctcctgagtacctgggattgcaggcacctaccatcatgcccggctaatttttgtatttttgtagagatagggttttaccatgttgttcaggctggtcttgaactcctgatctcagatgatctacccgccacggcttcccaaagtgctgggattacaggtgtgagccgccgcgcttggcccaatttagactttttaaaccaacttttgaaggttggtttttaaaaaataaatgactggatcatgttctaactactcatagtctcagccaaacacaattgcggaaggcctagccaaaggctctttgctcagtgaaagtcccatgaatctcaggcacagaggatagtctggaaagacctaacctgcacatgcaaatctattaagaaagatgaagtcttaggcttatatggagctaaataattgcatgtttaatgcaatgccagggtacaggtaatggtgattggagttggaggggtgatgtgtgtggtgggtgaggaagtcagggctgagtcctaggtgagatctataagagtgatgtttatttatgcatctgagggctgggactctcatgacaggatttattttcattctctttcaaggagagccatgctgccttgctgcttcttgctcgtgtacacagagcacttggtgtcttgcgaatcccctttgacgccggtgcctttccaggccagtgctttgcttgtgttcagaggatgcatgctcaggccctaccagactatcttagggatgaggggcaaattttgtttccaatgctctgtgtgggccctccatggcattttcttcattttgggttccatcctggcctaaagcttcccattaaagctaatggccattggagttaacccaaattttctcctttggtatttataaaaagcaacactgaaaaaccttgaaattaactaacaataaaaaaaccattgatcggttctttcctggagatggttctttcttctcaaataggccactttgcagactggaaatcaccccaatcctcaaatagcctaatatttttcacatgtgattccagcaaattgctgtttgcattaacaccttggtggggactcacttaagagctagatttgttagtgtatttactgacattttcacatgatgttttcagctgcctgaataattgtaatattcaccagaaaaaaatcaaagtaatgaaaggtgcctacaattattcatatctcaacattgtaagccttaatttcctgcctgaagtgtggtaaattactcatttttaaagtcatctctagccactgagagtttatggtgatgtatatagatgttttgtagattccaaaaaaaatcaatgactatgaatatcacagactgtcaaaacagctggtgtgattataaaataatgagatcaactaaagacatcagctctcagacatccaaattgtaagaggaaaatgaagacgaggaaggggaaagtgaattgcttaatgtcttgtaggtaccaaataatagagtcagtatctgccactgccatgctgaagattttgcactgttacttacacagattcattcccctttttgcaggctttgttgggccaggagatggttttgcagcagcagaagactatgaactgggctttgggagataggatctctggttgtattctggctatccacactctgaaagaggaccgtgacaggtattgtcattattggtggctgagtttctaggttagccaacctatggcagattgggaagactttataatgcgaataaacagaagaaagtttacttgatcaaaaaagattttttctcctggtggaaactgcaattattagggcaactctttaagtgtccatcaatattaggatgcattttaacaggttaagtactcttctaactgggatgaatagggcattgacaggaaaattaacacacaagttcttatatcctccttcccttatatctggtcgcataacctaatgtgaattttttatgcctttaagtgctgatattatggaaaaaccttctaaaactggataaatatcattttccaagactcagatcaaatatcacatctttctctgattttcttgatccttcctgccaaaaagaaatagcaccatatatgcattagtataatctatttgtaattaacataaaatttctcattttacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttga

SEQ ID NO: 2166 - DNA, 301082 bp, Homo sapiens
cttatagatgtaaaatattttatttgtaaatggtgatcttctaaatctgtgtccacaaattccaaaacccataacactctgtatacttcaaaaaattcaatttttgccaacattagatactattatacagaacagaaaacaacaaaaacccggtaggacaaatactggtaggatgtcaggatattgtacaagagaagaaaaatattcaggaaacaaatttcatacagctatttatcaagagaaaaatatatacaattgatttattctgtaagataaaaatacatcatgccatatacaagttcagaactgcatcactgaatataccaacagtttacagtccacttgaattgtgcacacaaaacttcattttatacttagcctgtgaagtgtcagtaccagaattttaagtacaaaataaaaagctaacctggttcaaaatgctgattaagtttctacaagcaaacacaaaacagtgttttttttattaaagaaatgtaaacaaacagttcatacaaacacattttaaaattacatcttccaaaaaccctattgccagagtcctgcagctgtaagcataatcacatctcctttttttttttaactttttcaaatttttgtgttaaatagaaggctaaagggttagatttaagtttctgctacatgatcctattacgtttacatgattctctgtggctgaaacaaagttctaatcaaaactacttttgctgaagaaaaaattcagcctccatttgggtgtatttttaagcagttattcacagttatcacaaattgtaagcacaaaaaaacctgactgaagaagtagggatgcaacaatataatatgaaaaaattagtttaaattaccaaaacagctataaaagttgtagtcgtagcatacgccccgctctgtcagaagtaaggtgtataaaaccattgagtactaatagactgcggtttccaaaaaacccccaacactctaggttgaaattttggttattacataattataatggcatattttataacacaaaattatattgtaacatccctatgaacattttataagcccccgagctgctgcagagcctggtagcatttggtcaataactatttttatactgtattttttctcaaaatatttacatatctgtacaaagtaacagggtttgttagttctgcaggtaacagcagcagcttggctttcttctaactttatttaaaaatagcttcattcacttattcaataataaatacaaaagtttctcttattttacagaaatcaaaaactacaataaactgactcatggaatcaagtatttaaatgtatttagtgcaagttattatcccttagctctatccctaaggaagtcatttcagtacattccttgttcagtggtgtctactttatttaaaaacattttgaagttagagggcctgcccctttttaataaggccgtggccagcactctctgtccccctcgctggtgatttcagtcttacattcataggaaggcccctgcccggggcagggcagccatcggctctttgccccagtaaaagtttctccttagtgagactagaaaaccaaaacaatgaaacccacccacaagggaaaaacaaaacaaaaaacaaacaaaaaaaaaagaaaaggaaaagaaaaaaaagcaaaagtgctggaccattctgtgattccgtttaacctcggccacttcaggaacgctgcttctgtcagcttcctcctggcgctgctttaacctaaaggactgaggaaatcagaactcccagaagctttttcaaaaagtcataaaacagaaaacaaaaatctctttctgtctgcaaaattccaatggtgtgttgaatcgcctcttcctagggacaagccgcccgctgagctagcaaggaatgcatttcagttcatccacttccggcagttcacagctccacagtgacacggaatcttgtgctggtcatcttcaaagtcaaacttatagtcatagcagagctgcccacggcaaagacacagggtaagaaaggacagcaaggaaggcaatagcgtttctgcctccatctcccttgcattttaaaaccagcaaacgaaacagacgtaaattaaggaagacctgatttattgaggttccatgggaccctgggggaaccctgaaaagaggcattgtgcttgcacagaggaaatgagggaggcagtatttttaaacagcgagatctgagaacgggagcctgaccagagaaagctgtatttctgtgacttctcataatgctgtccctgcaagtggatggaggggactggaagggcaactgctttcctagccctctccctaaaacccagaagcctttcacctcccctgatttactgaatggggcatgcaattctgggtgagatgaactgccagctaactctgttttccctccttcatttttcctcactcaagactgaaaggatgtctttctatttagaggtcaccaaattaacatctcagaccaatcaaggtaggtgggagtctgcgtgagtcccacggtacaagcctcagtgcgcggccctgcaacccccaccaccccagagagagccgatgctgcaaaatgaaggggaggcccaggaatttctaggtctcttctgagtgaaatgattctagacgctagctggaaagaccttctacacagaaaggaaggaaaccagtgtttattgagcagctgttcttggcaatgattccactgctttctttcaggtatctgctgagtccttccaagagcctggtaaggaagtcattttctctatcttgcagaagataaaataggggctcatattaaactatttactcaagaatactcaagtaggaaggaggcaggtggccctgggctgagtctcttctgaccaccatggtagccattggttactggcactgtgccagggctcccacacactgtcttatttacacgttactttgagatgtataacgggccttgggtctagtcggatccttattcttgactaagaaaggagattccacaaagacccaaaatacagatagaatcccacgaatcccatggctatgttcacgaagggagaggagcaccaacaaagtcaagtcactcaggtgcctcactccccaaatgcgggacgtttcctacagaaaccaagcctgctgctcagtgacagctttccaggaaatgccaattccagaaccaaggtacctgaatcacagtgggaaagaccaaggtgggaagcaaatgcagcaattaaggccaaaaataatcccaatgggtgagccgccggaccagagtcacctctgagagcacggagacaaacagcaagcttggcactcggcattttgaagacaacaacccacacctgaactgctgaagaatgtggcgatgtgggcacttggttaagcacacactgatcgccagcgtgagcacacaatcctcagcagcacggcggcccagatttgccgcccacagcccaacagtgccatctcaggagccacggcccccttggagaaggacggggatgctcttcagaggggacactgccaaactgtgtccaggttaaggggataaagaaggatcctatggcacacagaaatgataccacctgggtgccatggggatgctgaacccgtggcacagaagggaagggagaggtgacagcaaatgctcacagagctgccatgtggaggaaggtgaactggagtgcctgaagggtgagatactgcagggtgggaacatctggcctattatggacagagtttttatcacaacaaagaattgggaaacaagtgagtaagtgacctgtgtgaggagggaactattcgcccaggatctgaacaacatggcagatgcaatctctcacactcttacctcttctcctttctggattctccgactggagctgatgataattttgtgtcctctctcaaaagtcaccacttcagccacacaattaggtgcacacgaatggttgatatacctgcaagccaccatgtcagaaaactgtattgtaaaacagctagaagcagctttaaaaacttcccatttattgataaagcagtttttgctaattaaatttctatttgcccattgttagaagcacaaatataacatttaaataaaaattctcaactcatttgctctgaatgtttagtcaccgccaggctgccgtgagagcctttcccttggcttcagtgttctctccaccagcactggccccacaagcaaaagcactccccgtcaggttcctcgctgtctcaccttgcgggccctcctgtgagcgtcgcgtcaatcacatggtcgttatccatgcggaacatgtacacaccacggttctgagggaaaagtcagtcagtaagtcatcaatgtcgacctgaaactcccctctgtgttcctatccacaccaggaggactcagtcgaaactgaacggaacggcagcctgatcatccttactgtggatattctattaggcacagatgacatttacatggcacgaatggaaagcatggaatcagtaggttgtgtgtgaagccaggctcattaatttacagttgtctatcaaagtaaactgtaacaccaattgaaagagatacaactgataaaaatacactaatatacagatatggcttttgtttaaagctgaatgcagcatgacagatttcattctgccttccagggtgtctggctggcacggagaaagggagaggatgatggtgctgtgtatacaatctcggggaccagacacctacctgagactcataaagcttctctttcctgttggctacttcgtttcgaatgatagtcccgatgtactcaatgaccatggtgtgtttctcaatgtctcgagcagcatacaggcccagcccctaaaaaaaagtgtgtacatacttccaatttatgtgacaacaagtcttttttctgtttttcatacaaaggtttcaccctcgggtcttattagaagccatacttaagtttcacttgaactcaaatcatttttgaatatgctattttctgaaattttaaaaattggacatttttactacttaaaactatgccatcactagcttattcctacatcttttttagcactaaattcttagagtctatgtataaagtagtactgtggcttggctgtcttatgtattaggctatctaaccttccagatgagatagctgagttcccaccaactaaataagcttattgacttgtggtgtttattttaccccaatactatttcaaaaaagacataataaattcaataacatagaaatcaggctaactataaccaatcactgatactgtaaacagggttcagacttggctctgagtttcccagcagccagggcaaagagcagacacaggaaacgtcactctgctgtaaatatcaggaatgttggaaacaaatgaagctcttggggaaggtaaatttttcactaatacaaaattctgaggctgggaaagaagtttgaacgggctgaaatggaagcagctctcactgcgcagcttgtactcccgtgctggtggcctgccaggtgcactattcaggttggtagcacaacttgtagagaaacatactaacaaaatatgggtctttgccataaatagttgtattttcttgtcccaattttgggtttttgcacttaattctgactagaaggcaactgaatgcaaaagtactagactagatgcaactgaatcagaagtactagactagaatgcaattctagaattgaactgaattctagaatgcagaaatcaactgcattctagtcggaattactaggaggaccatgtgctgccccagctgcatcctcatgaagcacatccgggagcacatggtgggaagggccatgtgagagactttagtatgtgaactgatttatcctctgaacaagcatctttgattatctgttctactccagatacaactcacaagtgaatgaaccagaacacacaaaaagtatgtatggagatcaatagagtgtggtttaagaataaacaagatcagtggaaatgaagagattccaaatgggccaggcgtggtgactcatgcctataatcccaccactttgggaagccaaggcaggcagatcccttgaggtcaggagttcaagaccagcctggccaacatggtgaaaccccgtctctactaaaaatacaaaaattagctgggcatggtggcgtgtgcctgtaattccagctactagggaggctgagccaagagaattgcttgagccccagaggcagaggttgcagtgagctgagatcatgccactgcactccagcctgggcaacagagtgagactccagaggctgaggcatgagaatcgctttaatctgggagccaagatggcaccactgcactccagtctgggtgacagagtgagactccatctcagaaaagagaaatagatccctgcatgtatgaaaatctaacgtacagtagtaactggtattaaaattcagtttatagtcaagatttcgtggggttagaagaaaaaggccaggtgcggtggctcacacctgtaataccagcactttgggaggcagaggtgggcgggtcacaaggtcaggagtttgaggaccagcctggccaatatggtgaaatcccatctctacttaaaaaaaaaaaaaaaattagccgggcatggtagtacacacctgtagtcccagttacttgggaggctgaggcagaagaatcgcttgaacctgggaggcagaggttgcagtgagccgagatcgtgccactgcactccagcctgggtgacagaggaagactctgtctcaaaaaaaaaaaaaaaaaaaattcatgccagccacgggggctcatgcctgtaatcccagcactttgggaggccgaggcaggtgaattgcttgagttcagaagttcaagaccagcctggacaacatggcaaaacctcatctctaaataaatatttttaaaaattagccaagtattgtggcatgcgcctgtagccctggctactcaggaggctgaggtaagaggatcgcttgagcccaggagatcgaagctgcagtgagctgagattgtgccaccgcactccagcctgggcgacacagtgagaccctgtctcaaagaagaagaaagaaaatcagttaaaaatgagtgggttacttctaaatggcccttcaacaactggttatccaatggaagaaagcgaaattgtattttaaaaatgttatgcaagaaaacctctagaatccgtatataatctagggtcttgaccaagactagatgcaacagaaaattatgtatgtttgtttatataaacagtaacttttacaagaaaaaagatgtcacacttgctggtaggcaaaggatattttgtaggggaaaattctgaatagtgtaaactgctaaaaattgaaaaatggacaaaggatatgaatacgcaattcctatgaaagcaaatccaaatggcggacatgaaaagctgcctattcaattaaggtaacatcagtctatatttatcagaccaactaaacaaaaaaatagtaacaccagctacaaatgggaaacaagaaaacagtctcacatgctgcaggaagaagtgtgcagtaagagactttttagaaaactggcaatatctatttaaatgaaaagtacacacgcttttacacagaaacctcacgtttgggaatataccccataggagtgaaactattaattcattgtgatatttgtacaagatatagcaacactgtttgttatgagaaaaattataaatcaaatacacactcatcagtaatgcaatggtttaactgcagttcatcaacactatggaacatcaggtaaccattcaaaagaatgaaatgaagctacgtcagttgatcgagagggacctctgattattacagagaaaaggaagacggagaaaaataaatataacatgattccatttttatatatgtacataaaagtgtatatagttctaagatattagcacagaaaaacaggatacatattagatcatccacgggatccccagggaggtggacagatgggagggtggcaggatgaaataagtaaagagacagaaaccagagctctcaaaaatgcttcaggttaaaggtgacaggttgaacacagttaagatacccactaaaatcacagtaaaagcacactcctcgagaacacgaatgggtataagagtgaatggactatttaaaatgaaaagtaattgacttagcaggggaaagctagaactggaaggagtagaggcaaagcactaattcacccacagaatccgagagaggctcaacagagaggggcaacagcagagaaaacacagatactccactcataatgtaaaaacaaaatatcaaacaagatcaagagcagaaagggctcgtagctaatctctaaaaatagacaagaaagattagcagataaagtagaggaagtctcagaaagaacagagagacaaggaaacaaagaacagaaggggagaaaggatataagacagaaattactctctgacatgcatgagaatcatccaggaggccccacctccagagctggattcagtgaggctgggctggggcccccgaacctgcacatcctaacaagctcccaggtgacactgctgcttctagtctcaggtccacactgtgagatcctgaatctcaggggttttagtgcaaacacagaggaaacagaggggcagaacttgcaaaagaatgaatacaaaacacatttctcagacggaaggtcacgatgctccaggttgaaagggctcatcaagggaggaaagcaatcaacaaaaagacctccactgaggtgtagttctgtgaaatgtccaaatatcaataaagagaagatcctacaaacttctagtgaggagtaaaagggttccaacaaaggaacaagaatctgaatgagtatagacaaaggaacgctgatccagtttatagggtaaagatactttgctggctgctgagagggaactggatgggaggagacagccaggcctgcagtggtacaggcaagtgatatgtggctcaagatagggctggtaaacctaagagtggatctgagagaatttttaggagaaaacagaactcgatgatgctttaggtttaatctggcagtactgaggccaatgtacacaaacggtaacatcactcagcaaggagcttgtaggatggcggggtttaggagctggacaagtttgacaaagtaagagctttgtaattccattctgagacatccaaggagaaaaatgctgaacaggcatttggatatttgggtctgcagctcaggaagtatggactataggtgtaaacttaaatgcttagcctatacacggccttacttgtaagatagtccacagtctaccaaaaaacatgcactgatttcatgaaacggtagcttccaaaagataaggtaacttccaaaattggtgtacctttggaaaatattttcatttgtatttctctcaagtgcttgaaacagctctactgagcactccacaaatccagtgtgtgcaaattacaatgctacctgcctcccaggagctctcaacaagatgcaaagatgtggattccactggtctgctttccctttggggaagccaatcaccaagtcccaagactacatattaaatccctagtgttaccaagggacaggatttgatacgattttgaaaacacgtttctgtccctgcagctatgtgaaatcattttcacatactggacatcaatagcttcagattgctagactccaccctgtctctccacttcctgtacacaaagtatttcttcacctgaatccgagaccgtgccagatacacattggatttccattcagttttcatcttccggtactgcgatgacttggagtgaacaaactgtttactataaggtgcgttcagttctccagtgactgtgctctgaaatgactttgaggtgctggtgctgtttaaggtgtgaggcctgcagacaatggcatatcaacaggaaaaaaatacaaggaaaactgaagatacctctgagtaatgcccaaaaccaggttaattcagattcttactgacagaaacatacatggaaagctgcctagcagagacacacggcgagttctcttatgtagttgggcacatacacagccagacagcagggtttgtaagcagcagacaaatcaagcacaggaaaccactaatacgcctagaaaccctgggctgtactatgtgaagttaaaacaaaataccttaacacaaacctcttgacatgggcactcattttaggttcagaacgggcacaacctgtggggttaacggcaagaggaagttccatgagaggatttcggccgtatcggaaggtataattttcacatgcctcaaccccaggaagctgaaaagaagcaaagcagacacaaagtcaccccatctgatggagactacagacaatctcaagctggtcaaaggatggcccacgacagaaataactcatcagcgttttccccgataataaaatggtcttctagcttatgttaacactattggcctgcaggtagatctacttaaatatgagtatgcaaattcagtttcaaagccaaacttaggtaaaccctgccaaatgctccttgaagaaaaagattagcccatgcaacaaacactggctgaccaatatacacgcttgtgtgatttcagggcctgactgaaacacacaatacccacaaacacagggcatgtaatgattcgcattgagttctttcccctgtattaatgccaacttttatatctctgtctggaattttacaattaaaaacagttaaaaaatcatctatatggtttctttcttgatcgtttctcactcctttcaatttgactctgatgtgatgaggttatcgctctccatgtcctgggagcataaagcataggtgttaactcaagctttactcaaagtcatttacatgttaaaggtcttttctggaatacattgcttgtgaaatttatttctctgtagtcataaaagataagtatcatttaggcagggcgattccaaagaaaacaattaggcacattactcagtggcttttggggtttcctctgcctgtccaaagaaaacacaccaatgatatttttattcttgaaaacaatgccttagaatcatacaattttctaaaactattgtgtagatatggttcagttagactcactgacaaacaggcttgtaatcttttaagcaaagaaatgtcaagagaggacagaaatcagtgctgctgcgatctactgccctctagtgacttcatcctaggaagagggcaggagagtggccataaatacccaagtgtcaggaaatgggcacactgacattctgaggtgggagaaacttcagaaaggcaagggaagaggagagtgtcctcacccatccagcacacccagaagatgtgacaagcctggtgtccttcacccctgcttgcctccagcctggaagagaacctgaagttggttaactacctcaactgggtgaataccaacacggctgagctctcccgattaatcaccaatgccttattcctctaagagaaacgggttaatgcacaggctcagtcactttctgaagagtgccacaaatgttacagcatgtgttcaagtggtcacactgaatcaggaaagcaattccaatctcaaagcctgaccaagacactcactgattccgctatgcgtgccactgcagagacggtcaggccaaacagatcctctccttttaaatacgctgggaaaagctggagcatttcagacttttttctcacacatgccacaggctccaaaatcttatcccagacacctacacagggacaaaaacataatttttataggaaataggatacagtataaaaaacaagagcaaaatgaagaataaccactcacaaggatttactaatttccaaataaatcctgttgggcaataatctaataaatctgtttggtaataatctaatgaacctgtttattaaatggcagcaattttttttaaagacctaaattttggggaaaataatagattaaggacattaaagtgaaaaaacttaatgtaactgaaattcatgcaaacagttcatttactttcatagtggccatataacataccagattttaaaatgattagtctaattggtaatgtctatagctatgttcctttcccctcagatttaaattaaaatgttaaattgatattttctttggaattatctttagagtattttcagactttttttttttaagtgctaaacttaagaaagcagctccacatacttttgtttgtgtactttctacataagcaaaagtgacaatctagacttaaccatggaggtccaaactaagtgtttaatttccatctctaaacttacgtaatatctgatgttcctatacattgtcttatgacaatgtatacagtatgatttagatgtcattcctgccttctagaaactgactttaagaaaaagggggtccctgccaggtacggtggctcacacctgtaatcccagcactttgggtggctgaggcaggtggatcacctgaggtcaggagtttgagcccagcctggccaacatgctgaaaccctaaaatactaaaaatacaaaattaaaaactactaaaaatataaaaattagccgggcatggtagcgcaagcctgtaatcccagctactcgggaggctgaggcaggagaatcacttgaacccaggaggcggaggttgcagggaactgagatcgcgccattgcagtccagcctgtgcaacaaaagagaaactccgtctcaaaaaaaaaaaaaaaaaaaaagaaaaagaaaaagaaaaaggaggtccccaatgcaaatgacaggcaacctttatctacaaatcattctcggatttacctcaccaactcgtatgttcaaagatatattgattatgaaagtgtttagacaactgtatagcaaagagagcaaggtgtgagaacacaaacattggcatttgtaaatgaaaaatacacattataaaatataaaactaacatgagacaaacatggaaaattgacaaaatacattcattagcctgacatcagagtaagtagcactgcacagcatgtgaacggcagacgttacctttaggtgagatgtcacttagaaccaggtcttcatggccttgttccacaatcctgatgacaaacactgggcgcccatccttctcctcaatggagcacaggtagcggcagcgcctattggcatagcgagtgctccagtacagccggctggcttcatagcccacagggaagagtgctttaggagaatggaatgcttgcatctgctgtggaagcagctgaccaattgtgtggaagatgaggctacccacgcgaaaggtatggtcccgttctcctcgttgcacgatgctagcaatctgtcgcacctcatcacgctgaacatagaccctcctgaagactgcaaagtaacttaattcttgctcatgaattccctttggtttgtgcatggggcaaagcatagttttgtccttaaaaaacatgcattgtgctttaatggcgcaagtgaagtgataaatgttggtgcatcgaaatctgtggcatccactagtggcacccgtcttgtgacagaagacacatttcatttgtaggcctctcctcagagctagctccacatttattaaggcaccagcctgagtctcatagacctccgtggaccacagagcgcagttcaagtggacccacagatccaagtcaaggttgagtagccttgctggtccatctgtcaatccatcaccttcttcatgacaaaagcaacatttccgatagtctttgggcacaggatcaggtttaagggaagtgcccaatttctttagaaattcatctatttcatcctcacaaggtggtttaaatgtccccttagggattacaatatgaatgctccacttcttccatttcattcctctccattttttattgagcggcctgcaatcttcaaacccaccatggacagctcttagccgaggcttcagcttgactgtcaccttcagctcatctggcttggcctcgacttgggctgcttcaaaagcaggagggaaggcgatgggtggtgaggcagggggagaagctttctctgggagctgggggagacagtgcacatccaaagtggagatgttgttgctgtactgatgaaatgctttggaaggcgtttctctcataggtgattgtggcaatgaaggaatggattcctgggcaacataaagaaaccatgacaaagaaaaataattcacaagcccggaaagcaattcttgttaagacaagaagctgagcagtatgactgaagaggatgggtgacctgaggggcagagggagagtcagcagtaagtgctgggggctcatgcaccgcagaagctgaccatgctctaaggtgcacagggatagagagcgggtgatggcagctgtgccgcgtcctttcgaggccttttccacaaagccataattctggagaatattctgctcttacactttctgggacaatcccctttctaactatattaaaaccagaaaaagaaaaaacacacacacactcacaatgctgtcagaagagctaatataatttgtacaatggaacagtgttttttgtttaaccaaataagaacgctgcagcatcgtttcttgagagcttatctccactctaaaattcacatctgttaatctcagccttaatcaattggtgtaaatgttacagaaagggaaggagcccctgtcaacaaatgaatcatactaacttttctctgaggcttctcagctctgatccggctgctgaaacagttgagctgaggggaaatctccaatagcttatttactttatggtacagagtatcataaactaataaacaccaacccacaggctgccctcttttcacatgccccaatcctgacaaggtatctgaaaaaagacatgccttataccaaatcaggcagggactgcacaccaacttaaactatctggtgaaaaaaaaaatccttcttgcatttaggctgatgtattttaagatctaaatttatttgtcatctagcctagattttattacaggcatactacaaacaactacctgttaaaaataagtcttcagaatgttcttctgtgaaagacataccagagcaataacctggatggaggaatgactggcagtattactgtacaggaaaagcttccttcaaaacatgattataaacatatcatttgtatcaaccattagttggacacactcaaattacataaaatcaagtaaagcagacctctttcaccatactgtgagcaaagtgttttctcttaaaatgcacaaatagtcttaaattttatctttaaacaggttttcctattggggtaacatcaataaaaatgattttaaaatattaagatatttacggccgggcgcagtggctcacacctgtaatcccagcactttgagaggctgaggtgggcggatcacgaggtcaggagtttgagaccagcctggccaacatggtgaaaccccatctctactaaactacaaaaattagctgggcgtggtggcacgcacctgtaatcccagctactcaggaggctaaggcaggagaattgcttgaattgggaggcagagtctgcagtgagccaagaggtgccaatgcccttcagcctgtgggaccagaatgagactccatctcaaaaaaaaattaaactggtaaaattaaagattttaatattagtgttctgtttactgaacttttaaaacataactctgcccacttctgtcaaataactaagttgaaagagtagcacgactcaaggctccctacaccctctcctcctctgccgggtcagcacctgctttggattccccacacagagctccatgaaggcagggacacatctttattcactcccatatgcccagaacacagaagtcactcgttacacattgttatcagctgagattatcctaatctcaccttgttttctgagtttttcgcttgtgcagttgatgaataaagaataaagcagttattactacagaagacaatgtccttctctaccctcttggtgctttctcgggaatcctgaaaagcaaagagaaatgtgtgggaatctcaacaagtcaaaatttaataaaaacaggatctatacattatttttatgttatattcaaaagtgacagtggttctttatcttaatagtagaaaggaaactatgttccaatatttagcatgtgataatttagctagggaaaaaatacatgtataaaaccaaactatgtggtccacggttcactctatttaaaaatacgtagtcctcataatattccctttaacagcctgttgtagctctttggtgttcagcccaagcacatctgatatacgctggtgccatcaccaggaacatgtgtccatcacaccaccataagtggtgtctctctctgatgttggaagagacactgccaaggacattttcgctggaggtaggaggtggggtcataaaaggagtagcaaagtaccttgttcaaaagggtcagatctttgaaagatttccgcacaccacttccaagaataaccactttacaatgacaacaccactgtggtctgagtgctgcgctttctgcaataccatgactagaatccttatatccagaaagacctaaaggcaatcaacttttgttagtaattaaaactgactgatgacacaaggtggcacatggtgaaaaattatgcagtatcaactcattacaacatggttcattaacattattctttaattaataaaaaaaatttatcttctaagcaatggttacagagtcgattatctgacactagggcaaaaataaagaaacatgcctattctcaaatagctgggaaagcaatggcagtataaaagaagaatctaataaaactaagtcaccaagagagattactattcagtctaagtacaaagtaagacagagagggaaacagatattacttttgcttgcaggttaagatggtaaaaaaacattttatgaaagatacaatgacatatgtataagagtcttaaataagtgtgacttgcagagtcagaaatgaggaaagagccaaggccaaggataagaaggtaaataaggactcaggaattagaaagcatcattcaggtgcagtgtgaaggcaaaaaggagcagggaaaaagtgacagaacagctagaagccaagaggaggaagccagggcctggactgagcacgcctgtaagattgccagtgaggcaggaaggaaagcgacatcatggtcggtctaaggaagttgttccattctcagagatggggggcatgaacacctctgtgggaagagaagggccctatagagctggtgcagaggtaaaacaagaggtaggtgaggatggaaagcagaggagaacaggaaacagaacccacgtcaggtcaccagccccatctgtaccaggtggcccaggtgcagcgggatgggggttgggagacaggaagaacaaaagctgctcaagggcaagcccgtcacaggcttcttctggcagcctgcacagatggctggcactcacatagcccctggtgacagcatgacagaatacacaggccaaagcactagaggtcaaaatcacagcacagaaaacagaacacccacacatggtaagttcaccaaggactatacgccagcatgttacctgtccgttgttaaaagataatcagtatctcaaagagtaagcttaacttttgaatcaggaatggatttggggttaacaaaaagctcactagctcaccattgcttgttggaggaaatggtacattaggctgcttcagccggtaagagctcactaatctgggagggtttgcagatcctggcggaggcccacggagaagtaaatgctgtcgatactccaaacccgggttgattctgtggctactgaccaaacccatggatgggacatctggagcactgctaacctcatagctgttagggattcggacgtgaagaaggtcggaaaatgcagccacaacactgctaatgttctaaaaccaaatgcaaatgctgtattattcacccagaaggcaacagtgaaccactgaagaaaaatacacacttaggataaatcctctttgcatgatacatagattctaagaaaatccaacaaattttatttagacttaaagaacctcaggaaaaaaattagctctaacgaactaatatccaaaaaaagaaatttataaacagaaatcctcataaagggattccaattaacattaaatatctagtaacacattaaactattttagatattgtaacatctgacagaccccgtcagttcctacaggtggtcagaaagcttacttccaggggcttccctccagctctgacacaacccgtaagaacagacaaaggtcttgctactgctgtattttgttgataaccaaaatatcacatcattggacttctagtttggtctctactgaaatgtcttcacagaattcagagttaaaaaaataaaaaatcctcaggaaattacttatgtttgatataagcagatgctacttgaagaacatttctattgcttctgcaaaactattactgttgataaagttctttttcattgcttaattttcttctctgttaacagttacaaagaagttttttctgagatggacatgatggctcacacatgtagtcccagctactgaggaggctaaagcagaaggattacttgagcccagtaagtttgaggctgcagtgagctatgactgtgccactgcactccagcctgggcaacagaaggagactgtgtctctattaaaaaaaaaaaaaaaaaaagagttctctaaagtatacatcctttaataagaaaatgtgagctctaatttccctttttacttgacgtaggctgagaccaattcaatgacaaacgatggcactcaaaggcagctgagaggtctgcagtgagcatcagctctgctctctgaccctttatcctcagtgatcctgtttgtgtgtgttttatggtagacacctgacccatctttgaaaattggggacatactgtttaacattaagaagtcatttaatcttttacctcagcagctgtaggatgcagagtaattgctacagatataagacctgatctgggaccatttggggaaggaccaaaaggtgacgcaaaatataaagtgcctggctcagttttgatgtcattccttcttgattctgaacctttaaaaagagagaaaaaaaagaggaaaatagtgttaatggattttcaaaatcaaaatatttacattagtaaattggcgtagtgtaaagggaaataataaggttaagtgttgttcttacttttcccagcagtgctaggaagaattggaatgatgggggacggcaccggttctggaggctcctccttgaccaatgacagatctggatacctgctcacttctaccccaaccacactctcaggagaggatgagggaacaaaactgtcaggagtatctcgatcaccacagtgatcctgtatcctgaaaaaacataaacacacacatcaaagtctgcaaatccaccactgggggcttcctgtaccaaccctgctgacatctgtgaatacagctgtaaggatactctgggcagcacctatacgatgagcagcaaatgaatcagctcagagccacactgggaaaaaaatacaagaacaatatttagttacaaaataatttaaatggtatgtttccttttaacgaaagcttcagcaccaaagtttgaagacctgccaaagaggaagatgttctgattagcatgtaacatagagagcatgaaagcaccttttcaaaatcccagatcgttgagcctagggcagcactcctgcagcttgaaaaggaaagagctgctggttggatttaacaataaaaaaggaaaactttaaaaagacaaaaaaaaaaggaaagagaagtccaacacatatgcaatggtcacacctgcattcacctgactgggaaaacagctgtcctactgctgctctttacactggcaagatgggagaaaacttagccattgacttgatcggcccttatttttcttaactgataaagtgaggtgagaaaaacaaaagactggtcccttctgttgagttcaagtttgagtctaccaggccaattgtgaggtctcagactaagttccacaaccctgtggaactgctgtctcccactcctcacgcagagaagtagctgtcatgcaggagacccaagaaaggctggcctactgaggtacagtagaaagaggacctggatcctcaattgggacagattattctccacttcggtccaaagtttccccattaataaagtaagggacttaggttaaataaatgtctcatcaaatagagggtagtgggcagattttccaaagaagagataattatttgatgaagttgtaagaaccctctggatctaaagagttggctagcgatcatctactaagggaacttgattctccccaattagaatcttacagttaaagaactgacacaaagacatcaaaccccagacagttcttaaactctcttccacgacggcgttctctgatatagcaacttctgctctttcattttagacatctacaaacaacaataaacccaataaatcacattaataccctttaaaggacaatgatttctgaaatatgttgcatggagattttccactaccttcatgtctattagattatttaattagattaaataatctaatacttaactgtctattagattatttaactctctatatgatgtaggcttaaaaaaatgcaaactaattatgtttaatggtaacaatgtcttataaactttaaatcctgaagattattcaccaaattgtactcttcaaatgtttttacatgctattcctaaagacattatgccacatacatacatttattttttttaaaagaagaaataactaagaattatttgagaaaaaaataacctgtaccttaattcttcctgattgttatgaggtggtgttgggagggaggctggcacatcaactgtcttggggccctgagcaagagctcgggccaacaagtcgtcctggggtctgaagggcagctgaaatggtttaggtcctagagttttggtaactggaaaagcaaaaacacaaaaccataaatacattcagtcaatattgataaatgggtagaactttacaattctattgccatttcacaatacacaactggcagaggcacatttctccgaggtgtgaaatttggaggctataatcataccttcatggctcactaacactccggcttttccagcaagttcttcagttgttgcaaaaccattggccatcttctgacaagccataggaggtggtgtaggaggaagagaggcagggggtgttggaggattacttaaattattctgctgcaggagaccaaaaaatttaaattatatgctactgagcgaatatgcaatgaccttgctaaaacgtagttctgtgaattttttgcacatagaagcaaggctacagaaatgtaatcaagatgtatcttgcacaccaagaaaacaatacctacaaggccaggaggcttcttagtggaacagatactcgtgattttatggacataccaacttgcttactttacccagcttgactacttaagctctgaaattaagaagctaatttcctttctacctgattttatttatgcaattcttcaagtttcgtggttatagctagtgaaggataactttaaaatgcaatcaagaaattgcaaaatattatcaaaatatcctttaagttctcattaagatatgccctagttctatgaaaaacttaagaatttctggtcttaaacttgtaatacaactcacatccgagatatgagaatctggattgactaagacctttaaaagaagcaacagtactaatgctactactaaagtaactaaatcattaatgtagttcctcttcagacacctctcccagcttaacagttatcaccaatttgtcatttactgattagtctctcaaggagagacttggaatctaccaataacaccatgcaaatcaagtgcaaagtcaaattacaaattttgcaaagataaagaatttcatgaggatgataaaataaggttggagaacagcttatgagttaagatagttttttttttttctttttggagacagagacttgctctgtcacccaagctagaggtagagggcaatggcacaatcatgctcactgcagccttgacctcagggtgtggtggtgcatgcctgtagtcccagctacttggtaggttgaggcactagaattgcttgaatttgggaggcagagattgcagggagctgagattgcaccactgcaatctggcctgggtgacagagcgagaccctgtctcaaaaaaaaaaaaaaaacctacaatagtctaggaattacttgtaattaatacctaaattattagatatacttaaaattgtttaatttcatttttcaaggtaaactactactttttttaaatccccaccatttacaatgatttttgaattcattttaagtgttaataaaggttataaggaaataaggatttccactaccatggaagtacataatagatatttcttgcaatttgtattcttacctataaaaacaacttcaaatgtttatgctagaaatacttcaccaggtaaaattttaaccctgtagctgaacttaagttttaataaaacttggaagagtagatgtaaactaaatacaaaaataagacaagctctatcaattctgacatgttacccaaagatgaagcaagacaacaccttggcagagaaacataccttgtagatcaactgagaatagtagtccgaaaccccttccagggtagcactgccaaaagttcctagaagtcgattcccactattaaattggccactgccataaggaagaaagtgcgcaaagttcactccaatgattggttccattagagggagcagagagagctgctattaaaaaacacatttaagagtaatgtacatgataaaaggaactcagtgtagctcaactttctaagacccgaagcaactttgttgaataaggcttcagaaaaatgagacttaaaattttcaagtatcaaaatgctggagtaagtgagagagactacagacctttgagacttaaaaataagctctgtactaaatgaatgctgccaggcatctaacaagaaaaacatatttcttatctatgctcagcaaaaactggggcatcaactgaggctgggtaccaccaacagcactgttagcaactgtctcccaccttctgtaacaaccacaaaggtgtagaacagaattcacaatgtgtttctttggattcagagtcacaacaaagtactgaggacagatttttttcttggtactgaggctactccttatgaacataagaaaatcttgactatcacctatcaatccatttgtattaccgtaaatttcagatgccaataggatacggtgcaattctgcttggaaaaagtctactaggttccttgtccagatgtcttttagcatttgatctctcgtgtccttgaattgtttgttttttttttgtttttttttttgagacacagtctcattctgtcacccaggctggagtgcagtggcacaatctcggctcactgcaacctctgccatccaggctcaagcaattctcgtgcctcagcctcccaagtagctggaattacaggcgtgtaccaccacgcccagtaaatgtttgtatttttcgtagagatgaggttttgccatgttggctaagctcatctagaactcatgcctcaagtgatccacctgcctcagcctcccaaagtgctgggattacaggcatgagccactgcccccagcctatatccttgacttttaaaagaggctgctctaaatgactcaccctcacctgtttcaagtgggtaaacgtgtcagtgctagagtacatagcttgtttctcctcttcgtcctttttccttttctttgagcgaggtgctgctttctcacccgtcctctgagtccgtttgcttcgctgtttcttggtttcacttcctccatctgtttttggcaactggttgccacatccaaaaccaccttgcatttgagcccccaaagtttgctaatgtaattggaaagggtaaaaaataagtgaacaatttgcatatttggtttttagttcatgcagtgccaagctatgacgcgtcatcctaacatggcactaaaaggtattaaataagtagggaagatagagtggtgtcaatgctggttttccaaaaacaccatccttttcttcaaacgttattctcgagtatggaaatcagtaagctgcgaagcttgaggaaagagcagaactcattagtaaggccacagccctttctggcaaagcattacccctcatgctgacctccctggggctggggaaccccttattcctgcttacttactgcagaagggaaggaaatgcttgtagatggctataggagcctctgcatagtggtcttggtgagttatttttggttccccttaggaactagtgaaatatgaggtgtgctgaaacaattcacaggctccagaaaagctttacagcctatgcatcttaggtgagagaacagatagcaccagacaacaataaaaagaaaaaacactggttcttcaaattagttcacaaccgtatttgactgaaaaataatggccacatacttaaagtcaatgggagagaacgtagatgataacaaataaaccttttctttatttttatcattacaaagtgagaataagccaagccctgaaaaggcctttaagggtagtcctatcagtaccttaaaacacaggaatattttcaggctccattatttctaaatttaacagcagtactctgctatagacgattatagtagctgaacttactgtaatgaattctgcattgaatctctgacggttctgaaaattagtttccagttatattctaaatagtttagcgcatggatggcaacatttttatgtaaagagccagatgataaatattgtaagcctctgtaggccatacagcccctggcataattactcaactctgcccttgtacttcaaaagcagccataaacaattcataaatcaatgagcttggctgcgttcaaataaaacttttaaaattcacggacaaatttgaattttgtataatttttatgtgtcacaaaatactactcttccttagattttttttcaaccatttaaaaatgtaaaagccatttttagctcatggagggaggcgaaagcaggcttagactgctcatctccaggctagttctgtggctctcaaggggtctccagggcggcagcagcatctagagctggtctagaaatgcagattatctggtcccacccagacctgcagaatcagaaataccggggctggagcccagcaatcttggtttaacaagccctcctggtgctcctcacactttagctttgagaatcacctgcctagagcagtacttctccccttcagatgctcaggaatcacctggggatcttcctaagtctacattctgagaagcaggtgtgtggcgggagattctgcatgtgttacaaagctcccacctgatgtggatgctgcggatccccaaggactgcactctgagtggcaagaacctaaaaattaattatatatatatatttatatatttatatttatatatatatttatatatagatgtatatatttatatatatttaaatcactatatatttatttaaatcacactttaatttggggggaggggctactttttaaacttgacgtggttgttccccatgccattaaacattcttacacccacaaattttaatataaacatgctcaaaatgtagtctacgtccttcaaggagctatttaaataatgttaagtggtacaacagaaatcgctatgtgagaacacgagcatcaacacatatttgagattgggagaggtgagaaaggtatctggaaaaagatgactcaagaactgcatttcaaaagataaaaatatattgtccagacgtatataagaagggagaacagaacaggcagaagcagcagcatgtggtatacatagaagggtaaaaagacagaaggctgcaagttattcagtactcctcagggtataagatgtcttggagaaagtggatggagactgtgctggagagttgcctatatttactggtgacaactgtaaaagcataaccagtaaaatttacaaaaattacacaaatctatcaagtcaacactcaatctctactgaatggtcaaagacaagaaaaaaagcaacacttgcaaaaagatgagcttcattaacaatcttaaaatgaaaaaactggacaactaaatataccactcaacccttaattaaaatatgaaaatgaaatccaatttgagaagctctctagggacagctttatgaatgcactggtaatggcactgcaccttctgaaagataaacaggcaagagctattaagcagaccaattcccatgactcaaactccagttttggaactatcttaatgaagttaactgaaataaaggggacagattcttgtaaaggtatatttacaagttagctcttcatgtaaatgaaaaaaaaagcaaattaaatgttaataacttaaaactgatagaaaattgatacatggaaaactacaaaacagtatctacatgtaacattacattaagtatcaatacaacactgtaaccacacaatagcttcccagtgtggtatccctaagagtgccaagggtattaataggggtgcatgggctatcctctgcattttaaagaggttaatggaaattaatcacttatttacaataaagtacatagacatttacttactttgctttagtcatatcaactcaatgtggtaataaccagttgctacacatcacgttatatatgaaatgcaatacatgcctttgctttttaaaaaatagtaaacaaattattatttaatatagtttagatataagtaaaaacatgggttccagagaggtagaaatgacaaaataaaaaatggtcctttagaataaaaaggttgtagaataatgtggaaatacagttgctggtactaatctgctgtaagtataatttaaaacaaaagaaaaaagttgtcgtttttatgatttacacttaccagtccttcagctgggttctgcttctcaactagtttattatcctttgtacagtcatcttctgaacaaatactgccctcaggtttttgattcaaaagagaagatgactttttatttttcaacaagtgtttcagaagttcattccctgagtctcctttggcagcaggggccccagcagaatggggaggactctgtgctgaggagacaggacaggctacagcgtttccttctaccttactaccattctgttcctccaatttaggctcctcttggcctgggcaggactctgtctcagccttttccagttttatctcttctgttttggcaggggtttccatggagagcttgtctacttctgaatttgcatacgtctgttgatttggagttgcttgtgagaaatcactattgggcagtttgttctctaattctgtacatagctggcctgctgccatattgggagtggatgggccgactggttccaccgactcttggtcggcttgttgaggaagctcactgggtgtgctcactgcaggagtagaggtagtttctgagatgcctggagtcggtggggcagttatatctgaatggggagttgatggagccttggtggattctgcatcatcatctcttttcttctttcttgttcttttctttttccctttttcctctgggattatatcagaatacaactgaatgagcgattgggttgatcccggataactgtgtccatgggttatagtagaatcttggccacatgggagactgctattagctactggaggtgctgctggtaaagcaggtgtaaaagaaggcctcactggggactgctggaagctggtcccagaaagatttccatgtccctgcttcacagaagaaaaatttgggcttccaacagggattgatggtgaatcaggaacaaatgaaggagggcctacctgccttcgctcattagtctgcatgaaagtttgggtggagggtgaattaattgatccttgttgtatattctgctgctgtaaaacctgccccatttgctgttggtgttgtggagactgctgaaggggtcctagaggttgcataaaatcacaaggtaagtcggaactgtagaagggaatctgggacacagatgtcctactactacttatctcagagcccaccataccatgctgctccatttccatcctctgctgcaaagctctttgtctatctacctcctgcatgagttggatccgttgtctctcttgctgttctcgtaaacgttccttacgttcccgttcttgaaaactttcactaaagggattgttgtcatcaaattctacccgaggtggtggtccactctgtggatttgcatttgagactgtccctggggctggtgtacaagtttttattggtaactgggcaattgggggctgaattctaggaggattgaggggcaggtgggcaggagcactgttgggttgccatccaggtaaactgggcattctaacagggctagtatggccagaaataactgttgtgtgctgctggtgctgaagctgctgtggcaccatgggaaaggtgggttggctcatggtgggtggagtggcacctggaattaggggtggctggggctggacactgggcatcatggtaggtggggccattgcacattgctgctgctgtttgatccgataatcttcaatcaattcagcatgttctttctgttgtttacgaatctggaataacaaaatgcatcattactcatttctatacagcataggtactgaagtaaaacactggctgatgactgtggttgaggttacacagagggcagtttggccctgcagaagcaaacatattttgcttgggtaactgcaaaagtcacaaaaaaattgaattgataagccttaactaacaactgtcaatctctttaacaacaggatttttataaagttatctgtaaaagtgcttcacatatgaaatatcaaaaacggtttagtaaaatattaaaatcttatggtgaaactcatatatactatttatactatacataaaaaatatacaataaaaaaggttacacaagcagctaattttgatgtcctagaaattacaatatacaatgttagaataacagacttaactcaaacttgaaccatttaaatgttaagatttcatttcttaaatatataaattgtacaacattttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccactgcgcccggcctgtacaacattttaagacaagatgaattaccagcacgaatatcacaccccccacccagattaaaaagactaaatttgttgaacactttcaatttaatggctaacactcaaattataatttctgaaatctatacaagctccgaggaagtattttgaatagtctgtaaatagactcttaatataatggctaatatcaattaattaattcattccaaaaacctttgtgtcccaatgtgctcaatactacaggccagatatcaatcaagacgcaaactatgttctggagaacctcaccatctcattcagcaagctagggaaagaaggaatgcaaaaggatgtgtatatctctcaacatcattcaatttttagataaatattaatatactaaactcaggagttctaatagtttttcaaagtattttcttgggttccccaggtagactaatactttctgcaaataatcgtgtttcatctcttcttcaacagttgtgtaactcctattttcttatttttcctggccagtttactggttagaactgagaaattaccattggttggtgaagtagtaagaaagtacagaaagcacctacaacactatgtgggatatataaggtggtcatccatgtctttcccatgatattttataatactttttaaaacattaccatcaactgcttatcttaatatgattatactggatctttggcaactatgtaatagatgatgtatcccatttttcaagtattagcttctaaataggatttgatctatggatatgcaaaaattaggccctcatcaaaagaccttgtacaaatatgccagatggcaatgaaagtgctaaaaaaaatatactttattaaacatatctttacaagaatattaacctacagtaaacatgaacccagagagtagatttaaagagaaaagaaacctttcattctggaataatcctagttttaaacaactggaattatgatcaccttattgttggtacattattgtggtagctgtggtttgaagataagacacgtgagtccaaatccctaatctaatagttataagcaaacatgtacagtgggggtattttttgggattttttttgttttgttttgtttttgagacaagagttttgctcttgttgcccaggctggagtgcaatggtgcaatctcagctcactgcagcctccacctcccggattcaagcaattctcctgcctcaacctcccaagcagctgggattacaggcacctgccaccatgcctggctaacttcttgtatttttagtagagacgagttttgccacgttggccagctggtctcgaactcctggcctcaggtgatccgcctgtcttggcttcccaaagtgctgggattacaggcgtgagccaccgtgcctggccacgtgtacacagtgtttataacctttacaatgaatcagtttgtaaaatggggataatactaactccttcagaaagatgtagataagacaacgtaaatggaagtgcttcctacagtgttcattatagagcactcacattttttttttttttttttgagatggagtctcactttgtcgccaggctggagtacagtggcgcaagctcggctcaccacaacctctgactccttggtgcagggattctcctgcctcagcctcccaaatagctgggattacaggcacacaccaccatacttagctaatttttgtatttttagtagagacggggtttcaccatgttggccaggctggtctcaaactcctgacctcaagtgatccacccacctcggcctcccaaagtgctggaattacaggtatgaaccaccacgcctggcctgaaccttaagtttttaatttacttgggtaaatatacctaggagttggctctgaacccattttgtacactactattgttttattttaaatacaatttttacatgtttcttcttttccagtatattattcagtttaaatattctgataaacttctggtttataatagaagataatggcaaaatgatttcatttttctggaacagtacttcacataagacataccaatgtattttaagaccaaaacattaagaaataataataatatcaactccaagtaaacaaaaatactccctgggcccccaattcttattccaaactaaacccagtatctccccatgagctcggtcctcagttaagtcgaatactctcaatgatgtataacagaaacatggtctttgcagtgatttcttagtgcagaaaaaaataacgtctccaactataccaaagttgaaaatagttcttcgaagtcgaaattatgagactcaatctcttttgtgtcatttatttagtatgtgctgtgaccgtcactttaagtaaaagactggagctgttatggctgcagttactaagaggtctcagagctgtcactttttggcaatgtacttttaatgccatttaatactagtcaaaaaaaatcactagtcaaagtcactaatgaacaacacaccaaaacattctactcattaattgttggtagtttctattttgcaaacctatttattacctgttctagctgtttctgaaccatgctttgctgttcagtaacatgcttgagttgttctgcatcttcctctggaaattcacgcccagctttcttggcagtacgttgtttagctgaaagggccttcttagattttctgtgagcaccaatttgttcttcaagatacttctgctgcatttgaagcagctgttgggtctcctggagccactcttcatactgcttacgctgtgaatcatctgaggaaaaattaaaattcagttgtgttaattttctaaagagtccaacattataagttacacaaatctattttgtaaggaagtagtttcaccatgaccacataataggaaatttgaaaacacaatactaaatattagacgattatgtaatgataaaatatcagattttagaaaaatatttaattgagaaagccagagaatgcacattcttgagatactggttaacttagcacttataaatattacaaatccaatcttggaaaagcagacttatgtaatgaaattctttttttttactaaacaaattctctaacccacaagccaaactacatactaaggtatacatgcattttatgaatacgattttacagattttgaagagacaaagacatatcccattaaggtctagcgcatagactaggaaatcacttcccatgttaattttcctgagtttataagttctttcctatttcttaataatgaaaaaatatcctaaacagagagaaaaggaacccagaatgttttagaatggaataatttaaagtctatgacttataaaggaaatccataagttgaaaacattggtaattattattctgtagttatattttttaaaataaggggagggaatagttaaccaagcaaaacattttctacttttacaactgccagtaattctccccaaatggctatatctcttcattttgtaccaatattctcttctttattctttaagggcactttacttcattgatacccagtccaaggggaaaaaaaaaaagtcatcgtatgtagtgaaattctgaatatacctttttgactcactacaagacaaagaaatgaataaatacatttctaagaaggacattcgctgaaaataacatcaatgataacagaatattgtcatacattaagaatccaaccaaagccaatgggcacaataaagccagaaaaagccagttggtatagttctttacttgtttttaatgcaaatatgtattcaaattatagtaacaattaatgtagggggaatttcaaaaggtcagactttgggtttgttcctaaacccagaagttccagtacatgtatgaacttgaaatctagtctactaaatttgaagggcattttttaagaacaggctttttcacaagatttcagaagttctgcttctggtagaatgagacctaccgcaaggaaagcctttctggtttctggaaccaggagagcagaggtgagcaaaatgaaaaataatggtgaaaaaaaagttagctaaacagtctgaagatttcagaaaggttcagtttggggagaactttaaacactatcctgaaccaccttgggacccctgcaaataactagaaaggattcaggggcaccttgcatacctgacctttacaccatgctgctaacccaacttactgctaagtataatccctttgtttttcccatttagtgtccttgtcacttaggaagacagttcttagagcaaaacgtggtttagttctatagactgtaaagtgcccaatctgtatacaaaaacagcaacaatattgaagagaatggggaagatggtttttctgtattaaaatacttttctgtaactataattcttcatgcacagtgaaaaaagcaatgaaaacacacgccttgaagaagagttgcctaatagggcagtgatgtttaataagacaggagggcacctgggcttgaactggtgtacctacactcacttcaggtttagaacagcacacatagagtgcagacaagcaatccccagaaaacattaacttattagatttatacttactgacaaagcctggaccaaaatttggaggattaggcctagaaatctgatgtgttatactgccatcctaaaataagtaaaatttacaaatatgtttattccacatttcagttaaaggggggaaaaaactttaaaagaaagaaagaaaaaaagaaatggaagaaaaaaccctttaatttcctaagatatcttttaaaggtttttttataaaaagtagagtgaatttagtggtggcaacctaattctgaattcttattactatctctgaactactatactgtctagattttggctgaaaacaattatgcttgaggtaaaggattattcatcagaaatataatacagggcaaatcaattactgctaatactaagcgagagatctatataaaaaatctcactttttgatgaagtttacctggtttcttcttcaatcaaacacaagttccagattgactaaatgccactccacagcatggttatttataacaaaaactaatgtctctaacatgcacaaatataaaagaaaaatacgttaataaaaatattagtcttattttctacacacgcctgtagtcccggctacttgggaggctgaggtggtaggatcgcttgagcccaggtgtttgaggccagcctgggcaacacagcaggatcctgttcccaaaaaaataaaaaaaataaataaaaagtatttaattcgttttattttcaagttaaaagtcttatttcttccaggtgactgaacaagcagttattaatctcacaagtccctgataatcacctaacaaattaatgttgaaaaatgtttatccagttgtcacaagttctccttaacatgagctgtatacaaggtaataattataaacttatactagcagccagaatgtattatgtgcaatcttcacaatactacaaagcagttggtttaacatttgacatattaaaaaacaagaggctaaagaatttgcccaaagttgcacagtaaattcatagtggaactataatttctttaaaaaaactcagctataaaggctatgcttttcccattatatcaaatggcttctgtttcctcttttaataatgagaagaatataattatcagcataataaatctaaagcataactggcagggcaaggaagaaaacaggacatacattatagtaggtagctccctttataaaaaaaaaatcactgacaaaaatactgcatgagttttacttccccagatactgcttgatattatattaaaaatatagcatatctttcaacaaggatgggaagaaaaaaggaaaaaacaaatatagcatattgttttctacttgctgtgtttgtttgtttgagatgaagtctcgctctgtcacccaagctggagtgcagtggcgtgatctcggctcactgcaacctctgcctcccgggttcaagcgattctcctgcctcagtctcccaagtagctgggactataggtgtgcgccaccacgcctgactaatttttgtattttttgtagagacggggtttcactacgttggtcaggctggtctcaaactgctgacttcataatttgcccatctcggcctcccaaagtgctgggattagaggagtgagccaccgtgcccagccattttctagtatttatagaagttttacattttaaatataatgggtttaattctaaaatgcaggacatgaaaatgtccttctggagttaaaaataagtaaataaaaataaaaccaaaagtcctgagcgtgtggttttgccatcaagtgactttttacccgtaagtatataaatccttttcagaaatcacagccaatttttttaaccttaatttgtcttttgtttaaaaagcagtaaagtgtctttttggttacttttggctgtgctgatagataaggctactatttaggttggtgaaaaagtaattgcggtttttgccactggcaaatggcatatggtgaaatccgcatttacttctgcacaaacctagtactactctctagcaggggacttactctaaagcatgagtttgctgggaaacagaaaagcgtgcattctagagggactcattacaggcagtgttacctgaggaatggcctgtggtccaaggttctgtccttcactgttctgtgttccagttaccacctggcccataaaagggaacctgtcaaaacagggtacacaagtatcaagtgatgagcgtttagaaattattaatattaattaaaaactgtattaggtgcttaacagttttctcttccagagaagaacagtggcaatttcttcttcatcaaaacactaaagccctacctttcatgtactgggcagatgtgatcctcactgtaattcgatgaagtgtgctcttagcaccctcatgttacttatgatgaaagtaagattcagagatattccgtaaccttccccacaaggactagtagggctgcaataagaagccagctaggctgactctagaggttttactctattatgtgcctcactccactttacgataaaatgaattcaagacttcagaataaaaataagttgatttagttttataacgaactctaaggaaatgttttctcattccagtctgtgttaaaaactaattgagagcttagttattttatattctaaaacaaaagacatttcccaatttaagaattttcatacattttcatacatttctatatctaatgttaaagcaaatcaaaaatggacgactgaccaagatcagtctgcatggttaaacgtgtttagagaaatgttactcattctaattaaaactataaaaacttcacagaagcattactgcttacatgaaagtatttcctctggcattatcaaatgctttaacgtatcaagatatacatacaattttaaaaatgtattccaaaagctgtatattactatttaagtactattaggatatagaatatgtttttaaattttttactcaggtttttcattgatctgtcaccctacccactgctacaggtctggtctaaatgatcttctaatctgaatatcacacatggtctatcatcctaactcaacatatcacactactctaagaagggactatcacttccatttctaaaaagcagtcagtagaatactaagccatatacctgatacatgactaatgtatctaaccggcagatgcatgatgctaaaagagcatcagatgctgaaaggcctcaaattctgaggtccatatttaaaactaagtgctggtcgggtgcagtggctcatgcctgtaattgcagcactttgggagggggaggcaggtggatcacctgaggtcagaagttcaagaacagcctgaccaacatggtgaaaccctgtctctaccaaaaatacaaaaattagctgcgcatggtggcacgtgcctgtgatccgagctactccagaggctgatgcaggagaatcgcttgaaccttggaggtgaaggctgcagtgagccattgcactctatcctgggcaacaacagcgaaactccgtctcagaaacaaaaaccaaaacaaaactaagtagtaaataaaactcagcatttccttgttttgaatatacatagaaactacaatattattagcaagtaccacaactatcaccaatagaagacagattattttcctatcgagtgttgcaggcacctaatagattagttatgttcatcattactttcaaattatggtttattgctaaatttgttaatactttaaggaacatatatacataaatttaattatattttaataactatatttcaagtataatcatttccttcgtaatgctatgtcttaaattttctgcatataaaacattctgagaatttcaaaggcttcactggaatccaaaaatattcaagacataaaacagttaggaatctctatgatagagaaatagtgttaataaatattgctcaataatgaaaatcattggaaaccactatctctactttgatctcaaaaatgcttcttaaccatgtccaaagtatctcaacaattgaaaagaattatacccttaagaattcaaatttctttgaaatatatacatcttaaattcgtgcaaattttatattcaattctataatcatccacattttttatataaaagtttttcaacaagataactagactaaattgaggctctatgcttactttattgacagaggttctcatatagtaatacacgtaagactcattcatgacgcttgctaaaaatacagacacacaggcaaccatctccagatattcttatttagtaggtctgcagtagagcaaaataatctgcattttaaaaaaattaccccataattctcatggtggtccatgatcaaaatttaagaaacagtgccatgtggttaacaacccttagagggcataatttcaaaaattcagatattgaaataacccctactgtcttctttaatgcgtaatttctgtttttctcctaagagagaaaagacaaactctgtaactccaacttccaactgtcctcttatctattccttgtaactttctttttctgattcaaaaccggtttgggaacattttattttagaactgaatttataattgctttaatcactcagtgtcttaactgaaaaaaatcttagataacatgaacaattctaaaggtatttaaaagagcacagacctaaatactttgacttgagtaatcaggaaatccaatcttccaaatctttttaagatgttttacatttaccatccttgagactaatgctcttaaactggttcttacactaatttcttaaattggtatagcattttgtatctgatcatatcgagctgatgccatgacaacttaaatagtgttgttcattcctagacaagggctttccattttctgtatgttttttctaaaaactagtaatgatttcatgaatgtctagatgcccagtagaaacaagcagccactccacctacctgctcatcaccattggtggcatgcccagattgttttgtgccatcactttatttatacctttaagggccaccattttggctttcattataggatctgtaattgcatcaaaatctagaaaagaaatataaagttacttatttcatagtaattagttcaacgtacactaagaagtaattcaaatattacaagctcttaaattttattatttaataatcattacagatttctgagatggcaaccttatcctgggtttaatcgcatctcagtagtccttaactgaatcatgctttaataccttagtcctgcaggaattaaaacaaaaagtcaagtttaagggagattataagcaataatctaaagcaatgcaattaatttcctttcatccaaacttttgcaatgctaatcagaatggcttctttagtaaatataacatcacaaataagaatttgcaatactaaggaattctactaaattagttatcactcttaaaagaaaaatgcaccaatttcttaagggtataacctctcaataagaagctactacgaaaaaacctatttgcatctaaatgaaaaaaagggagcaaaatgatgaaattggggatatataaaatggaatgtcaattttattatttagaataaggcacactgcttagacacgtgccctttgattgctaattcttattcttagaggcactgaggcattttgactgcattgcttttgttgtttttagaatcagtaaaccattagaaacaagttaaagaggtttatatagcaaaaaatcgccaagcatttgtcatacacaaaaggacagtaagaagctttatttccatcataattttcttaaattcatccttccatgactgaaaacatatggcaacaatggttggaatgtaggaactaagaagacaattagtttctattaaacaattccataaataatagaattgagggaagtttgtaactcagttttgaatctcttaatttacctggaaagaatctaaaactcttcgttgttttcatttttttttttttgagacagagtctcactctgtcccccaggctggagtgcaatggtgcgatctcgcctcactgcaacttccgcctcctgggttcacaccattctcctgcctctgtctcccgaataactgggactacaggcgcacgctgctatgcccagctaattttttgttatttttttttaattattatactttaaattctgggatacttgtgcagaatatgctggttacataggtatacatatgtcatggtggtttgctgcacccatcaacccgtcatctacattaggtatttctcctaatgctatccgtcccctagccccccacccccgacaggttccagtgtgtgatgttcccctccctgtgtccatgtgttctcactgttcaactcccacttatgagtgagaacatgcagtgtatggttttctgttcctgcattagtttgctgagaatgatggtttccagcttcatccatgtcctgtgttgcccaggttggtctggaactcctgagctgaggcaatctgtctgcctcggtctcccaaagtgctaggattacagccgtgagccactgtgcccagccaactgctttcattctaaagctcaaggagggccaagcagggtggctcacgcctgtaatcccagcactttgggaggccaaagcaggcggatcacctgaggtcaggagtttgagaccagcctggccaacatggtgaaaccccgcacctctactaaaaatacaaaaattggccaggcatggtggcacgtgtctgtagtcccagctactcgggaggctgaggcaggagaatcacttgaacccaggaggtggaggttgctgtgagccgagatcgcgccactgcactccatcttgggtgacacagtgagactccgtctcaaaacaaaacaaacaaactcctcaaggaggaatagaaaaactcagtgctttattccaactgtaattctaataataaaatcttataagcatatcgcatgccactctaatacccatagtaatatacgttgagactcaagaaaactcctaccaatattagggaagaacggttctgatcgctgacgaatcatggcttgcatctgtctttgctgctgctgttcttgcctttcttgatccaaaagatcctgtagaagtagaggctgttcttctagaagaaggggcctctctctattctgctgtgctaatgtttgaggaatcattagctgttggggtccagacatgctactggtaccagactgacttgtttgaggcccagtttgagttgcaggttttcctgtccccagactgtggttaactgttgattgacctggaatgagccctgggtttacctgcacaccctgagaaaaaacatggtttaccctagagactactgtcacattagaattcatggcattatccaaaacacggccaggcggtgctatgaaaggaggcaaacttgacacatgattggatggggaggccggcagagttggtggtggtggagaccccgatggcctaatgtctgaattatcagatttctcattagcaagtaaacttgagagaactggagttgatccagttatgccacaagagtttattacatcttgagcaggtagttgagtggatgcctgaatgacatttgcactggggccagcagtttctcgattggttcttttctcaaatagatctggatcacaaggatgcaaagaagtcttttctccatcatttaggtctgagtgagcagaagcctgtgagcaaggagtgtcaacattatctttattctcatcatttttttcagtttcacatttggattccaccttagaatttggagacagtacttccgtttttacctcattggtaacagtggattttttctgtggtgaatgtttatcagagagaaccagagttttgttttcttgttcctttttttttggttcaacagatacacactgattatctaacttatcatcaattggaaggtctagttcctcattaaacatgcttttcttatctcccatgtcaagttctggatctgtatatgcaatgatatcaaactctcctgaccttaagaggtcatccaggttgggatcattagtttccaaattatctaaagtatccaattcaactaccttgccatcctctgtatctaaatttaagttttcaagatcttcatcatctaagtctttgacttcaaccccctcaaggtctttaacatccagttccttcacagaagggtcatcagaatcaagtttttcctctagaccatcagaaggctgggtggttatctgtaaattatcagacgttgtttcagacggtacagatgttgacaaaggagcttctgaaaattcaccacctagtggatggttcagagtcctcatgaccatagaagatgaatggacagaatgaccttgctcttgttgagatggtggcacttgttccaaatctgggtgcacaggtagctgattaggtagaccctggggaggtcgtcgcatggggtctgtgtgtctagggcccggaaagtctggccggggaatgaagtttccatgtctcagattagaagatgcctctacaacgctgccaggtggagcactgaaaggcagccgttgccttccgtcaggagccctatgtctcagttcaatatatgcttggcccagtatgttgtgctgctgaactggcaagctctgtggtgaaaaatgctgaggaagtccaactggattattcatttgtgagttatttaaaggcctaggcatatctacagatactgatcttcttagctgtggagaaactccagatccctgtatttgctgaggaggcacaaggaagcgctcttgactcggcatggtaccatgactacctcctggaaatccaaatcttttaaaaaaaaaaaaaaaaaaaaaaaaaaagcaaataggtattatgttaaatttagagttaagttgaaaaaaagaaaagtcttcaattaaactgtacatacaaaatgttgccaaatactatgacttacaaaagcaaagctatcaccattaaaaagtatttacagtattcatatgcaagtaagattttgctaagaatcctataatgaacaccatatctgagctctaaaggcttaagatttaacagataacaaaaatgaagacaaaggaagaacaaccaagcagatgaaatcaattgttcagagataagaacaatactactggactttttcaggaagagtttcttttatctatatttagggaggttcgatggaggaagctgattcggggatgatgtttgaatgaagataggtcttcatacctattgagggacttacaggcctcagtacatgagactacaaaggcacaggtttgatgatgggatagaataaacttagagaaaaggacaagtaggcctcatctataaagattaagtaaatgtataaattgttggactattttatattgtacttccttctagacaggattacaggcaacttacacagaatacaaagcatagcaagaggcataaattataacaaggtggaagaaaaaagggaaattaagagtaagattacaggcaacttacacaaaatataaaatgcagaaagaggcataaattacaactaaggtagaagaaaaggaaactaaaagaatataacatggaggtagagatataagactaaaagacataaaactaaaaagcatatcttaaagaactatttccttattataactagggcataggtttggctttgactttagccactttgaaaaaggaaacattcttatgattcatcaccactaacttacaaccctatctcaccatggaaagttcctaaagggaaagtcctttcagttcggaaatctctaaaatttattattattattttttaaattgagacagagtctcgttctgtctcccaggctggagtgcagtggcgtgacctcggctcactgcaacctccacctcctgggttcaagtgatccttttgtctcagcctcctgagtagccgcgaatacaggtgcagtgcctgccgccatagccggccaatttttgtatttttactagaggcagggttttaccatgttggccaggttggtctcgaactcctgacctcaagtgatccgcccacctcggcctcccaaagtattgggattacaggcctgagccactgcgcccagcctaaaattaatttagaatgtaaagttaaaaggtagaaatttggagagaggacaagtctcatcacatcgtaggaggctttgcctacgcagaatagctacattttgaggatgtcatatgataaactgcatcattaagggtgcaaggtaatgctaacacagttaatacttaaaaacaaaggtaatgttttcagagtctgtagagttcttagaggaaaaaaatgtctatgacctctcattagcactaaatagcagattatatatatttcaaaggggagaaagaagtagaaagcagtaacagcttcctgattaatactaacttcatttgtctatttcttttaaaaaatttttaaatttgttgaagaggttgggggggggggggggtggtctcactatattgcccaggctggtctcaaactcctagcctcaagcaatcctcctgcctcagctagtagctaggattacaggcacaagccaccacacccagctctgtttccctcttctaatagcaatttaaattcggcaggaaattaaaagcattacctaaatccatgaggtctcatccccatactagcaacatcaggaggatagggtccacgctgatcttttgggaaaacagcatatctaggtcctaaaggaggggcaacaggagacctaatgttcccaggatagggaggtgggggtctggtgaaagcctggttaacattctctggttgccagtgttgaagaggccctggatgaggcactgcgggtgagtcctgtgaccccttctcctgtcgacctgcaatcttcttctgctgttgctgctggagaatgatttcacgtaacttctgccgctaaatgggaagaaacaaaaatcactgggatttgtggtaattaatggctttttaaaggttactggctttttatttttagatatgggatcttgctatgttgcccaggctggcctcaaattcctggactcaagtgatcctcctgtctcagcctctcaagtagctgggattacaagcatgcgccaccgtgcctgacaggttagtggctttttaaatcctgatactttcattatgtggctatggtaatgtttcaaagtttgatgaaataccagttacatttaactattcaatatattaggaaaaataatttgatgatttgggtccttttccttgccagacaactatcacaaaacaaagctttaatatttaaggattcccctgcgaattcgtgaaaactgaaatcagatacagaataaattaaactggtgttaatttcatcaatttcatttttcttttttgcagtatgacaaactctacagaataaaaaaaataaaacattaactcctgtgtagaaattactcagtttgatgaaatgaacagcttcctcaaataatacatttaaaactgagaacatacaatgtgtttacctgtctcaatttctctgtatctgcttgggccatatttacagtattctgtgtatcagttactcctgaagttggcacaggtccaggaagttgggagacaccagagaactgctggccttgggagtgcattggagagtttgaagatgcacagaagctcccctctgatccaggccttggctgatcagcaacatcatgggcagtttgacttgttccaaaagagtcagactgagatcttggagtcattggagactgatcatagggatcacgggcagcagatggggaaacacggctaaatgtgtctgaaagaccaggtccagggggcctaggtgtctgggaacatgtatcaggtggccttaccaacgggccaggtaaagctggtcctcggttttgtgctgcttgcaggaaaggatcctgatttggcatgaggactggtcttgtcattgaggacctagtaaaaccctctgaaatccttggccttggtgttgctggtggctgagagtaagggacagaaattccaggtcttggtgttccaggaggatgagcatatggatcagaatgcctctgatttgttacaggtgtaacaaacaagtcagtttgtgtagatggtcttggggtttggggctgctgactatatgggtcaacagtagtaggccggggagttccaggaggttgagagtaagggtctgtattggacctagctgttcctgaagattgggaataagaatctacaacaggtcgtggagttcctgggggttgggagtatgggtcctgagatgttggccttgatatggttccaggctgggaaaaagcccttgaaggatgggcaaaagattcattcactgctggatgtggggtaaggggaggctgactatatggatcatttgactgattatgagaaaaattatctataggtcttggtgtcaaagcaggcctttcataagggtcaacagacaatcgccttgatgcctgtgacactgatccataaggatcctgagaggatggaggaggttgcattggagtcttaaaaggtccaggaccactatcaagaggtgcaggtgtcaacaagggtcgtgcatatgagtcaggtatcctttgtctttgaaacacatctgccctaggagatggtttagtaaagtgatcactggttccagctgctatagggccttttgcagtttgttctgaaactacaggagaccgggataggcccaaggatttgggaaattgatctgtcatcacaggcctaggtgtgtctggaggttttgcataggggtcattatttgtcgtggaagaagaacataaatctctgacaggggatggcctatttgctgttgtctcattcatttgaaggggcctagataccgatgataaaggtgtacagttttccactggtgcagcagaatttcttctggaaaaactatggcccacaggaggtggtcgaggggtaccaaccatttttgcatatggatccattggagatggtggtcgtgagttagaggacccaggtgaaaacacttgcggtgagggtggctgagaagtctgagcctgagaaagactatcctggatgggaatccgggatggggctggaggaggaggtggagcttgtggctttacaaacacatcatctgaagatgtagacgtaggggtactgggtggctgttttgtaaacagttctttatggaatgactgtgcaggagacatatttccattgccaggctgaggtgtcaagggactctgtatcccactacttggtgtatctgaaccagactgcaccagaagatgctgagaaccaaattgctgttgttgctgctgctgctgctcatttttcacctgttcaagtttctgtgtggcttcaattttagcttgctgcttacttttctgacgcatttgctattaaaatagaaaagaaaaagcaatcatatttaggttaaggaagaaaactaccatcatggggggaaaaagcaacagaaagttaatttgtttgatgtcagcgctaccagattgctcccatattagattatgaattcctgaagaagagaaattactcatcatggtatgttccatttgtgcctagggcagtatattgtttataatatttcaataaatttctcaaatcaatttaaatatattttactgaaaagagaaacaagtctatcctaaatcaaattttcatggtctaagaactatattctaaaataataatgcaaagacctcccttctcaaaacaaaaatgcaacttcaaaaagtagattatccaaaaattccatacctgtctaaatttccattcctgttcatgttctgattctctttgctttaaaggatctttaaaaagctccgaatcaatacgagagctgggatcaatgctatcttgctgttgctgccttttcatggaatcatttgacatctgtactttattaatgcgtaaagcagctctgttatctctggctttttgctttgacaaaagaagagaaaaaaatttcccagattatgttaaatgttttaaggaataaaataaaactatcatgaactttctcaaataaaagaaaaaaaagtcaggtaaaatagctgaaatacttacggcacctcccaaaaaaggatctggacactaactcatcttctctctttacagtgcatagtacctatcagttgaggatatatttctatgtatttgaattaagcttaaagatcctaggtgtgatttaatattttagctcctagttttcttaacatatccttagaaattatgtctccttcaatttagaaagaaggggctggggccaggcatggtggctcatgctcgtaatcccagcacttcgggaggccaaggcgggtggatcacctgacgtcaggtgtttgagatcagcctgaccaacatggtgaaaccccacctctactaaaaatacaaaattaggccaggcgcagtggctcacacctgtaatcccagtactttgggaggctgaggcgggtggatcacctgaggtcgggagttcgacaccagcctgaccaacatggagacaccccatctctactaaaaatacaaaattagccagatgtggtggcacatgcctgtaatcccagctactcgggaggctgaggcaggagaatcacttgaactcaggaggcggaggttgtggtgagccaagattgcgccattgcactccagcctgggcaacaagagcaaaactctgtctcaaaaaaaagaaaaagaaaaagaaaaatcagccaggcatggtggcacatgcctgtaatcccagctacttgggaggctggggcaggagaatcgcttgaatctggaaggcagaggttgcagtgagccgagatcgcaccattgcactccagcctgggcaacaactgtgaagctccatctcaaaaaaaaaaaaaaaaaaatttagaaaaaaggaaaaatatccaatcagtcttaaaaaaaaaaaaatctggatatttgaaacgtatcattaaagaaatcacttaaaaatttaaaaattctgtcattacctaattcaagtcaaaataaaacacagcatattaacacatctatatatatatatgtgatagagcatatacacacatatatgctctatccaaaataatcactgtaactgaaaatatgtgcactggggaacaagctggaaaataactatatatattttccaacaataatacagatttaatatgctttaaaacgaaagcaaggatttggttccagctgacaatcttaatttggctctttgggagaaaataatttaccatatgaactgcgaatcttataaaattacctaatagttcatggcaaagatcatgtgtcaaaaactctttaaacatgtctaaatatttctctttcaagatgcacaaagattctctatgaaacctaacaagaaaagaggtgactgtggaagacactgaggcatgccaatccagtctccaaatttagtacagttgtccctctgtatccatggggtattggttccaggattccctgcagataccaaaatccacagatgctcaagtcccttatagaaaatgtcacagtatttgcatataacctacacatatcctcctgtatactttctccctttttattttttgacctagcagggtggtcttgctctgtcacctaggctggaatgcagtcgtacaattctggctcactgaagcctcaacctctcaagtctctcaagtagctgagactacaggcatgcgccatcatacccagctaattttttcattttttatagagatgaggttttggctatgttgcccaggctggtcttgaactcctgggctcaaagccatctgcccaccttggcctctcaaactgctgggattacaggtgtgggtcactgtgcctggcccctcctgtatactttaagtcatctttagattacttgtaatacttaacacaatataaatgctatgtaaatcgttgttacattgttttaaaaacaatgacaagggaaagagtctgtacaagttcagtatagatgtttttccaaaatatttttgatccatggttggttgaatccacagatatagaactcatggatacagacggccaactgtacctctgctgaagagataaaacaattttaaagtgaaatgaattactccttcccccctaaaacagctgattttcaatcttcaacgttttggttctattaacttgcttataaaaatgtcacactctctattaagacataaggagttagaaaatcactttaaaaataaagttgcttgttgtacaggtactaacaagcattttctgaaatggaaatttgttttttattaacctaatacaaataaggttcaagcactgtatttaaatatttaaaagatagaggagtttcttaaaataccacatatggtgctctttcttgtgagcttgcttttctccacaatttggcaatttgcttcactctagtagtccaatctgcaacaaaagaacagagtataacactttctcagagccatgctaatgatgtgttgtaataaagaatgttgatgaactgctgacagttaatcttattcaggccgtattctcatgaggtcatagacctatattaagttttttacaaagaacaaagatcgtggcacactgtaggccaaacaaacgttttctaaatgaagtgctgccttattaacaacgtagcttgtaaagttgggaagtttttagattcaagggacaaagtagcaaaaatgcaagccagacataataaattccctctggtggtaagacaccaccagaaccaaagtacaagtttgtaaaacatctgtgctaaacagaaatctatcaatttgacctaccagaagtaaacaaagtcataaataagcatctcactagcatttgtggacaacaaacacatggaaaagtaatgagttcaaaccatttatatgaaactcagtgtcatgacggtatacaaaatgaagaagcctgggtaagatcaacagttaatgataaatacagaaattatttattccacattacaaaaagaaagcaagcttccaaaaagccaatgaaaatgaaaaatcagttcacagaccaacagctttaacacagtatttcatgaggttcttgaatcacaaagtaaaattattaaagaaaattacttttaaaaaagttacagctctgctgtaaggacaatttgtgctgacacaaaatgacaacatacccatgtacgttcataaacagcaaatgtaagcatggaaagaaagtggctgaagaatgggatactgccttcacaggtctccctgcatcaaaccactgatttctattgttagataaaaagcatttcatttattacaatacataatgaataaagtcccatgaagacgccaatccaaaaaggtacctaaatacaggggtcatccaaatgaaaagtcacttccaggtacccctctagtaatttaagagtttgtgtattgatagatagctgggaaactattgcaaaactgagtttgaataactttttcaatcctagtttgtctgataccatgaactcaaaataataaaaccgcattgcttgcatatattcaataattgacatttcattaatccaaatttctcattcactggttaatcagaattttcacaaactgtactattatcatctgtttttttcaagaggcagtggtaatagctgggcagtcagggaaagtgagaggggaagaagggaagacaatattgaattcgtttcataaaaacactatttaggattcactgatttagcctagcagtatttttgattaaatgatagtttgggttctagaaattttttaaagaatcacataacacggatttctgcatattaataagtactgctaggagctgaaaaacggaccatttcactaattgaaactaatttttgggaaatatgaggatggatgcagggtctaggacaaagtaaaatgcaagatgtttctagacatctagggaatcttcatgttgtgggtcatcatagacaaaaattagttaagctacctttctattgcagttaaaaaaaaaaaaggtattgcacatgtgaaaatgttggtaaaacagaaataatatattcatggcttaccagggaattcttcctttaagttggggaaattaatattggtgtagagaactggggcaacagttgccatttcacccagagcctcctctttctcccacttaagcgtgcttctctgggcattcgacattgtgtcattttctccttccacagtgggagctgatgatgtccaagagttgttaggatcacttgccattggattaaaggctgaatttttatccctgggaaaaaataaatatctttactttatgaacataaaataacttcttaatatatgttcaagtatagctttcattaaaacctattacaaaacagttaaaagtaacatatttatagcaaaagccacaataaacgcaacatacaataatatcatacacaatcatttaagcagactaatttatatataaatcaaacagaaattagtgcaatttaagtttccatagaaaataaggcttgtacctggcatcaggataagaggattgtgcaattgcagagaaagttcccagtccgcttccaggtggcaaagaattatgtgggagatgaggactggatccaataaggccattcatgagaggcatccgtgaaaaagcatcttcagagaaaaaaataattccgttggcatgatattcacaagtaacaaggagttgaagtaaagctggcccttgaacaacatggtttttaactgcatgggtccacataaacacacatttttttcaactgaatgtggatagaaaacacagggaaacccatgcatagagaggaccaacttttcttgtatgccaagctccatagggccaacatttgacttctgtattctcagattttggttatacctgggggtcctggaaccaaagccccaagtacagaagagatgcttatacttctaaatcaaaacctttaatgcaatttaaaagtaggatttttttcagtattttataatacttaaagagtgacttttggctataagattttgaaatatgatctctacagctgtgattatttcattattgtgtactagaaatagcaagtgttctggagtccaaaagcccagggtgtgaacctcaattttacctgttagaagcagaatcaatttctatttctgtaaaccgtaggtattctgttatttgggttaattgagataatgtatgtacagctctaaacatagttcctggtatgcagtaactattcgacacaattaactcctaaaaaacactaatgaatcacagcaaatgctagtaagttttatcaaatattctttctcttcattaaaaatttacaaacagatgtttcttatattttattcctgttcctcttaataccaaaaaaaaaaaaaaatctatgattctttcctttttttttttttttttttgtttttgagatggagtctcactctgtcgcccaggctggagtgcagtggcaagatctcagctcactgccacctctgcctcccaggttcaagcaattctgcctcagcctcctgagtagttggaatcacaggcacttgccaccatgcccagctaatttttgtatttttagtggaggtggggtttcaccattttggccaagctgatctcaaactcctgcctcaagtgatccacccacctcagcctcccaaagtgctgggattacaggtgtgagccactgtgtccaccccacctatgattcttaaattgatactttctctaaattagttttgagtaagcaatatatctatcactaaaaatcagatgattattcctaaaaatacatacactctggttttggcctaatttttataacttacagttcagcccccaaacacatttgaattctcattcgagcttattcacaaacatcaaataccttatcgttttctttctgaatagacattaggcaaataaaaggaccatcttatgcttctttacaacactcctttaagcatgtaactccagtccttattgtgaaagtctacttgtctaaactatttggaactaagccaactgtccatattggagcagtttccagaaaaaagaaagaacaacaacaacaaaaactttgtttaccttcaaaaagccctcccaattaaacttgatgatttgtggaaatacacaaggcctctgttaattgttgcaacacttagagccatactattacaggagatccacatcaccaattaattacacaaatggcaatacagagttgaccaatacttggtataactagagaattcctaacctgatcacttgatttttttttatctaatgtcattccattagattaaaaaaaaagtctcatacacgtacattttacaatgtataatgatctttcacttaaaccacatcatttgaatgttacaacactaaaacctacatagctccagtatgtatgtgcagatactaaggatgatcactgacaagtttaaaagattttgtctcaaagacttcctagaactctctgactttcacaaacgggcttaccctactaaatgccacagctgggtccactggatcaggttttcacaatgacaaatatctcatgacacttacatttactccaaggattaaagggcaagatttctgcttttttcaaactagaatgccacatctattttcaacttcagtgaaaagcaggttccattaaggcaggggtccccaactctggggccacagactggtaccagtccatgacctgttaggaacccggccgcacagtaggtgaacagcgggcaagtgaccattaccgcctgagctccacctgtcagatcagtggcggtattagattctcatagaagcgcaaaccctattgtgaagtgtgcatgcgagcatgttcctatgagaatctaatgcctcatgatctgaggtggaacagtttcatcgcaaaaccattccccaacccaccaacctgggtttgtgaaaaaatggtcttccttgaaactggtccctggtgcgaaaaaggctggggactgctgcgttaaggaatgtgcaattttaataaacaatatcaaatgtctttcatgtaattaggagaaacaagagtttattgacaaggagaatgtgatccatactgtagctaggtatcagtgccatctaccgatattacaataataatcttgtaataatctacaatattaacatattgaaacttttcccaatagtaatattagctattatttgttaagtactttatgctatgctaagcactgtcttaaaagctttacagcttcatgaaaacccactgaaataggttattatgttcagctccatttaagcaaagaggacccacagaaattaaataatttgttcaaggacaaataagtaaaagcaaagtatttcttcttattttattcaagaagtggtcttttttttttccaagtctaccatatctacccaaactagtcatattagtttataaaagttcaaaagttacttcacaacttttacataaaggtatttcaagttactctatctcaatcttgaaaattctattctctactttctgaactttattaccatcagacaataaagcatattacatattacataataacatattacactttgcctcccctttctcatcaattctattgaagttactccactgaagattagcaacaaccttcccatggtccaatgaaacaatgtttttcaagtagtcatgttacttaactgtacaacctgtctctaatgatcattcatttccaagatcctatacctctcactcaatgtctcaaatctctcaccactttttttactttcacctaacctttaaaaggaagaaagataagaaacatgtaattgcacacctaatataaatcagatgagttaagcatatacttaattacatttaattaaaaagcattcctcgagattctatactctactggcagtatattctcttaataaatctcatccttcccacatgtgcaattagcacaattacacagataattcctacattttcatccatctccttgactaactgcaactgcctgtaagtcaaaatagtgtatatgtcccatttctaccaacctaaaagaggtctaaaactaaattcattgtacctccactaccttctaccagcacacacactaagtcttcctctgtttcatgattatcctctgggcccctggtttatacatagtctaattcactttaatttccccctttcctcacaccttatatccattcagtagcacagtcctacttgttctaatgtcattttctctcgtatctattccttcctttcaatcagcacggaagtatctttacatggaacctactttttaacttagtctcaaccacaataacctcattagtacaattcttctcgtcccaaatttattcccaatattgacaccagagctaccttagcaaaacacataagtgatcagatcacaccagtggtgtaaggtcttcaaaggctcttggaagcctctagggaaaaggctagctgcctctgcctatttctcagagccctttacaatcagcaccaatgtccacttctagttttgcttccttaaacaatgcccactccctttgctctggaaaacattaaagttgccattcttgaataactatgtgtcgccctatatgtaacttgatcatgctttgcccttacattagaactactattccttcaaacaagaacaatgaaatcttagtgattcacaaggctgtacttgaattatactgtactataatacacattagttgtatacctgaaagtctacagtattagaattacaaactcctaagggtaggcaacctgattcaccttgtattacacattaacaccttgcaaaagaaaaaaaaaaaaagaaaaagaagtcatcctcccaagaccttttaaaaatgagactgcacaatgaagtgattttcataatgattgtaagatgttttttataaagaaatacatctttgatttttaaaatatgcactttcagttcagaaaacataaagacaggtcatttttatatgttgaaaagagaaatactgaatagttcttaatcgttaaaacagcatatgggggctgggcgcggtggctcacgcctgtaatcccagcactttgggaggctgaggcagatggctcacaaggtcaggagtttaaggccagcctgaccaagatggtgaaaccccgtctctactaaaaatacaaaaaattagccgggcacagtggcaggcacctgtaatcccagctactcgggaggctaagccagaagaatcgctgaactcagagggcagaggttgcagtgagccgagatcacgccactgcactccagcctgggcgaaggtgtgagactctgtctcagaaaaaaaagaaaaaaaaaaagcacataggaacaattaaggcaagaatagttatatgataagtatattacccaaatgtaaatcacatgtttagcctagcaaaaatcaaggtaaatttatgtttagaggctaaactggtaaaaacacaaatatttccattatgtgcattatggaattttcatgtatatacaaagttgttagtaaaggttacaaattattcacacactttggcacttacacaagaaaaggagaagatatcctcatgttattcaattcagggtatagtcatgaggcagtgacaataggatagagagagatgttcctatgctcaaatcatcagaaatatatactagctgcgcacagagggccacgcctgtaatcccagcactttgggaggccatggtgggaggatcacttgaacccaggagttctagactggcctgggcaacaaagtgagacccccacctctgcaaaaaatcaaaaaattagccaggcatgatggcgtgtgcctgtggtcgcagctgcatgggaggctgaggacagtaggatcgcttgagcccaggagatcgcagctgacgtgagttgtgttcacaccactgcatgtcagcctgggtgacagagcgagaccgtttcaaaacaaaacaaaaatacatatagatagagttatatacacgccaccatgcaactccataaactccttcctatagattcccatacctgtaccaatttccctatctactcatacagaccttaatcctaggctatcaaatttcagctctacagaaaaggggagaaattggtagctagttgtaagtaggcagaagaaaaatgaacaaaataggcaaacattcacaaaatttcatagtgtctacagggatagaaaggtcactgatttactatgaaagtatgtactgaacacatactctgtggcagggcatataagcaagacatggacaactctagcctttaaagagctcacaatctaaagggaagacataattacccaaacaggtattatatttgtgccatatgctacaaatgaaaaacatgggggtggggtggtgaccagctaacctctgagagatgacagtgaaaccgagggcagatcaatgagtacaggcagccaggtgagcggggacagttccacacacacacacacagcaagtgcctatgtggcaaatgactagagtggagtgagctgggaatgggacttgcagggagggaagagggcaggcactgttacatcctccccactggacataaggataattacagaattacagagaatttcagggagaccgctatgtgaagtcagtatttttcaatcattacaaaagggtttttctccctatcagtttgtatacgtggctactaaagaatagggcaaaacttgcttgtgtgtgtatatgtacccacatatatacacatgtgtgtgaatataatgtagaattataaagtcataacataccctgattgtgtattggcaacagctgtgttggtgggggaggctgtggcaatggagttggctgagtgttcgcaggactaagtacagctgtaaataagtcttcaacatcttttccgccaagctctaggagataaaacaataatagtaacaagattaaaagactagtagggtcctggtatggggaacgccattttcattaactagaaaatcaaaacacatttacctggaattttatataattttccaagaattgctcctagaataaattaaaaaaaaaaaagaaacattaacagctactaattcaatatactgatataaaatagtatttaactgacagaaataattagaagttaaattataaccatgcaaaaatctttaaaaatcatatttactcaggtcttttagaaagcctagatgtagggcaaatattttaccatctgtgaccattttgtctagttcaggactgaggatcccatctagctgttcttcacttaatggtcgtgaactctgattgacatttggctgaggcaaagaggaaggatcatcagtgacaggaccaatatctacaagagtaaggaaaataaatttaaaggtacattcagaatactcacacaaaaatgtatagcactatttacctgtacttagtatataacaatatgattaaaatagagaaataaagtctgtaattctgaatcagaattctcatatcaatttggagagtcgctcagtaaaaattaggcacaatatatttgtattcggtgccatgtaaagttctatttcaagtaaaaacatttcctgaggaataaaagaatacatctgattttaacttgccaactcctgccaaaaaaaaaaaaaagcttaagataggagtttatgagaaatcgatatgcaaataattgctttaatttggaaaatagtgttatcaaatgtacagttcaattattatgcacagtatgtaaaaaggaatatgtttcatatgaattaatgaaaagccctaaaatgctcagtgtttaatattatcctttgtaaataacttcaattataggtaatatttttaaagtattctataggcacattctgattatgtacattacattttataaaattgtaacatgctgcagctcaaatttgtaagagtcacatgtaaaagtggtttatcatctacatttttttcatgctttctcaatattattactattaaaaagtaaaaatttagtctgttcttatttgatcttatattaggaactagctctacgacatttaggtaatattgtaaaccacatattaacaaaaataaaattattcattaaagaaaaactactgagaaagtcacccgaagtacagtacagctatactatgctttagccacacacaaaaagggaaaagcaaagtatggattagtgacaaattagcactactgataaacagcatgcacctacaggttgtttcagctgaaatcactataaaaaaagaagactacttctagtcagccgtcatccattgctcagtttcttaccaaatggaaaaggtgagctctcaacctggaaagtgcataaatcaagacctataagacccaaaccaaataaaatggatgattaccacaggagcaggaagtgagggaaaatacaaacaaaagaagaaaaaagatacagcaagactttaaggcaacatgccttaaatgtgatgcaattagaaagacgacagaaattaactaacttgctatacccctcctaaagcaggaaagctgaggcagatcaaagaaaatgctgagtcctttaacaaagccaaaaacaaaaacacagttactgggaaacagacaaaaggctaaacttgttccacacatcatacacctctcgctcacatcagaaaccagaaaaagggtaaacagtattcatatatacctgaatgatcaactgattttgctagatcatctgaaattattccaagaatgtcatcatctgtgtttaaaacttcagaaatatcagctaatgggtcatcagcaggacctaaatatagtaaatatgttttttaaaatttcagtattttctcagatattaagccatttgctaaaaacctagagtacagcagatactgagtgaggcaagtactggaataaaaacctgagactcttaattttacagtaaaaattttccatagcaaaggagataatgttttgaattacaaaaatttactaaaaattcagacgattttgtcttgtgactaatgtatattgagacaaaatttaaagacctgtaggcaataaaagtgaaacagaataaatgctgtaagaaacaaagcaaagaaaaaaaagtttttcattaagaaagtggcatgtctaaaagtgacattgagaaattaaaacacagtaggaaaagttaaaatatgaaagacaaacctgtcactctttagaaattccatatggagcacaagccagaaattccatatggagcacaagccaggtaccatctagtaactacttgcagctttgctgttcatactgattactcactcatttattttaaaaagtatttcactacccacagaactgtgtctatggatcacgtatcaggcattgcccactcagtaatgactgaaacaaagtgcctgccctcagagggcttactttctcagggggagttagtaaataaacgacatcgctgtaagtgctatttaaagaaaaaacaaggaaaaaggattaaaaataagctgcggggatgttgtattagacagagtggtctatgaagacctttaggagatgactgagcataaaactaaatgagggagtaagttatatgcacaaagatggagataaccctccaaactaaggcaaagcagacataaagcccctggggcaagccgggtttgccaacgagaggccagagtgttaacagtaagaaaaactgtggtaaggataaaaaagaggcagctagggcaagattatgttaagattttagagattatggggaagactgggttttattctgaagtgtaatgagaagttgctgggaggctgaaagataggagatgactaatattttaaagggaacatactggctgctatatgtagagcagatgaggggtgggaattagagaggggctggtaagattagaaaagggcactggtgcagtctgagaggtgaggtgatgacagcaccagggttctaaggaaagctgagacaagtggtcggctttgggacgtattttgaaggcagacacaaacgtggatgaatgaaagggaaagaaaagtcaaggaggattctacgggtttgggcttaaccaagaaactattggaactcttgtttaggctagctttaataattatattagtcattcagtaaagagaaactgaaatttttaatccatctcaagcttatttttacttaaaagggggaggagggcataaatgtaatattccaggtcaaatacttctgtcaaacagtcttggtcccattatatagttttcaaaatgtaattcatatgtaacatatcacattaagttttgcgtgcccaaatatccaggaactttttagagaaaattatttcaataatgacaacactgtagttgaatgaaaaaaaatctggataatttttttaggagtcatatagcagttttttgttttaaagtaatggaattctactatacaattataactaattttttaaagactgttttacaagtttgcccctacctaaaggattttatatctgaataaatcattaaaattgatataataggctacaatgaatgacatgttaaaaaaaagcctttagtcattaattttccattataaagtgaaaagagtagttcaattgcaaagaacaattaatctaggttttgaaatgggtatatttttctagtcctccaagttttggccttattgtaaaactgttctctcttcagtatttttgtggaaaaaaataaataaagaaaaaaaaaaacttgtatcaatatctttcctatatgttctctgtccaatttcaatccttttgcttttaaaactcaagtgcaaagagctcctatttaagtcttcaaagtggctagttatgagagttataagataaactttatcgtaaaatatcctttgaaggacccacaggtctttcattatacattatttttaacaacatactgacaaggacaagagcaggtcatacttaaaacaacagaattaaagtaggaggtaaaaaatatgtaagattgaacaaacaagaagcatgacctcactaccaacaatgaggcagactggacatgcacatgtgtccaacacggggtaagattgcttctaattatttcaaaaagtcaaaatcaaaaatagttgtcagtatttcaattcaggataatgccaagttaatgaagcattaactacttaacatccaaagtcatttttcagtggaagattgctttaaaattgtttttcaaaatgagtttataaaattaactgagtaacaaatgcaattaatggtaaaaaaaggaagcttaccaaaagaacaatgatttacaattgacagaaccataggggagaagtgggagaaacactgatcaagacacttacctacccaatgagttaaactcctagagccttgctgacattgctgtaactctgtaaatacatcaagttctcatacctttctctgattgttaatagttcctgcatttaggataatggttctcaaccgggggtgattttgcccaccaaaaccaaaaggtatttggcaatatctggagatatttttgatcatcatgaggccaaagatgctgttaaacatccttctatacaccagaaaggctccctcccacaacaaagaattactggtgcaaactgtcagcagtaagaaaccatgacctagggcaacagacttcactgtagtaacacagtatgccagcaagttcccaagtacccccacatccatttcggtttctctgttttgaatttaagctgtatgattaacaaaaatctatcttagatttttagtcaaaaagtcactgttggccaaattataacccctcacattgccctcagcaaagtgtaaaccaaatgttttccttcacaactcttgatgttggtactagttacacaggtaaattaatttgctacatcttatacacctgtccacttaaaatagttccacttactgaatgtaagttatacttcaatgctgttgatttttaaaatgcatatgaggccaaacaaaaacatttcaaaaagatttaactgaaaggaagatgtatgttatatgatataaagaaaatatctgtgaataattctacataccgtgagttccagattttgttggagccgaggatgaactaagtagtggatctaaggaaggatccaagaaacctgtgttcatgtttgttttatataaaagctgagctccatcttctgacagattatctaaacttatcttgctttgtctacttgtatctagaagatcttttccaaagaaagcttcctagatgaagataagcacatacaaaaatggttagaaaattctaaaaagacaatagattattctgtcatggtttttgacaaggaagcagaaataacagaaaaggtttatatttaacaatatagaaactgaatacagaagtattaaaaaatagaaatatcctgtcaattattttatatagattctccttattttaaaaataagattttttggtagctttactagagacaaaattatggaaataaaaccacacaattataccaaaggtttctagaaactgcagaatagcttcatgagtattattaatttttatagattacttgcagaggacagcataagactttgatctacggctttaatatttacttcaggtagatttgtaatctattgattcatataaccacacttacactataagactacttacatcatcaatctgaaagacggttttatagtcagtttagccatactatgtgtgcaatatttacagctactaaaggcttgtggttttctatttatttaggcatattaacatttttccatttcaatatactttcaagctgggttccttgcaactccaagatctctccaaaatttctcaaaaatcaataccaaagacaaaagggaagcacagttccacccctttaccctgcttcaacccaggaactctgctttagtctatatcctatgatgtagtctatctggaaaaaggatcctccatacaggacaattttgcaatacaacatttaacacattcttgccaaacatgcacaaaaaagttcactgtagcatattttgtaatgtcaagaagtaaaaatggccttaatgtctatcaacaggcatagaactatccaaattatagacacttatattacaaaatacaacaattttttaaaagtatatagttctatgttatcaaagaaaaagccctaaaatacattactaaaagaaagtaagttgaattacacatacagtaaattataaaatacaggtcgggcgcagtagctcacgcctgtaatcccagcattttgggaggccgaggtaggtggttcacttaggcccaggagttagagaccagcctgggcaacatggcaaaactcttgactctacacaaaacacaaaaattagccaggcatgcgccaacatgcctgtaatcccagctacctggaaggctgaggcacgagaatcacttgaacccagaaggcagaggttgcagtgagctgagatcacatcactgcattccagcctcagtgacagagtgaggctgtctcaaaaaaaaattagaaagttcaaatcaagactattataagtttgcaaaaataaattataaaaaagtttctgaaggacaaatgccaaattattaacaatactaccctttgagaaaagagattgggagtgtgtgaagtctggtggaggcaatgatatatctgatttgaaatgttcacattttaaatgaaaaagtcatctcactatgaaaaatctaaaaattcacaaaactagaataccaggtagaagaggattcatttcttataataagcaatgcttttatcattagaaaaaatgatgaacagcagaaagcgttttagaagtttagaggtcatttatttaatgccttcagtataaatctgagaaatcttacaccatcatcagcaagaattctgtctaatgactcatgactttactggtgtttatcaaaaactgtgtcacccttattaatttagtgtgttttacattccctgtagataacataaagagggggctccatccatatcgtctctaaaagtccaagaaaactaccattaaaaaggcctccctcatgtcacacatacagacacagacacacacacacacacacacacacacacacacacacacgctgaaagttactgatgtgcaacaggggaacaagacggcccaggagactaagatcacagcagtaattgggaaattagacctaataattttaaagactcttttgccaaagtattaaatggctagttttcatacttgcagaaacacctaaagaaagcttcttaaatttatattacactttacagaaggatcaataggaggaaaagtaggttgccatcacaatattcctagaaaggactattaagaagggaggtaaagggaatcccaggagaaaacaacaacaaagatgaaaaaaaaaaaaaaaaaaaaaaaaaaggtaagccaacctataaatggattttttttcctgaccaattaaatgatcgtttaaaaaaaaacaaaggtgcaaacctaggatataagagattgaggggaaaaacatgtatgaaggatatacaaaaagtaaggcacaggctaggcactttacatacatactctcactgaacttctgagcatttctgagaggcaccactatgtcacaaatgaggaaaccgagacacaagagatgttaaacagaacaaaatcacacagctaactggtagtggaatggtgtttaaatcctgactttataggctgagctctaacatgaatactgccattaagatgttagtagctacaaaaaagaaaattgaggaagttgtatgctagttgaaaggcaatgtattttaaaaccaattaaactagtaatacctaactggaaaattgatgtaaaaaataaatgcaactcaggcaatgaagggttatctgtgtaagccatagtttcttaggaggaacagatcagatgaatagttgtctacaatgaaatgaggatggcctctcaatgatagtctgttccagttcaattttaacacatgaagaaatagaggccaggaaggatgaataacacgcttaggaatttacaattagttagatgcagagccagatatttaatctcagtacaatttctaatattgagctgtttccgtatcacatggccttaaactctgacttaatgtttacaagatgaactagaaaaaaattttttttgtagtctacatctatcaaacataatttattcgtactgaaaggtatttttctgatgtgtattttggaaaacaaaaagaatactgcttaaatctttggttctccaggcctctaaaagtggtaacgattattaaagctataactttggctgaaaagcctatctttaatcaatgaatataattaatgtaacttgtattggcaaaggaaatttcaacagaacttgggtgtggggtatacatagctatcaatgacttggaagattgagtttttcctatcccaaagtgtccttgttacatcttatagaatgcttagaagtgaacaactggtattaaaaaagcaatttatgacaagtatcaaagcacacaaaaaaagtaaatttaatttttatggacccctgaaaggtaaaaatggcatttatgatgactaaatgacaacaaaacaagtaaaacattaacaaaaacaacaaacctatgttttaaaactcaatacattttatttcctcaattaacaaaccatgtaaaataatgtaaagcaaaatattacttgtaaataggcagggaaagtttcttcaagcttatttttcctttttcggtatctcttctttattttttcagtgctttcagtaacagaaacagattcatcaactaaagtatctggtaactgctcactccagcctgaaacaacagtcacatttataaatatgtgacatttaaaatttctagacaaacccactgaaggtaattttataccttaccaacatacacacagtttcatataaacaaacaagctttttgaacaaaaaaatctcaaatcaagtttgttacttttaagtgccataaaattttgatttcatgtctacttagtattagcatttttcctattttcttaataatcgattacaaagcaaaaacgtatttatttaaacatattttgttaaagagtaaaataataataataataataataaatacccaaagctcatgagtatgacgaaatggcaacttataaactattaagagaaattctgtgggtgtaacttttttgtagggtgtattgagaatactcaacaaaaaccttaaagaaaaagtgtgtcctttaatacagcaattccaagttcagaaatttattataaattatttgtaggatatacacattgtgaaaacatgacgatgaatatgctaataaatatgcaatgaacacttattcttgaaatcagaaatggaaataaatttggggactatgaaactagcaaagaaacaagaacacagcttaaatttgacaaataaacaatcaaatgatattctcagatgcttcataatggcagggcaaatggcacatcccttctgaaaatcaatatgggcactctaccaccagactacgtaagtgaattgactcttctgaaaactagaaatagacaaacattttttacaacaatctttttaaaggcaccagtaacctagccagaacataaggaatccatgaaaaacaaaaattaagataaataaggaaccacagaagtaagcaaaaaagtaaaagctctccgaaatttgctgaaatccaatgacctcaaactccaattttcagagcattgcgaggaatagggaatagaagacaaagcttaaggcctctctccaaggcagacaggccagaggtgacttgcataaagctcagggtcagtttaataagaaatacaccttcacacaaaccatcacttgccacctcctgctcaccaccaatagcaaaaaaaaaaaacaactcctggctggatgcagtggttcacgcctgtaatcccagccacttgggacgctgacgcacgagaattgcttggactcgggaggtgaaggttgcagtgagctgagacggcaccacagcactccagcctgggtaacagaggaagactgtctcaaaaacaaaattttttttagatatcagctgggctcacatttgtaatcccagcactttgggaggctgaggcaggaggatcgcttgagcacaggagttgcaggccagcctgggcaacaaagtgagaccctgtctttgcaaaaagccaaaaaattagctaggcatggtggtgtgtgcctgtggtctccagctacatcagaggttgaggacaggagaactacctgagctcaggagtgcaaggctgcagtgacccatgattgtgccactgcatgccaacctgggtgacatagtgagacccctagatagatagatagatagatagatagatagatagatagatagatagacagacagatacataaatagataaaaactgaggtgcactgtcacttgagaatttcaaattatatgataagtagctaaggcagtcaaagaaaggctttggagatgaccagaaagtaccttatgtaactaagttattcagtccctaaaccatttatatttaaatatagaaaatatatttaataatttgatacaggaaaaaagagcttgtcaaaaaatctcaaaagaataaagtctattggatttaaaccatttccttataaaacctgattactgtattacagatatgaactctatacgcactcaaatcctttcatcaataaaaggcaataagactcttattgagtaacaataagaggcaataaggctcttattgactgtaacattatttaggatagttttttccaatagaaatatcaagaccaaagggttacattaaaaaaaaaatttttttttaagtcagtactataccatcatctctgcaaggtaactgctcggaaatagagcctgaggaatcttttctgatcacagatcttttggttttcccttgcccagttcgacttctttgccgcaccataaatccaccaatacctatccaaaaaagaaattaggtaaactgataagtaatttctccctacatttccacagtacacaggataaaactgctttatcttgaatagtaagtcattttccaaaattaaatctgtgctaatctaaatcaataacctgatttttaggtaaaatagaagttaaaaacgaccaaaaaaaaaaaaaaaaaaggcaaagccactcttatcacttatcaaacagaatacaaaaagacctgtgtgcacttcctcttctcaacagtatcagtgtaaatatcaaacactaaattacgctggcttatctatttgacaaatattagtgcctcatacatcacataacagtcatgcactgcataatgatgttggtcaacaaagggctgcatgtcaaggcagtggtcccataagattataatggagctgaaaaattcccaccacatacagacatcaccgtagttataacaccgtagcacaattactttatttttttaaatgaatttagcgtaccatacagcctaaatgtgtagtaagctataccatctaggtttgtggaagtgcactctatgatgttcacgcaacgatgaaaatgcctaatgatgtatttctctgaacttaagtgatggatgactgtctgtatattaaccggctaactggtacattagctggaggatagaaggcacaaactacctagatgacacaaatattctttgactgatatgatttcagggggacggtgtctggtactccaaggtatgagggcatttatacatgggacacatagagccctgtgtttaacagcatggaatctggagtcagactatgtaattctgcttactaaatacttctcaatgcctcagttctttcactggttaaaaaagggggtgaggcaaagcagcttctcatacacatgttaaaaggacaaataacataagtgaagtgcttagaatagaggtctggtacacagtcaacactataagcttttgtgaaatgatatcgttgtctagcaatttactccgtgacctaatgggtccctcaattagagggttgacttccatgtgaggcagaggaaaagaaaaaaaaaacggtaaatacaagttcctggaagaaatctgcaatgtctaaaaaagtacacttataagcctcatgatcaggaagaaatgaaatcattttcataaaacaattcagaagcaactaatcttaggtccttattatagatatgacctatttaaaagataggttatcttttaaggtctcatggaatacgaatgaagtaagaaagttcttccttccatatcaaaagggatttagatcactcttaccaataaaatataagcaataagaagcataaagattgtacaaatccaatttaaaacctcattggtaaacaagatattaataaactgcctaaggaaagcctactcaacacgtgtgataagcgggaaaaaaattttttaaataaatacataaaagcctacaacttctgtattgtgacaattttaataattttttccaataaggcaaataaaactgacaagcaagaccgcttttctctccactcctgaggcagataagaaatgagtgtttaatcagtcatggtttttaactggactataaattctaggagccataataactctgtcttattccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcctttaataaaatggttaacatttgggacaaggcattcaataatgattcattgtgaagtattcacacattcaaaataaagaactctagagctaaaaagtcgtattcaaatagtttagttctttaatttatgtgcacatatttttgtttagacagttctgaagcctgaatatttaattttaattgaagtcttcagtattgtatttttctttaattaaccaagtgttgatgatattgaaatgtctacctcaggcactatacctggtctgtatggtttcctttttctctttttgacaccatctgttccttccactcccttagtttcatcatccacagcttcccgctcaggactagattctgattttccatcacaatccataagttctccttctggaaaaaagtaaatgtatacacaaaactggaaaaacctatcaaatatataatccctacataatggggaataaaaagtagggttgttgctgagccattttaattgtacatccctgttggtagggaaagtatgaaaggagatagaagaagccccaaatggttgtagaaattgtgctgcttagtgcagtgttcccatgaaataaaacataatcagagaaggggaacacagaactcagagttctgttaagtgcaatccatttgcacttaacaaattcacttgcttttaattatgtcttcaggtccaggtctctagactagaactctcttctgagcttcaaccacagctataattgaatattacctagttactgaaaactgtatatccaaaatgaactactaatttaaaataaactttctcctttttcccatgttacctatcatcattaaaaggcatggaaatgtaacccggagaagacagaggcctggaagaccacctcaatcattcctaatctctttcctcctacaaccaagacttctcaatacctctgaaatgcattttatcactctctactaccatcttagtccaacctcagatgactcactattaatacaacatgctcctatctagttccccaccttaaagcttacctctctccaatcagttctttaaattactgcataaatgatctttctataaatatgtatccattttctgcttaaaatcctttcatgtcttcccaatgccctcaaaataaactttaaattgcaaggcccattacaacagtctcttgtaaactttccagcttcatctcactcccaccagtgaactacactcagttctttgaatgtatcaagctctttcttccactatcttccccaatttctgccttctacctaacttatctttcaggatttattctaaacttcactgtattaaagaattcctgatatttagaaaagattatgtcaaacagttgtatgctcctatgtattaatgtcatgctttatttttattggttctttaaaatctgtgtccctgctagactatattctccatgagaacaggtacacagattttcttagtaacagatgtattgttagtaggatacctaatacatgttcaataaatacttcactgaatgaggtaaatggaatgcttagagaatgctattttagagaatgctattttaacactatggtaatcaaacttttccaagttatatatgctttacattgtattacaggaaaaagacatgtttatcaaatacattttaaaatcaagttgttaactccttcaatattctcagtattagagataacatatttcagtaatggcatgaacagggtatttgtcttttgttttttattatatttggtctatatttgaggccaattccataacaatctgataatggctatcggcttatgactaagccatgaaaagaaaagtttataggccaggcacggtggctcatgcccataatcccagcactttgggaggctaaagcaggtggatcacttgaggtcaggagttccgtaccagcctgaccaacatggtgagtctctactaaaaatacaaaattatctgggcgtggtggtacacgcctaaaagcccagctattcaggaggctgaggcaggagaattgcttgaacctgggaggcggaggtttcagtgagccgagattgtgccattgcactccagcctgagcagcaagagtgaaattccaactctcaaaaaaaaaaaaaggccaggcacggtggctcacgcctgtaatcccagcactttgggaggccgaggcgggcagatcacgaggtcaggagatcgagaccatcctggctaacacagtgaaaccctgtctctactaaaaaatacaaaaaattagccaggtgaggtggctggtgcctgtagtcccagctacgtgggaggctgaggcaggagcatggcgtgaacctgggaggcagagcttgcagtgagccgaattggcaccactgcactccaccctgggcgacagcgggactccgtctcaaaaaaaaaaaaaaaaaaaatgacagggaattttgagttaagatggcagactaaattcatatgttaaaattacattctcctgaaaccctactaaaaaacacactgaaataatctatttttaaaagataaaatcaagctgtggcatggtggcatgccggtaatcccagctatttgggaggctgaggtgggagaagagaattgcttgagcccagaaggttgaggctacagtgagttatgatcacactactgcattctagcctggacaacagagaaagacccaatctcctttaaaaaaaaaaaaaaaaagacaataggaaaggagaaaaacaacttaacaaaggcaaattctcagttgagagcagaaagaactgaaaaaaagaatccagtttataacactcctcagaaggctgagaaactaggaaaactggccacctttggaaataagtgggagaaaacccaagcaacaagagatttaattatctgcagaagtcatactccctacatctgcttcctaggtttacacactgagaagctgctactctcatttgtgggatgcaggattcctgggtgaccttaaatggaacaatgggatgaagactgaaaataggaccaagaaaatatgggcatactaaatgtggacaaccccatcctgctcccgctgccagaccccacgtttccccactgaattctcagaaagctagcagccagatctctagcctccaagtatgaggtttgaaaagactgcagtggggaacctgagcagttcaagaagaacatctaaagatacggaaaccagagggttcaccaaatggtcagcacaaatcaccccactaaacttacaaatcgacaagcaccaccacatacagaaagctttctaatcaactacttaattccttttttaaaaaataaaaatactatctatccagtctccatctttagttcttcacttttaatcatgcatgtaccataaagattatccgactatggtctataacaagcttgtccaacctgcagccaagatgctttaaatgcagcccaacacaaattcataaactttcataaaacattatgagactttttatgagtttttttttttttaaaaaagctcatcagctatcattagtgtattttatgtgtggcccaagacaatgcttcttccattgtgggccatggaagccagaagatctgcaacacccctgatctgtaacatgaaagacagagacctgagaacataaaagacaatttggaattaacagactaagtaggaagaaaaaaaatcttaaaaaagattaaaatcctctgagggataatataagatacccatgaggcaagaataggatgctacaaaagaaacattcaaagggaggaaagaaagctcttgaaataactgaaatagaaataaaactcagtagaggaagataaaataaggacatgaattggaaagaagcagagaaaaactgagtatgtttcacatctgaaaagcagaattctggaaaaacagagggaattgttatcaataatatagttcaagaacatttcctaccactgaaggatataagacagcagactgaaagagaccactcagtgcctaacaaaacagattttaaaaatcaaaaatagacaaaaacagacgttatcctcatgaaattttagaacactgaggacaaagaatttcccaaaatcttaacagcttccaagaaaacgcaggtcacatagagagaaccgagttcttcatatactagaaactaaaagacagtggatcaattgactaaaattgataaatgaaaatgtatttccaacctggaaaagatgagtcaggtaggaaggtaaaataaagacattttcagaagtatataatgctcaaaacttaccttccacacattctctgtcagggagctatggaatatacgttccacccaaatagagggaaaaaataaagagaaattcatgaaattgcagaaaacacatgtaacacaggagagaacagaagatgatctccaggatgatgaagaggaaatccccaagttaatcatatgtaatggtttgtggccaaggataacactggatctagtacaaaggccacctttcacctgaaacaatgcacacaaggacagtaaaaaccaagagagcacttttattgatgaggttcatagtgacaccagtaagcatacatgttgagacaaatggcataaagtagcacatacagtgccctcacacaggtggtatcactgtaggctaaagtctcttctaaccaacatcttcacaagggccttctgattcccacaggctgaaataaagaaaaagaccgtatcggccaggcacggtggctcatgcctgtaatcccagcaccttgggaggctgaggcgggcggatcacgaggtcaggagatagacaccatcctggctaacacagtgaaaacccgtctctactaaaaatacaaaaaattagccgggcgtggtggcaggtgcctgtagtcccagctactccagaggctgaggcaagagaatggcacgaacctgggaggcagagcttgcagtgagccgagattgcgccactgcactccagcctgggcgacaaagcaagactccatcgaaagaaacgaagaaaagagaagagaagagacgagacgaggacagaaagaaagacagacagaaagaaaagaaaaagaccatatcacccaaatatgagaaattctcccatatatacatacttgtatctagatgactaatctctggaaagctataagaaaacactggttctttccaaggaagggatggtcaaaaggtaggctaacttaacactgttcactctttttaagacctctgtatttcttgtatcatgcacaggtattgcctattcaaaaacaaacctacaacagggaaagactgaaagcttttcttcaatatctgctacaaggcaaggatgcctactcttaacacttatattcaacatagtcctagccagagcaatcacataagaaaaggaaataaaaggcatcagcagaaaaaagcgggtaaaattatccctgtgtgcagatgacatgatcctgtatgtagaaacccccaaaaattccacagttactagaataaatgaattcagtcaagtagcaggatacaaaatcaatatacaaaaatcagatgcatttctttatacaaataatgatctgaaaaaaaaatgaagaaaacatttccatttaaaataacatcaaaaagaataaaacactgaggaacaaatttaatgaaggaagtgaaagctttatatactaaacactataaaatattgacaaaagaaactaaagacacacagccgggcatggtggctcacgcctgtaatcccagcactttgggaggccaaggcgggtagatcacctgaagtcaggagttcaagaccagcctggccaacatggcgaaaccctgtctctactaaaaatacaaaaattggccaggcaggcgtggtggcaggcacctgtaatcccagctacttggggggctgaggcagcagaattgcttgaacccaggaggcggcagaggttgcagtgagcggagatcacaccactgcacttctgcctgggcaacagagcgtgactctgtctcaaaaaacagaaaaaaaactaaagacacaaataaatataacgatatccccatgtttgtagattggaagaatattgttaaaatgtccatactatccaaagtgatctacagattcaatgcaatccctatcaaatttccaaaggcatttttcacaaaaatagaaaacacaattctaaaatttgtattaaatcataaaagaccctgaatagccaaaagaatcttgagaaagaaaaacaaagtagaaggtatcacactacctgatttcaagttatattacaaagtgatagttaacaaaacagtatggtactggcataaaaacagacacatggatcaatggaactgaatacagagcccaaaaataaacccaagcatatattatgagctaatttttgacaagtccaataagatacaatagggaaaagatggtgtcttcaataagtagtggtaagaaaactagatatctatatgcaaaagaatgaaactggacctgatgcctatcttacacatcatacataaaaagcaactcaaaatagattaaatacctaacacctgaaaccataaaactcctagaaggaaatataggagaaaaactccttgatatcctccttgacaatgattttttggatatcacaccaaaagctcaggtagcaaaagcaaaaataagcaagtgggactacatcaagcaaataagcttctgcatagcaataaaaaaaaaaaaaaaacaccggggtgaaaaggtagcacagggattaggggaaaatattggcaaaccacacatctgataaggggttaaaatccaaaacatataaggaactcacacaactcagtagcaaaaaaatcccaaataactggattttaaaataggcaaggacctgaatagccatttttccaaagtcacacaaatggtcaaatggtatatgaaaagatgctcaacatcataatcatgagaaaaatgaaaattaaaaccacaatagatatcatctcatgtctcttagaatgactattatcaaaaaggcaaagacataagtgttggtgaggatgtgtagaaaacgaaacctttgtacatggttgataggaatgtaaattagtatagccattattgaaaacagtatagagtttccttaaaaaaaaaaaaactaccaccataagatccaacaatgcctctgttgggcatatattcaaaggtaataaaatcagcatctgagagagacatctgcactcccatattcatggcgacattactcccaatagccaagatatggaaacaaactaagtgtcctgatggacaatttacttacccattcaaggacagatgaatggataaagaaattgtgacgtgtgtatacacatatattaagtcctcccttaatgtcatcaataggttcttgggaactgagacgttaagctaaatgaacatacagcaggtcctcaagtaacactgtttccttcaatctaattttggcataatgcaaaatgaaaaaaaaatcagttttgtcatacttttttccccctcttaaccacagtttctaagaacttactgatgacaatgaggactttatacaatggaatagttagctttaagaaaggagacactgccatttgtgacaacatggatgaaccgggaggaaagtatactaaataaagtaagccagacacagaaaaatactgtatgatctcacttaataagcagaatggtaggcagcggggtgagaagctgaacgtatagagagtagaatggtggttatcaagggtctggaggtaggggatgggtgggatgggcagaagtaggtcggagggtacaaatctgcagttaggtaagacgagtaattctagagatcaaattaatacacagcatgagaaccacagttaataatattgtaatgaaaatttgctgaaagagattttaggtgtacacacacagagagtaactatggaaggtgaaggatacagacatttgtttgaccatagtaatcatttcactatgtatacaaagcatgttgtatacctcagatatgtgtaataaaaataaatgaaaaaaaaaactgtatcctacctgccaaaaacagttttaaatgcattatgtctttggatttagcaaggaattcacctttgcaggcccacttacatacaacattataaatataccaggtgattcattgtactattcacagtaaaagactgaaagaaagccgagcgcggtggctcacacctgtaatcccagcactttgggaggccgaggcaggcagatcacgagttcaggagattgagaccaacctggctaacatggtgaaaccccgcctctactaaaaatacaaaaaaattagccgggcgtggtggcaggtgcctgtagtcccagctactcgggaggctgaggcaggagaatggcgtgaacccaggaggcggagcttgcagtgagcaaagatcgtgccactgcactccagcctgggcgacacagcaagactctgtctcaaaaaaaaaaaaaaaaaaaaaaaaaaagattgaaagaaacccaaaggtctatcaacaggggaaagaacaggtaagttaaattgcttatatttccatacaaaggaatatttgcagccataaaaaaatgaaggacagtaaatagtagtaagacaaaaggaacaaaatatatatatatacacacacacatacacacacaaaatatatatatatacacacacacacacacacacacacatttccttatacatgcataaaacacatctggaaggttacacaagaaacctctgaggtttctggagatgtaaactgggggcatgaaggcaggggaaagggagagacttcactgtttaccttttaattattttccaattttaaatcatttgaatgtataacttgtctaaaaatcaaattttaaaagttgagggaattaacattacagaaagtaacaaacctcaaggaagcagccaccttcaccagatggatagtctacctcactcttcccactctccagtagttactgaatgccagtcccctccctccattcagtctgccccacctgctggccttctagagcctcagtgcagtcctattcccacacctcccaacacatccatacactgtgatggtcgatctgggaccaccagttgagaggaaatgtgttgtgtttccactcttgagacaaacagagtgttattttattgaggtatgggatttttttcttgcattaacagggtttctagatcccaggaggtgaatgagaaagaagtatgcttttattgcataaggaatttgtttctgatacaccaaagtgatgatgtatgacttttcttaaggaagcggttattagaagagttaaaaataaatagaaacaaaaagtcataggtattgttccaatactccaggaacatcacagtttggattctgtagatgtgtgtaatataatgtgtaatattacattctgacaacctcaagttgaaaactgcacagctgaagatcacttatagtcaataatacttttcaaactttaattttaaattcatcaagtctctccctaatgtattgtactttttaataaaggaaactgtcagatatgctataatacagaggaaaacgtttatatactctttcattataatttttccacaacttccaaaatgaagaaaaagacatggaaacattaagctcatagaataattgtggcagacaattccctcatcctaaaagttcaattaccccaacacaggcataatttcttactaactcaaaaggaactgaattcacatataaagacaagcatgggattctgttgagttctgttggacacaagacacaattgctcaagcactggttgagcacttgtattctaatagctcacggttactgagcactccatgtgtgggaagagccagtgctgggtgcctggcatgcatccttgcacctcatcagcacaactatcctatgggctcatcctggttcacctattttataaatgagaacactagcatcaaagaagttaaaaaatttgcctaaaaacacccagagtaggtttcatcattgcccactactttataatgttttcccaagggtactgagacattatcaaaacacgttagtgaaacagtctaaaacatcacaaattttaggtttaatacaaaatacccagaaaagggcagtgttattagaaatctcagcataatgtaataataagaacttacgatgattgtattctttccctattttttctcctgtacaggcatatgaaataccataaaacttattttaggggtgtgtgtgtacatgtagtttcaggataatatagtaatctaaaacatttttaatatggcaaagtgtggcaatactgaatttttaaaagggatttttatttagcaaacagaaagcaaaaatgttgtccaagtaacatgcacttattttatccctaggaatgtacctttccttctgcaaaggatgtgagatcctggcacgtaaatgaacatgagggactagtcatgaaaatgctgtatattcaattccttaaattctaaaattgtcttagcatttaacatccaacacactaaacaatcttttttcatattcaataaaaataaggacaaattcagtaaattcagatgggctattttatcacgtaaattttaaaaaagcaagggtaatttttcaactgattttcttttaccctgatacgagtcaatgagaaaatatgaaattgaaacatatcaccatttctcagtttacaagtggtagtcacaaggaaaaccttccaaggtcttttgtgttgtttttaaaaggtattataatctcataatttgggaaacaatgtgtactattatcaagaaacctttcatattttgtgaaatggagcacttcccaaatttaagagactatggaaacctttttcagacattttttaacatcctcagaaatggaaattcttgttaaagctgatctgatcaattcctcctaagtatatggactacttctttgcaaactccaactgcccaaatcaaattacctgttcaattgtatctgaaaatcagttacatacaagcatcagaaagtgtttctcccagtaacatagacccaaaacacactacaaaacaaaaattatcaagaacatacaaaagacatatcttttcatttatttatttattttttgagatggagtctcactctgtcaccaggctggagtgcagtggctcgatcttggctcactgcaacctctgcctcctgggttcaagcaatcctctgcctctgcctcccgagtagctgggattacaggtgcctgccaccacacccagctaatttttgtatttttagtagagatgaggttttaccatgttggccaggatggtcttgatcgcctgacctcaggtgatccacccgccttggcctcccaaaatgctgggattacagattataggcatgagccaccgagcccggccacaaatgacataccttttcaaagccacaattacctctcacctggaccattgtttctcactgatctacctgtcataactcttgcacctaatcatctatttatatcataggagagtgttcctcttaaaatataaataagatcatggtgttcttcttttcaggaacattcaatggcctcccattccattgctattaagcacaaactactgacacatcaccttatggttgtgtgagatatactgagccgtccttcttgtcctcacatctctaatcttctcaccttctgactgtcccctctgctcactctgttggtctccacaacactctttcttcaaacatgctcagcacactctcacccagagcctttacatcggcttcctcactgtctgggatgctcttctctcaggtaatcaagtggctcactcactcacctctttaaaatctgtgctcaaatactgctttctgttcatatggaccctaaacacccatctgtacttccaattcctttttttttttttggagacagagtcttgctctgtcacccacgctggagtgcagtggtgcaatctcagctcactgtaacctccgcctcccaggttcaagcaattctcctgccttggcctcccgagtagctgggattacaggtgcatgccactgagcccggctaatttttgtatttttagcagagaatgggtttcaccatgttggccagtctggtctcgaactcctgaccacaagtgatctacctacctcggcctcccaaagtgctgagattacaggcatgagccactgcgcctggccaggcaattcttatcaaactttatttttaccatgggacttgccaaacacattataattaactgattttttttaagagttgggttacctaacattaaaatataaactctatgcagagaattctacctgctttgtacactgatatgatttccaacatctgacatacagtagatattcaataaattctattgtctcaaagccagctgcagtggcgcatgcctatagtacctgctacttgagaggctgaggcagaaggatcacttgagcccaggagttggaaaccagcctgggcaacgtaacaagacactgccccttaaaaaaaaaaaacaaaaaactatgaaataaaatataatcaaacaaataattatcacttcatttctgaatcagttgaaaataaataaccgccccaaaaatgagcaaaccaacagtaatcctctttaactcatattggattttgggttactattaaaatattttgctatctcaagaactcagcaggctgagcagagcagatggtttgagcccaggagttccagaccagtctgggcaacatggcaaaaccccatctctacaaaaaaatacaaaaattagccaggcgtggtggcccgcatccatggtcccagctactcaggaggctgaggtaggagggtcgcatgaacccaggaggcagaggttgtagtaagccaagatcgtgtcactgcactctaacctgggcaacagagcaagaccctgtctcccaactgaaaaaaaaaaaaagaattcagctagaaaaaccttatatttactttgatcaagaaaatgtttataaaccaatactttatgatgcacactggtgaatatgaagttatacctgaagtaacattaaatgacagcttttccatttctagaatgtatgcatcaactaccttaactgaaacatggtattatccaagctcacagtatctgagaaggtttgtgtcgttatctagcaaactaaagtcaagccctctgtagttccccacctgtgatcttcaaagatatggtgctccttgagatttctgtaaggtaggtctgttctaaaatgtgtgaaaggaagagaacctgaaaaggcaaggtctaagaagatcactcatttggaaatggcaagggtcagtcacatcaggggttaactaagtcagtgtgatttaccctttggtaaatcatacacatatttcaaaagttactttatatgctttaattcttgcacacatatttcatggaaaataaattagtattacctcgactatcatccatttcaccatcccttgaatgctctgattggatgtctggaggggtctgaaggacggccacgctattctgatttataatcttcaatttcaattttggttttgaccgttttcttcttggaactgtaactgtgaggctctgtaactgagtcatccctgattcagtcaaacacacaccatcctgggtataagtcttgggtgggtctaaaattacaaaatcccaaggatacaaatttaaactttcatttcaaatttgactgattactgttccaaaatacccatgtcaagggaatgtgactgtagttctagaaagcaattacgtatctatgaaatgcatgaataattaacttcatgatacccaataaaaactatgaacaataggtcaaatttccttggattacaggcagaaaggttgcatgtttttaaaaaatggtcttcctgggccaggtgcaggggctcatgcctgtaatcccagcactttggggggccgaggcggcaggcagatcacgaggtcatgagatcgagaccatgctggctaacacagtgaaaccctgtctcttctaaaaatacaacaaattagccaggcgtggtggcgggcacctgtaatcccagctatgcgggaggctgaggcaggagaatcgcttgaacccgggaggcagaggttgcagtgagccgagatcgtgccactgcactccagcctgggcgacagggcgagactctgtctcaaaaaagtcttcctggaatttctattttcatgtcccaataaaaagagttagaagcactgcaactaaatgcaatgctcagctaatccactatgagcttcttcgtagaaaagatcaaaaggcagggatctatttacgtaagagaagagagaatactccagaagctcatctggaaaaatcagagtatcaacataattactaatagggagaagtaataaataagtacaaatcctgcagatttaattttaaatgtacaaaactgttgttccttagaacaattcctgtactatccaaacatttttgtatcaggtgctattaaatacaaatattcaaaagaatgactgtttaataagaatatcatatgaatcaccatactaggcttattaattattttaaaaattaagagattgaattaattctaaaagaaatctgttcgctaactaggccgtgttttctgctaactgataattaagcacagtaatatatcaatgaaactaaagcaagtatggcattaatggttattctaagagctgttatttttgttgcctacttgctgaaatttataggaatactgccccagtaaagctggatgacattttatatatcattgtggaaatgattaccaacattacagaatttggatagaacacccatatgattgaagcaggtttgacaagtggtaagccaattatgtaaaaattaagcaaagtaaattaattaaatcaagtaaagcatttcaaattttacctagctcttttacttttgtgacaatttgtgctacaagtgaagattcacagcagtctgaggaaggcactgaaacgaaaaaaaaaaatccaggtaattcttttcagaaaaggtaaagtgtatttaaatacttatatatgattataatttctgtttctatactcattttattaaaataaatgtttgaacactaaagttaaaagtgctttttaaagcaacaacaaaacaagaagtgatgaaggaaatactcaagtcatggaggaaaacctggctaagaaacaatcaacatattggattctgacatattgtcaataactacaagatcatgttccttggaagcaaaattatagtttacatctaaagtatatgctttttattgtttcatgtaaattgttttataacaagttgtgataagtcatgtataaccaaaaataatatttttcataaaatacttgtcaaagtaagtttcacaaagacaaaatagagtagagctaagctaattcattggttatggacagtaaggtgcaagtgagtggtacaagagtgcagactcacagtttaaattattctcttaccattagacgcaggcatatagggtctgcacatgctacaatcaaaaccaatgtctgctacattttccacttcttcctcagtatttaagttctgacaaactgcatgcatccatctaaaaagaccatatttgtacattttttttaaaaaatggaatatactgagaactgctaccttttaaaacctgtaacactgagtcttcaaacttaaaagccctaagcctcacatgctcctcctaccttgcccttttctcctaactatctctattaacagaaaaactttcatacagctaagaaggaaataaaaaggaatgagaacaactattagagaggaagcaaagcacattacataaggaagctaattattttatcatcatatattaaatatttcaaagacagaaaggaagctagttagggcaaacacaaaggtattcagaaaactgcaaatggcagtgctagcaggtatgtgctccaggtaatgcatctaacttgaagtagacatatctcacggaaagcgatgttgaatggtaatcgggaaattaagtaaaaagttgtcttgcaatggaacaaataattagtagccagagtcccaagaatactgtactactgataaaataatactattaataatatatgttcacttcttaacttctaaagagtacaacaatataccaatgaaagcaaggaaacattcttgattatgaaattccacataattacgtagggagggcagaaggtgctatctaatatctagatatctagtatctagagctttaagaaaaagtggtttaaggagaacagaatgtgttagatattttttataatctattagaagattcagaaacccttcataagaaacggcatagatgaaggcaataattctccatctaatttcaagggattcctaaaccctcaaaaaggcctaaattaaaaatctttagtcttgggcgggcacagtggctcacacctataatcataaaactttaggaggctgaggcgggcggtcaaaagatggtcaaaagatggagaccatcctggccaacatggtgaaaccctgtctctactaaaaatacaaaaattagctgggcgtggtggcatgcacctgtagtcccagatactcgggaggctgaggcaggagaatcgcttgaacccaggaggcggaggtggaggttgcagtgagccaagatagcgccactgcactccagcctggtgacagagcaagactctgtctctaaatttaaaaacaaaacaaaacaaaattttagtccggagttgagaattcaaaacaggaaatcgcttctgtaagtttctaggtgactaaaaatctacaaggcaaaaagttctgtacctaaaacttgtgattaaggaaaagctattttccatttgtttttttttttgctacatttcaaagagaaaagctttaaaaagatgaaaaaatagcacaatacctatcacattgtctacattgcagaataagatcttcttctctatagtttcgatagcagactggacaggaagataagcttgcacaaggagcgcactgtgtgtaattgttctgccattcacatcttagacctgcagatgttgctccacagtgtctgcaccaaacacacctgaaatccaaatccccccgaaaagtctcaattttattttcttagttactcagttactgtaattcaggaagctacatacgaacataatgggggaaatgatttaatgtgtatgtgaaaatttttctgattactggtatctatcatagaatatgtgtattattcaattaaataggtgtggctaatttttaaaaaccaaagtggtatgagaaagctctgaacttgaaagactaacaaggcaaacaaaccctagagtaccatttgcacttccagcctcctttgggaactgtctgcaatggagggtctaggcagtaggtgtgataacttatgtcacagtcatcacacagcaggagtcttcctgggtcagttgccttcccacaggcctcacacacagtgcactcaagacacctccaacctttgctaagaaccactttagtgatctgtaaaagaaacaaccaatccatgtgatttatgcattaacctaacataatcaaatatactatataaattaatatggtgcttatgtacctagaagcagaaaagaggcaatcaactaacatttattgagcacctacggaggcccaatactgggttgggcatgttcatacacgcttttagaagcctactgagcagaataatagaaaatggcacatattttaacgcctttttaaagtccacataattaccttatgctgtacatttaatgtccactatatttatagatatagtgaccagattttaaagaaatcaagtaagcttccctattattgatacataatttgaaaatacatcaacaaaatctccatctacatttccatgcttagaatcaatagaaaaaataccaaaaaaattaatgtaaggcatgagttcttagggacattttatgatcttagaggatttctatttagactatgaagctaggaattctgaagttcacattcactcctctgtttattctcccctctctcaagggtataagttagtagaatatttgggaatctccaaatccctaataaactcctgaaggaagccacaccatgtaatattaagattgtggaacttcttaaagatctcaaaagactaggatcctcagacagaaccaatcaagtgcccacattataataaaacagcaagtaatgagggtacagaataaaaattcagatcatgaggtacatgaaagcctaaaagctaccagagaagaaaataaaagagttaaattcaaaggaacacccatcagaatggcaccaaacttcccaactccagatgctagaagagtataagtttccaattctacaggaaaatacttttcaaagtacaattctcaacctagctacacaagcaactatgtgtgaagacagaacacgttgtagacacaggaagactcaaaattcagctccctcattctcctttctaataaagttacttagagatatgcggaacagaatgaggatgtattataaagaataggaagacttgggatctataaatcaacagatccaacaaaggacatcaggccaggaagtttaaggatgagaacaacatacctagaagccactggcacatatcagagcaggagaagggaatgtctagaaggagggtaggacttctcccagaaaaaaacagtactttaaaaactaatcttatatgatagttctagagtaggcaaaaacaaagaacgaatggagagtcactattactttcttgttataaaaaactccatgaaagacaaaagaaactcatagtatactgtttagacctgcagtgaacatttactgagtcataaccaacaccttattaattgaactaaacatagtaatacaactatattgggagaaggatggaggtgtattttaagacctaaatcagaatttatttattcatagcagaaagtcaacaaaatctagcattgataaagcagtaaaccagttgattatttagagctatagcattaaccacaagaaaaaaagacctgaaaagattaaaagcgactgcctcagacgtggaggtagagtaagacaagagttggttgttcattacaaggccttttttttttttttttttttttttttgagatggagtcttgctctgctctgttgcctaggctggagtgcagtggtgtgatctcagctcactaaaacctccgcctcccatgttcaaataattctcctggctcagcctcctgagtaactaggactacaggaatgagccaccacacccagctaatttttgtacttttagtagagatggggttttactgtgttggccagactggcttgaactcctgccctcaagtgatccacctgcctcggcctcccaaagtgctgggatgacaggtgtgaggcaccacacccagcccattacaaggcttttaatgtcatttgatttttaaacatgtatatttattattttgattagcttattgatttttaagaatttgtcttagattaccaagttaatgtattatttgcccaaatgaaggaaatggcctaggggtaagatcagggtggcttatggcagtagccagcaaacatttccaataaagggccagagagtaaacagaaagttttgagggccatatgatctgttgcaactttataaaaactctgccagtgtaatgcaaaaaccgctacaaatatatgtaaacaaaagaacatggccatatttcaataaaagtttatttgcaaacacaggaaatgggccagatttagtctatgggccagtctgcgtgaccctggcttaaacaatgacctgaagataaagtggcagacagatctgaggtgttcagtggcagaattttaaaaatatttatcttcattcctactaagttttcttcacagatacctgtggtcccttttataaccaaactctcaagtttctcagcttatattcactcttcaaaacactacagtctggtctctacacccacatccactcataactgcttaagccaggcttgtcaagaccttcttattctcaaatctaatggaaacattagtgtttgtgtttcttgacttctagtacttcaacacttcaacaatttctccctctttgaaatttccttttaacctaggtactggggttgtactatcatttttttcttccgttgaaccagtctagccttagttttaaaagttttttcaaataagatgtcatccaggattccatccatggtaccatgtccaaagttgttacagatatgttttataatctaatacggatacacgcttcaactataatggagtaggtgggaccagcctgttctcccataagatagtagaaaatgggacaaagtgtatgatacaactgttttcagatattggacaacacatagtacaggagacagtggtctctgagaggaaggaaacactcagggagtcctatgatattctgcctagaaacattttccagaatgctgcccagggagggagaacctcagcagagtacaatcaatggcctcgctgaggttagggaaggcaaggcagtggaatttgcaggacacagtactcaaaatgaagaagcaataacgactaagagctccagaaatctacaaaggatcccctgaagtctttggtggaacaccaagccgtacttctagaagcccaaagacccacaaccaggggaaagtacatctactgggaatttgtaagctgcacaattaccacagcttgcaaaaggctcaaagacaagtgaagcacaaccagtcagagtacaaagacactggtgaacagggagcagaattcagtagtgatcccagaaaggccaagtcttaagtatagggttaaattaatgctaggaccgcagctaccaaaatgtggtctagggaaccccagtgagtctgtaaagttaaaacaagtttaaataatactaagatttaatttgccttttttcactttaattcattcacaattatacagtggtgtttatagaggctacatgttgtatcataatattacattgatattgtacaggttgtgcttctgtagtcttgtgttataaaatgttcctagttttaatttctaaaatgctgaacagtccatagttaaaatcctcataaacaaaaactatggagtccccagtaattttaaagagtgttaaggttctaaaaccataaagtttgaaaatatccaccttagagtgaagactttctagacttgccccagcaagcttaaaaagaagcttcaaaggtatcaaacttatccacaaacaattgcctcctacaataaaaatgcaagctgagccaattcacatatccctagtatatttctagatactgctgtatttctcaatgagactgcagtattctatactgtccaaaacagtgtcatcgtgcaaaaggaaccatacataatttttaaaaacaggaattcaaattctagctctaccagtaactatgtgtttgatagtgcactaattgtccaatcttaacttatgtaagtcgtactcatctgtaaaatgggaattcggtaattgttggatgggttaaaagaaatacattactatcttgaaagggatcttattcaatttccttaggtccaaaacattaagtattctaaaaaacaaaatctaatgatagcagcaacttttatacagaatataaagtacaaagaagaaaagaaacatgttttatgcatatataactctattttttaattggctttatatactctgtgtttttcagtcacataccatgagcaactaattttaaaagactacataaattaaccgtactagtcttctattttggatagtattaattacaatctttcattttgattcctaaactcacaaaaacctgtattaccctataaaataaatactagtgtagttatcaacaaagaattctgaaggagataatgttgatttgcttactatactgacattttactgacaatgatataatacagtgatgtttgaagggcaggggagaaaggtataaaaatcactcatggttcacaacctgttactgaaactgaggttagtatttatattacatggtatggcagtactagaaaagatttccttgtggagtatacagtttaagacctctgctgtacagctatacctccatgcttgcttccagtggccatgacactttattcaaatatgtaagttttattaagactgagttcttaaaaagaaaaaaccaagaaccttagatacaactagtgaagtattgagacctgtccatatttaaaaccaagcacacgataccacttaaaaggttccccagaaagcctctatcctgaaatgcttcaaagtgagcagcgctgactctcgattattaccaattgcattaaatatgacacttgttttgtttcttttggctataaggagaaaatgtcattttgtatacgagtgagcatagaggagagagaatgcgggaaagaacagaatgggctaataattttttactaaatattccagttctcagctttttaaatcagcagacaaaatgaattagctaaacctaaaatctttgtgaatactataaattgtcttttaaattaaatgcatatatttttatgttttactttttcaagacaagtatattgtacaatataagatttatagaggagcaaatttcttgagataggaaacccttaaaagcagtattttaagtatttaaatactgtcacatatgtttaataatcataatacttaattgtgagaactgggagctcatgttactactaaaaccaaataaaaattcaatacatatttgttaactcaatttaaggatgtttaccttaatactgacacagtatggatggtaacactgaccacactgagaacaggcaagtaatcttccttctgctccttggccaaaactgccacaaactacacacatatcctgaagttaagaaaacagaacatattttaaatggagactaagctaaaaacctacaaattttactttaaaaataccttcttaactaatatagctctatagctaaatattgaatgacttctgtgtatatgagataaagcagaaatgtgcaaggaggaattcaatgaggaagacagtaaattgtcaagttcaaacctgattcaaagtgaacttgtcactgctagaaaacaacacaactgtattgtgcatagagttttcttcatcatccttatttgatgaaatatctgcagtagacacctataaaaagcaaaatacacagaatacgaagttatatttttcacttgttttacacttaactggaaagcttcagaaaattcataatcaaaacatatattttggctaaggtctagaataacaattccaaatattaatgctaagatactaccgtaaaatggagtcgtgacattttattattcacctaattctctctttagaggtagaattcctatagaccaagaagtaatgagaaaatataataaacctgtcttagtaagacttgattatgcagaattctaatcaggaaactataaatgataatatatgtatgtacccacacaaatctatcactattttaatgacacacacttgggatctgcaatgtagctagtctgaactgagatgtcctgcaaacataaaatacagcacataattacatattacgtgttgaaatggtaatattttagatatatcggtcgaaatggaaggcattaaaattaatttcgcctgttcactataatctttattttgttttgagaggagtttcactcttgttgcccaggctggagtgtaatggcgcgatctcggctcgttgcaacctctgcctcctggttcaagctgttctcctgcctcagcctcccaggtagctgggattacagttgtccaccgccatgcccagctaatttctgtatttttagtagagacggggtttcaccatattggtcaggctggtctctaactcctgaccgcaaatgatccactgcacccagctcactgtaactttttaatgtggttactaggaagttttaaattgcatatgtggttctcattatatttctattagcactgctttagaatattattttgaataacatcaaaatttcagtattagccatatgattatcaaccaatattgctcagtctggacttagttctatttgactaaatcaactaagtacccactggtttgttaataatttctagagtgattatgaaacaaaacaaagctctgaactagaagctgtagaagaagacaaggagggcattgccaaaatcataaaatacaatcctctttctttaaaaagcttacaacctaagcctggaaagacagagttgaaacacaacaggttatgttcaaggtcaaaacataaaacaactgaattacttttcttgaggaacaactgaaagaagattaaccagctgggtgtggtggctcatgcctataatcttagcactttgggaggctaaagtgggtggatcgcttgagctcaggagttcgagaccagcctgggcaacacggtgaaatcctgtctctaccaaaaatacaaaaaacagccaagcgtggtggcacacgcctgtagtctcagctactcaggaggctgaggcaggagaatcacttgaacccaggaggcagaggttacagtgagccaagattacgccactgcactccagcctgggtgacagagcgagaccctgtctcaaaaaaaaaaaagaaggaaggaagtttggttggttaactaaacagaaggactacatctcagtatttttcaatacaaatacatttaaaagcagtttttttgtttgtttgtttgtttttgagacagagtctcactatgtcgcccaggctggagtgcagtggtgcagtctcggctcagtgcaagctctgtctcccaggttcacggcattctcctgcctcagcctcccgagtagctgggactacaggtgcctgccaccatgcctggctaattttttgtatttttagtagagatgaggtttcaccatgttagccaggatggtctcgatctcctgacctcatgatctgcccacctcagcctcccaaagtgctgggattacaggcatgagccaccgcacccagcctaaaggcagttttaatggatagtactaatgctttataagagcaatttatagtcatatgaaccctaatgactacaagtgttaataatgccaatattcatcattagggagtaagtaaagcaatgacaaatccaaacattagaaaattacgcaacattttaaaagtagggaggtagaaacttgtatagactgccatgaaagaaattatcaaaagacgttgttgagtgaaaaaataaattgcagaacagtatttgaggtatagcactataatataaaaacatgcaaagtcattatatgtagtctatgggcatatataataggttgaatcataagaaattgctgcttttcatcagttcagaaataatattggcaatttcatatggatcaacctaatatataaatataccaaactgataacagggaaataagaaggactgaggagttagtaatggtaaattctgatctacctataatgctttaattttttttaatagagaaaatgtattgatgtgttacatgcatagtattaacaaaatcagctttctaagattttagagaatcatccaagatgattcacaaaagtagaatcatcatcatcagtaagaaattaagtgactactaaaagtaatcattaattcagtcatagaactaatgatgcattgacaagactattgagatatataattatggaaatggctaaaatagagataaagtatctatttctacctcccaaccactaacagaaaattcaacacattatacccactgagcagctcaaagaaattgtaaagatccattattatttttaaaaggaaatttaaccagtgaacgctttcactgaaaatgataaacaatatattcccagtataaaccagaaacaaagtctgcagtagaaaactacaatgtccctagattcaagtgggggtggggagtcatactgtcatatttaaataataagtgcagaaaaaccaaaatattttaaaataattgtccatgcaagaaagaaaatagtatcatctagcttgaagacccactgtttttattttataatttatttcatgaccgttagactgctagaaaaataaaacctaccttgagggcaaaggtaatctttgagaaaatacgtgctattgttgcctgcatagataatagtgtgatttatccagaaggtgatagaaatttcattttcctagaccacagatatgagccaaggagaatagaaagttctgacctaaacttcacaagtgtcccttccaagcagggacacgtaagagtaaacaaaaaaagaagatcaaattaaactcaaagtgagaagataggaaaaaataaagatgataataaaaatcaataaaacagaaaggggaaagaaaatagacaaaagtccatgaaaacaaaggctgactcaagaaggtcaataagattgataaatctctagccagactgatcaggaaaaaaataagacaagatgcaaattattagtatcaagaatgaggaaggtgaaatcattacagattctacaggtattaaaataataagaaacattatgatcaactccattcctttaatttgtcaagatagacaaaatgaacaaatttcttgaaagatgcaaatttatgcaaggagagacagataacctaaataggtacctattaaagaaataaaatttgttgttaaaaactgtcccacaggctgggcactggtggctcatcccgtaatcccagcactttgggagacggatcatctgaggccaggagttcgagaccagcctggccaacatggcaaaaccccatctgtacccaaaacacaaaaattagccaggcatgttggtgcgcgccagtaatcccagctactcagaaggctgaggcaggagaattgcttgaacctgggaggtggaggctgtagtgagcagagatcacgccactgcactccagcctgggcatggtggctcacgcctgtaattccaacactttgggaggccgaggcaggtggatcaggagttcgagaccagcctggccaacatggtgaaaaactgtctctactaaaaatacaaaaaaaaattagccaggcgtggtggcaggcacctgtaatcccagctacccagggggctgaggcaggggaaatcacttgaacctgggaggcagtggttgcatgagctgagattgtgccattgcactccagcctaggcaacaagagcgaaactctatctcaaaagaaagaagaaaaaaaaaaggaaaacacaacaaaaaccccccacaaagaaaatttcaggccaagatggtttcactaataaattaacgtataatataagaagatacatttccactactacacaacttttccagaaaactgaagaggagaatatacttcctgattcattctatgaagctgtagttatgctgataccaaaaccagacgaagacattacaagaatgtaagactacaggctggggcatggtgactcacgcctgtaatcccagcactttgggaagccaaggtgggaaaactgcttgagctcagaagtttgagaccagcctggacaacatagtgagatgctgtctctatcaaaaattttaaaaaaggagttgggtgtggtggcacacacctatgggcccagctacttgggagacggaggtgggaggtcgaagctagagttagctatgatcgcaccactgcactccagccaggaattagaatgataacctgtctcagaaaaaaaaagaagaaaaaaaagtgcacaggtctacaaccatggtgcatccacagttttattaatactcagcaagaaaagggagtacactgttaacaaatgcaacagcacagatgaatctccaaataattgtgctgaaataaatcagtccaaaaagtgtacagttctgtatgattccacttatatacaactctagaaaatgcaaactaatcttggggacaaggacggatggcagggggaatgcagaaaattacagaggggcatgaagaagctttgggagatgaatatattcactatcatgattgtggtatcgttttcaagggtgtatatatatatatatatcaaagcttatggaattgtacatgtcaaatatagcttatatcaactgtacctcaataagcctggttttaaaatttttctttttgaaaaaaggacaagaatctaagcttccttattcctggtttagtagtaaacttgaacaatttcacctgtctcctatacttaaaatgacatttcagaattttaaaaacagaattttaataaaatagcgaagttattacataaaatatttgctagttagcaaatatatttgcaatacacatataaataaagcctcataacatgatagtaagcaaatatctatcaatcttaaaattttttaaataaaagagcaactatattacatactgactttttagagagggttggcatagaaagataaggagtcaaagaggaaggtaagaaaagagaaaggatgagaaagtaaatatacaagaaaacataaccagaggctcaaaaaaaaaagcaaagtaggacagtaaaataaacattttgacctatttatatgactcttaagatcaaaataacttgctatgagattttcatcattaactgacatttagattagagaaaatatacatgaagcaagcctcaccccaggtaatacaacagctccgattccacttttcagctttgacctgcctcggccacctcgccccgacagtcctgcacctcgaggtctccgctttcctggaaatccagacccacggccctatgtaacagattgggaaaagtcaacattctgtgacagaccaaaataatttttaaatccaaatgccactgagataaaacattttattaaatgttacacaaacacttccttagataagtattaagagacctggcttattatttttatctttaaacgtatactccacaacttaaaaatctaaatataaaatgcttacaaccttagaatcataccttaggcctgtcactgtgaatgctatcagcaagcctttgcatgatttttctctttcccactcctacattcttggtgacgacaacaactatagcctgatccagatatttcgaagtgcaacaaattgtattcaatatagagtaagtataaggaagaactctctcattaactggtctcgcggtgattacaataatagctaacatctattgagtacttactatgtactaatctaagtattttttactctcaacaatcccatatagtaggttttattatccccatttgagatgagtgtgctgaggaataaaaaggttaagtaacttgtccaaggtcacttagctagcaagtctggctgcagcgtcccggggttggaagcatattctgtactgctacatcagcgtgaaagttcatttttgctagtgttgtgtaacagtattcttcctctcattaaaattaagtcagtttccttcactattcaacagttctcttatgaactcaacatttctacctcattcaccattgtatttagaggaaaatttatcattattgttattacttttatttttgagacaagaacttgctccgtcactcaggttggagtgcagtggtgtgatcatagctcactgcagcctagaactcttgggctcaagtgatcctcctgcttctgcctcccaaagtgccaggattacaggagtaagccaaagcgtccagccaggaaaaattatttgaggattataggaaagctgacaaaaggctttgtgaaagctttgctttaaataatctgaataataaatacttgaaatggaaataatttatctgacttcttacacaagaaataaacctatgggaaaatgtgttaaattccctgataatttcagacattaagtaccagagtatggtgttccctgccccctcacccttgtttgtactaattaattactccttgaaaaaacctggcacctccctaagtagatgaattatgtatatttaaaattatccagatgctcaggaaaatacttagatgtttccctcacagttaagttaaataatatgtcatatcttcaactgatgtcccttatcatagtttgaaatgaacttattccctatttagcagaatggtttccaagtcaaaaatttatggtgatactgtaagcataaaatagatacacatgaacaaaaggaacgggaggaatggcttttttccctttggatgtaacaaatacagccagctcccagtttcaaactgccactcctgtcttctcttaccctgctctccttgagatcccttttgagaagtgcatcagcttctttgcacaacagatggatggcgtcaggttagttttttgggggttttttttgtttgtttatttttgagatggagtctcgcttctttgcccaggctggagtgcaatggtgcgatcttggctcactgcaacctccgtctcctgggttccagcaattctcctgcctcagcctccctagcagctgggattacaggcacatgccaccacacccggctaaatttctttgtatttttagtagagacagggtttcaccatgttggccaggttggcctcgaactcctgacctcaagtgatctgccccctcagcctcccaaagtgctgggattacaggcatgagccactgcgcccggccgagtttgttttgtttttaaattggtataaaagatttttgaaaaattaagttagtgattaaaaatcgagactacagtaatctctcaatttattttctcgaacatgaaatgctgacccagaaaaaaagtaagtgaaaattggtggtctatattatcaaactgtcaaatgaggtatatttatacctcaatatcttggatgatatcagggggaggtagggaggttaaaaaacaatagttcttccagtcatgaaagaaaataaagtataatctagaattccttaaaatccttgattagtctaaattaaacagccatattccagaatattaaatatagaatatgaagaaaaactgtcatctccagtcaatgaagtattttaacttttgagttaatactttttcaaattaatttttttctcttcaaaatgcatcacactacttaactcacttcaaggactggcagagccatcaaccaatgtcatgggggaaaaagccttgtcattttaaggtattaaccagacaatgaaatatgccacaattttggtatttcttctccatgagaacataataaattaatggagctttttcttttgcttttttctaagcaacaaggttttatgatatcatgaatgaaaaggtccttaattaccttttggtctacatgtcaaggacttctccctcataaaaacagtagtaatcacaacaaaaggaattaaccataaaaagaggtattaaaaatgtatacttgatttttaaatgcaagcatattatttctttacattaaaatttttagatttaaaaagtgtttcttggaagctcaatctagaaaagaaagatttaattcttaacatccagtagggcaaaacaaatcagacagaaatgatatatgaatgtaaatgcaattttatttaccactttgatgctccaaatggcactgccaggaagctgcctgggtttaaaaatttcccgaccttctgaaatgtctggggaccaggaaggtgggctcactgtattatgggtactccaagccccctaggatatggcagttgagaaaatagatgtgtaaaactcagcaacataaaaggtcaaagccagcaactaaggaattttagaacagcaaaaacaaatgcaaacgtatggaaatttaggacaaattgcttcaaggaaggcaaaataagttaatcactaacagtgatttaaacatttaagtataacttaaatgtttgctgctacaatttacattaaatattttattctgcctgagacatcactacaatgaaacattaaaaattaaggtttataggacatcaacattgactcatgaactgcaattactgcaccaaaaagtaaataaaagtcaatcacactttaagaattaacactagaagaaagtattggggggttatttttcttctaacaactatcactctacttaaaaggagaaatggataaccataaggaattctatattctatagctataaacaaccaaaaccagtaggccaaagaatgcaaggagaaacataagcaatcgataaatgcatacacgttaaactgtagagagctggtaacattaaaatgcaaataccattataatctaagcatttaatcactctttcttcagtgaccattagttgtcggtttggttttggtttttacttagggaaatgaatactttatggaaattacatccaatggacaaaagtgaagaaacgttaaagcaaattgtcctaaatttgcaaattaaaatgcctaaagtacctgataaattatatagaaagtagtatcttattaaaatctatataactaaaactaaagcattttacttccaaacaaccacattcagcaataccctgaactaatctgatgaagatgctaaacagcataaagaaaaatgtttactccacaaagataacattttaaagaaaaacaagacaaatgtcaaacaataaaagaatatattttgaattaggtaattcaatggtgcatgctataattttaccaattaagtaaccaaaacttaagacaaggtacatagtacttaccaggtttctagaatatcatcaaattaaaaagtactatctcattaatcacataaaaataccaccaggaattaaaataaccagaaataagaatgtgactactcttggggtaagagataggtaatggaataacagtattttgagaaaagccacacaagcaatagactggtttcatttttaagtcacaaactgaatccacacacattgaagtccagcaatccaactcattctctccagcaaacactttatttttttccctccaggattaccgttaggtgttctttcttacccatcaaatctctaacctagctcaggtaatcactatgctgatttcactgagcagcaaccactgcaggtcaattacctcactttcataatttccaatcaacttgaatctgtacctatgtcttcttccctactattagtaaggaagtgttgtcaaaagccatttctcttttctcattttactcatgctcctgacatctggcatactgttctgctggatttggcagcagtccacctgtggatatttcactgccttcctcgctaatctttcttcatctcctgtacgtgttcttcctctatttgacttccaaagccctggagtttcccagggcttgagcctagatcctaaatggtattatctacaatgagggcatcttggaagttgatgcttcccatattcttatttctagttttaatcaaagatctccaaattagcaggattttcaacttccttcttagcatttccattttctcacacaaaacccctcttaagtttgccatgtttaaaatttctcccttaaccggtttcatcccagtcttccccatccttataaatggcatccagtcccttgtcactctcctttgctccttcagtcctctcccccaacacttcatcaatgcaaatcatcagcaaattcaagactttttatcttcaagttttgtctccaatccttctacttcttgtcacttccaccactagcagctcagtcgtggccaccaccatctctcacctaacctgctacaagagtctactgctggttatgcttctccgaccctgcatctactgaagcctttccccacagcagccagagaaacttttcaaaagtacaaatgtgatcaagcaagtcactattctatttcaaaccttcaattgcttctcagagcacttaaaagacaaacctttcccaatgcctttctccaactaaccttgtggcatttgtctccccgctgctacgctccagctattctggcttccttgctgtccttcaaacatgccaagctctttatcaatcagagcccgactgactcagaacacttcactatatcattccagcccctcaataaatgtctggcattttctttctttctttctttttgagatggagtctcgctctgtcacccaggctagagtgcggtggtgcgatctcggctcacagcaacctctacctcccaggttcaagcgattctcctgcctcaagtctcctgagtagctgggattacaggcatgcgccaccaggcccagctaatttttgtattttaggagcgataccatgttggtcaggctggtctcaaacacctgaccttgtgatccaccagccttggcatcccaaagtgctgggattacagacgtgagccaccacggccagccatgtctggcgttttctaacccttcaggtatggccttacatattttctcaacagcagacctttccttagtgctcccggtgaaccatcatctctcttaccacaccattagtgcctctcattgcatcaccacctaggacgttttattgtttgtaattttatttagtggtaggcagtgggggcaaaagatacctaaattacttctctcaatatttccattggtttttctctgagatttggctaacatacatcttaaattccttttagtcgatagtttaatattatgttggcagtagacagttctcaaaaatatgagacagaaagtcgtactctaagataaaaataatgttgaataattttatttcagaagtaagaattttctggtaattatgtattattcatcataatttaaaagttagctttgatgccaaaattttatctcacttcaaaaagaagacagactttgtgtaattttatagttctgaagaaaaattatcattatacttagatattctgacaaattatctagtatattccttagaccttaaaactaaaatatagctataattaccaaagtttaaattatccttcagatcttagctttgatcaagaacttacacaaaccactcagaaaaggttagctgcccctgtaatgtatgggctcttcccctacaatccagttgcagcactttttacactgtaattaaagatcatgcccctttctgttcactgctatgttaagcaccctgttcagcacttattgaactttttttctgctgagcatctattatctttttttgcatatgtgtatgaattcatcaataaacaatgaactatgatatgaaacacactaatgcctccaccagtaataacctagaatcttgaatttcttcacttaaaaaaagttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaacccaagaaaaataatttaacccaaaaacagtttaatattagcattaagtttctttctgttttgaggccaatttctcaggtaaactgtccaagctagtaagttatacaaggactgtgggatggggaaatgagaacaataatgacacgtggaggataggctatttagaagcaactttctattaaaagtcaaattctattgctggttgttaaatatgatcaaagtcactcttacagcccaagagtactatcagttttaaaagcagccagagaaggtttggtgtctcactggcaaactttacacctccaaatcctaaatcaaccccagccccacactcttccaacatactatgtaaaaccaaggttgcttataaacagtaagtctaatttaggaaaagtgaaagcaatgaagagagagagccgaaaggaagataactggtaaaagaaacaaaagagtttacagtttgtctttttggtaaatataatcacttgtatacagtggagctacagcagcaaacacttcactatttagggaattcttaaaagaagtctcatatataaaattgagttcgatatcaagtagaacaagaaattagacctaatcctgttttgataactacagaaacagctattatcagctttagccttcaataatttcacaatacaaattaggtggcactagcaacagtaatatctccaaaaataccacaacaagcacaagtgaactaaaaggaaagtctggtacttctaatcggctgtgttgttagcttggtgttccaaaggggtaggtattttttaggtttaacactatggttctctggctacttttaaaactgaaagtactcttcttataatataaagtaaacttcttataatttgtccaagagatatcaaaatacagtacctatgttttcatttatgaaattttcttgaaatatttactgtaggctgggcgtggtggctcacccctgtaatcccagcactttgggaggacaaggcgggtggatcacctgaggtcaggaattcgagaccagcctaaccaatatggcgaaacaccgtctctactaaaaatatttaaaaaattagccaggtgtgttgacgtgcgcccgtagtccccgctactcaggaggctgagacaggagaactgcttgagccagggaggcagaggctgcagtgagtgaggtcgtgccacaactccagcctgggcaacagagcaagactcaatctcaaaataaacagataaataagtaaaaataaaataaagaaatgtctactgcaaataatacgtttcataaaatgcttaataaaaactttcaataccatcatgaaagcaattagaacatgaaggtgtctgaactagatcatagtagtgtgattacattcaatatctttctataagacgtgatgatacatacagggtaaataatacaagaagacctaagattattatctcagaatttcctaattagaatgggaatacaactgtgcaatgagagaaatggactgaagacagaaataaaaacaaatgttatgatttaatatgacaaatttaaaatttccactttattttccaccatttttaaagagcattccttacagtattcagtttaatgcatttttaaaaatcagtaagacaagtagcacatttctctagttcagaactccgctttcagggttacagttaaagatgatcctagaagtgcattttaattggtctagggtagggccattagcttgatgttctaaaatctaccgagttgattacaatatgtggcagtgtcaataatcactttcttaaacccaggtcgcaaagtacatacacctataaaaatgctgaaaaatgggccaggcgctgtggggctcacacctgtaatcccagcactctgggagacccgagatggaaggatcgcttgaggccaggagttcgtaaccagcctggtctacacagcaagacccccatctctataaaaaaataaaaaatatttttaaatgctgaaaaatgaaatactaaattatttatgaatagataacttcaataaaagatgagaaaatacaactaggtcattaggacaatttgtatgaaacaatatccaatttgctgtctgttacttctcctaccttatcatgtctaatttttcctcatctttgtgaaatcctgcgtctacaataggcaagaaaacaaaaaacaaaaggaatcttattctattcacagccatcagaaaaatgtgttactattcctgtagtcagttaggttctaaatcatacatttgagatatatttgaaacatgtcataaagaaaataagcatcatatttctcactaaatagcacctgaaatattccatatgaaaggaaaaatacaaaaaactaaactttaattactaacctccttaaaggaaaataattctatatgatttgatatttgataatggatgtccaatacctgagatataaattccattttctgtgtcctaacatctcaccttcagaaaatctccaatattgggttatttggattatatatttaaaactgaatatacttgaaaatgtgaaagatttgttgcagcaacaaatggtttagcaattatctgcattaaaatgtgttccatgaacaacagaaaaagaatatttctacttcagtccttaaaaattgtgaaagcacagccacagtcttagtttgtcgatcttgaattcttttggtattttaatttcaccaataattccggaactgctgtttttatatttctcaaaatgttttgtcttgcatcgtccaataaggcagccaccatcatatgtgaccactgagcacttctaatgcagctagccagaactgatgttttaagtataaagcatcttgttcatttttatactaaatgctgaaatattgttttgaatataccaggttaaataaaatagattaaaatttatttcacctgtttttgtttttttaaagtgtaactacttgaaaatttaaaattacacatatggtctgcattatatttatattagacagcactggcttaccgttctactagttggctagcttgtacctccagataacatctgataatccaatcactagctatcacaaactagatctttcagatgtttcctattaaaatgttcgtttaattttgaagtgaattcctagaaaagctcatataatactattatagaaaatcattaaaatcaacttaataatttgcccaccatgaaacagaacttaaggtaaatctacatttctttggttagtatttactttactggtaaagaccaaagaattggtaatgttcaacaaaatatgaaaatgccagtgatgttaacaaaaaatagctggaaaccaaagaatcttgcttacatcacaatcacagccaggaaaatgcagcttattttacagccaatccccaacgtgaagaatatgtagaagaaacagtaaataaaaacagaagtataatacagaaatgcctaataccaaagaaattcatgtaacagaatactgaacttcagtatttctaatatacggatatacacattcctgctaactgtagaatatttcctgcaagttatggtcccagtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatacttacaagagtagcagcaaatgatgaagtagtaacaagaggggcagaaaaatagaaagattatcatcggatttgggaatcaaagacagctcagcaaaatactaggacatggctcatataagatggaataagcctggaaatacacccccctccccaatatttcggaacataaagtctacagaaaaagagtcctaatgtattgaacctggtttctcaattgaaacaaaagtctacaaggaaggagagataagtaaaatttaacaggaatacatatgaagcagtatctttaaagaatgtaaatatatcaaccaaaagtaaatttgagattcaaatttccattggtaaagtcttttcagagtcagaacaacataattattatataactattcaaaacaaaacaaaaaaaaacttactagaaaggagcacaactggtttgagaagaaaaacttttcatggtagagcagaaataactgtcaaggaaaatacttagaaaaaggcatatataaagagtggcctagttttactgcacacgtcttttgccatgcagaaacagctaaatcccatctgacaactactttccctttcgtgtaccttgtctttagagaataaaatatatctgggtttgatatagaggagactaattttcacattaaaaaatgattttcttaaaagcttggccttacagtttaaaaattatacgattaaaatcaatatattattcctataaaaagccaaactttaatccatttaaatcatgaaacttaaaacttaacttgaagcaatttcaatcatgaaacttaaaactccaaattactattgtgaattaacacttctccactatttgttatcttgcaattttaaaaaacacttcagaaagcagcaattttgtaaaacaataaataattcgtacctacagtatcttcattttgccatgcagttttacttaaatctcacttaaaaagaaatggaactcattcttaaagggtagaatgtacatgatgtaaagcagacaaaggaagatttatctttacttactgaaaatcaacagtacaattctaagatttttttccatgaaactactgaaataagtcctacttgaaaaaagaaatcccacaagagttagcaattaataaaaacatcaaaatgagaaattccccagcatggaaaattcctgtcataaatgttgatgtttatccagttaaaaatatatacaatgaataatatcaataaataaatatattagaaggaaataatagatgttagttactgtatacccaaaactatactgtattttaggctctatatttactgcagcacagaactaaaagaatttttaaagttctttctattagaaactattatcaataggttgcatctttatggcccaactgagttgaaattccaaataagatcacttcaaatttaataaatggcattcttcattaacagcatttaaaaaataatggctgaaacacataatcaacattacactgaagttctatctgaagacagaaaaagttgccatccacaccaaagctacacatataccttctgattttatagaattgttccaatatcttttctgtcaatatcattaaaatcaccctacctgtttggaccgaggtctaccaggagaaaattttctcttagtaatagctggtttacccatgccaatttttggagtgactgagatgtaagttgttggcatgatgtttccagcagaggaactaagagctgaagggtaattatgcagcatgtcatgcgaaggcaagtctgaagaaggtgttggggaggaagacacatctgccttgcttatgtctgctgatgatgaaaatgatgactctgtctcagatgataactttatagatttgcctccttggtatgaaacatctttcacacaaccctcaattgtaggagtcatttcagagtccatcaatccagtagaaagttcagaattttctttctgttccttttctccttgtagcctttctataaccaactgttcctcaggacataatgaaatactttcctcatgtggggacactaaggtttctagtggaagagtgacagattccatgactaattttggaggccttgattcttctctggataccactgtttcaggttcctctaacaactgcagttgttcttgctgcacagtgatctggtgtgtaacgacttcaatgttttctgtcacttccattttatcttcaatttgatcttcgccacaaatatgcttcacttcagaagacattttcaggtcttcactatcaacttcattagaaatctgtttttccaattcagtattcactgtatgttgggatgatactacaaaattcagaacatttgttatggcaatgtacaaacaaattttaaattttctaactatagatatataaaacatttggctacactagaacttaaatcagaaggtattcatcaaagcagacaattattaagtgaatgaaagccaaagtacacaaggatttatggattagaatcagccacacaccagaaaacctaatgaaaacattatgttttacaacttaaggatttccaaatggattgaaaattacacaggaaaagttctcatactcattttttagttaagaaaatgaggatcaatcatgttatgtgaggtacctaagttaaaaagtaaagagtgatctagaatgtgtaggcattttctaatagtagatacccagatgtaacaaagttactatagactcaaaagcacagacagaaaagatttactaaccaccaatatttattttgcttaaccatacctgccaacctacccaaaatattctttggatataatccttgttcttcatcactgtctataaattaaaagactaatctcaggaaatctataaacttagatatcagaaacatagtcactggtaaattttaaatcaggataccagtatgttaaacctttaactcaatctcatcaaggtaatttttaagttatagtaaaaagacactgctagcctcatttaccaatcagtgactaaaatttatctggtttttttttttttttttttttgaaacagggtctcactctgtgacccaagctggagtagagtagcacaaacatggctcactgcagcctcaacctcctgggctcaagtggtcctcccacctcagcctcccaagctgctgggactgcacacatgtgtcaccatccccagatactttttttatttttgtagagacagggtctcactatatcgcccaggcctatacatgttctgatatcaaactgaaatctcatcttctttcccactttattgaaagactacaggtagggataaaagaaaactaccaagtaacagatctgaaagtacaaaatatttttaatcatgacctcccccctccaaaaaaaaaaaaaaaaaaaaaaaaaacctttcaagagaaactaaccttctttagatccattgtcaattcttttccagaatctcttaactaaaagatttagttaccgtaatgtatatacatacagcaatcgcaaaaatgtctttgggataaagacattatcttgtaactcaatcaaattagacaatatgaacatactgcttaccagcaataagaagactatctgtgtcaagactttctgagggatgactcttctgttgctcttcagtgtggacttgaaccgctgtgagtaacacatttataaaatctctaaggagtcaaaatttctgtaacactgttccctcaacagtaatttgagtaaagagttttattctactaaatgtcaatttccaatataagcatgaaacattgtaccacttattagtaagttatgaagacaaaattagaagtctttgcactatggtaaaaattttttaattgtctttttctctttttctttaacaactagacctcacaagaaagattatagaaaataattttaatgagagttattatacgtaaacttaataaatttcaaaacatctcagtggctttttatgtatacattataatttttatgtatactatataattgaacatacaacttcacatacaacaccaaagactttcagatgagcctgtgattaaatgtaacaagtagttttcccccaacatggtctcttattaattccagatctgcaagtacaataatagctcttatcaatatttactacaaaaagcttaattgaaacatcatggaaataagtgaaataaccctcaataggactgctgagatgatccaatacagtaaatttttcattatctcagcatgaaacatctcatcatcagcaacagctctacttagcaactacaactaaagaaataaaaatacgaattgctttttaatagaaaatcacttggtcccttaaccaagtaagtacttatgattaagtctagatggtagctgaactacaaatacacgcatgtcctttctcctattaatttgtctaagattattttactaaaaaactcttcctaagtgactgcatcttggcttttactgaagttttagtcaatattcacatatttattgtatatacacattttcttcaaaaacagagtatatccattaaacattcttaccatctggaacaattccaggagtggactcctgaccgttgacatctttattagctgcctgctctgagaataccatttgatcttcagggccttcaacttccatttcattgttataatcttaacaaaaaattattaattctttagctcagaatgagtttttttctttgttcattaagtcaacaattatgattttgtatgagtaagggcaaatcatcaccaaaaatgctttaagtttttcttcagatttttctctgttgaaccacatgtatatttacatttttaaaaaacatgaaaattataatgcatcaaaaggtgggccaaccgtggtagttcatgcctgtaatcctaacactttgggaggccaagacggaaggaacgcttgaagccaggagttcaagaccaaccaggccaacatagtgagaacccatctctaaaacaattttttttaaaaggtaactggcacattattttaaaaggatatttcaaaactaaatactgatggcattctggaaatgaaaggttagtaattaagatgtttagttatccttgaagatgataaagagaagttttacaaaagctgccactcataatgatgaaaatgaaaaacaatctggcgagcagttctatttcctttactctctaagactcatgtttttaacagtaggatactactaaaaatattccatacctgaacaaaatcttgggctgaaaaggtgataattaacttaagaaggacattacaaaactacaacatgcttagagaaaaataacccacattataaagaacaaactaagcaaacccaaagactggggaacttccactgtcggcctgaagaacacaagtgaaggaaagcacactagacccggaattcaaatactaaaaaaaactatcttaagttagattagattttagccatcagattcagagatgaccaagataacaaatacatttaaaggttgagaaactgagaacaagatggaatctggaatacaggatcctctcttcctgattaaagcaatatattggtgatacaatggcacaacattacaaaaacaaaaaatttaaaaaaaaatcattctcaaatttacctgtagtgagctcagctatctccacttcctcacctggctgtaaacgatccatctcagctcccaggtgtttacaatacatgcagatatactcttctttgagctgagtatccagttcatgatctgttggtttgtcacactctaggtgaacccacctgcagtgataagtatacttaaataaaaatttctaacatcgagttattatctaggtaaagagaaggcattgctgaaaagctggatatgaaaacagttaattaagtatgagaggagagaggttagaggagttgctaactgacaaaggttttttaaagcacatttgtgcatgtcactagagatgctgccgtatttttacttgacatttttaagctattttctctttacttttccctattagtgctcatttctgatgtggtctggtcttatcttttgcccatttacttccttatgcctttgagactcaaaaacatcatttaattccatctataacagcaatcagtactgatggaattgctagagtgataaaaacttagaagctgtaagatggtagagcaaatgaccacatgaataaaacaatcgacaaaacaactgaatagaataactatcttcttaccttttgcacatattacaatgaagcatgtctttctgcaattctggatgataacacttcccacagaagggacataagttatcctgctgttggtaacaattgtcacatatcaggcaattgtggtgccactgagaactagaccgtgtgccacactctatacatattctgcaattctaaacaccaggaaaaataaaaacaaaaacagtttgttatgcatttgtaattgtagttctgatgtaaacctttaaaaagtcatgaatcatttgtggattatacattaagcttttattttcatgacactaatttagggtacatgctttttttttttgagatggactcttactctgttgcccaggctggagtgcagtggcgcaatcttggctcactgcaacctctgcctcctgggttcaagtgattctctcctgcctcagcctcctgagtagctgggactacaggtgtgtgccaccacacccagctaatttttgtgtttactaaagacacagggtttcaccatgttggccaggctcatcttcaactcctgacctcaagtgatctgcctgcctcagcctcccaaagtgctgggattacaggtgtgagccactgcgcctggccttagggtatacaccttttaaaaagctgttttcaatgtctgatgtggcctcacaaaatctgcactaaaatctccaggaaaatttaaataagggaatggggatatccaggaaaacatataggtggaagagataaaaccaaaaagacagcaactcaaaattcaaaaaaagaaacatatgctaggagcaggaagtaatttttgtggagtaagtctgctcaactctaaaacaatagcatggccagcctggtgtgatggttgatgccagtaatcccagcactttgggaggccaagatgggaggatcgcatgaagccagggatccgagaccaatctgggcaagaaggcaaaacacctctttctctacaaaaaaaaaaaaaaaaaaaaaaaaaaaaatttaattagccatggtggtgcacacctgtagtccctgctacttgggaagctgaggcaggagaattgcttgagcctaggagtttgaggctgcagggagctcacgccactacactcaagcctgggcaacaatgtgagactgccatggtgggtggggaaacacagagcacggtcaacgccatgtgacttggtgtctgaaaatgtgaaaatatattgctccacatcaaaagtccaatgatggcccttcatgtttttagaatagagagagtgtcctatccttaccaaattagaattgtttatgaagtaaaaggccaaccagaggccagccaaaactacttctgtgcctgtgagctagtcagccttaaaaccctgggtatccctgggtgtaaggttaatacattgtggggctctcattacccaccccaaattttgaatctaaaatatcaataaaagggaactttatctttctgtgctaccaggttgatatgaaagggatgctcacttaaaaagagaaactaccaggaaccatagatcagctagtcttaaagattaaaatgaatgcacttaacaacactgatgcaaaaatcctaaatagctgggcacggtggcacagaactgtggtgtcatctacttgagaggctgaggcagaaggatctcttgagcctaggaggtagaattcagcctgggcaacacacagagaccccatcttttgaaatacatacacatatattttttaaaagaatgtattatcctttatctaatgagaaggagaaaagaaaaacaatcctaaataaaatactatcaaacagactctaataccacattaagaaaataataactatgcccaggtggagtttatacaagaaattcaaagatatttaatattagaaaaatccattaataaagtttaacaaattaaaaggtctgaggagaaaaaattatttcaatgcaacagatgattaaagaaagaagtctttgggaagaatcaaaacccattactaataactcttgagaaagtaaaaatggatgggtatttctctaatgtgaccaacataaatacttcaattctaaaggcaacatcttattttatgggagagcccgagaggcattcccactaaggacaggaaaaagcaagggtgcctattatctccactactattttaacatggttctggagccaatgcaagcattgaaacaaatgaaaacagaaacataagaccaggaaaagaagaaacaaaactcttaatttgtaaacagagttggaacatcctagaaaattgttcaaaaattcaataaaagaattcaacaaagtactaggatataaaattagcatgcaaaaggcaatagaattcacacacacaaataacgagttaaaggatggtaagaaaaccccatttataacagcagaaaaataaatattcaagaataagcttaaatgttgaaaatcagtatgaagaaaattataaaacactcctaaaagacacaaaactagactttaacaaacttgtaaagacatcccttgttcttggttaggatgtcttaaaatcaagatgtcaatcaactctcacttatatatatatatatatatatatatatatatatatacatatatatatatgtgtgtgtgtgtgtgtgtgtgttttggaaacagggtcttgctctgtagcccaggctggaatacagtagcatgatcatggctcactgcagcctcgaactcctgggctcaagtgatcctctcacctcagccttctgagtaactgggactataggcgtgtgccactacacctggctaatttttttgtatttgtagagaggcagtttcaccatattgcccaggtttgtctcaaactcctgagctcaagcaacacccctgccttggcctcccaaagtgctgggattacaggtgtgagccactgcacccagacactcaataaattaaatgtgattccaataaaaattccaatgaggtttttattggggctacatatggtgatcctaaagtttatacagaaaaacaaatacacaagcacagataagaaacctgtgaaatggataagttctgaaggggcccaacattaccagatactacaaaggctctataacaaaaacagtgtcgtactggtgaatgaatagacagatcgatggaatggaaaagaggttccagatataagttcaatcaaatctaacattgtagtctggaatctcaagtcactagggcaaagacagtctttttaatgaatggtttttagaaaactgaatagccagttggaaaaagatactcacatcatacacaaacatcaactccaaatagatcagagatttaaatgtaaaaaataaaacaatgcaagccatacatggtggctcacaactgcaatcccagcactttgggaggccgaggcaggcagatcaattgaggccaggagttcaacaccagcctggccaacatggcaaaaccctatctctactaaaaatacaaaaattagctgggcgtggtggcgcatgcctgtaatcccagctacttgggggagctaagacatgagaatcacttgaacccgcgagggggaggttgcaatgacccaagattgagccactgcactccagcctgagcgacagagtgaaactctatctcaaaaataaaataaacataaaaactgcaaatcctagcagaaaatatgaactcctctataccctcagtgtagggaaaggctttctgaatatgactcaaaaatccagaagcaaaagaagattaataaatctaactccataagaaagaaacttttgcatggcaaaaaaaaaataataaaaacaaagtcaaaagacacataatacagcctggacaacatagtgagaccctgtctctacaaaagtaaaaaattagctgggcttggtggtacacataactcctagctaactcgggaggctgaggcaggaagactgcttgagcccaggtcaaggctacagtgaactatgaccataccactgtactatggccggggtgatggagtgagacactgtctcacacaaataagcaaaaaaaacaagaacaaataagctggcagaaagtatctgcatcatgtaacacagataaaagcttacatccctaacttataaagaactcttaaatttaggggaaaatgccaaaatcttcaataacaggcaaaacacatgaacagacaattcacgagaagaaattaaaactgacccttaaacacatgaaaaaacgatcaacttcactcaggataaacaaaaattaaaactacattgatacaccacttttcgcccagaagacagacaaacattcaaaagctgaacaagtcatcctgttagcaaagacgtaagaaaagttctctcacacatctctggtggcaatgcaaagtaccataagccccaagaaagggaatctgacagtatctaacaaagctacatatgtgtacactcctgaggcaataatcctacttctaggaatttaccctacagatttgtccctgagaattcaaaaacacacatgcacaaagctagggagtgtaaaatcatttataatgcaaaatatcgtaaactactgaaataccaaagcacaggccattggttgagtaacccatagcacagatacacaatggagtgctatgcagctgtttaaaaggagaatgagatctcttgaacttgcctaacttgcctggaagtgatttccagattttattacacgaaaaaagcaacatgcaaaagaacatacacaacatgctaccttcactgaaaataagagcaatatatcttcttattcttagacgaaaaataacaggaggtttaaaacagaaaacaatgaagttagttacttccaagaggttgggagaaatggagtataaataataaacaagaggcagtgacaattctgagtaaaacttcatatagtattgagttttgaaagtatactaatatcttctatatttaaaaaattaaatcactaagaaaagaaaggggaataaaatctattactgagagcaaactgaagcagacttgctttttagattgagcaactgaataaatgtgctgatgttgctacaacccagaatttttattgtagaagaacagacatgcaagaatgagaaggcaaagaattcagtggagaaggacaagaactggaggtactggtgtaaattcattatttctaagttatgcatatgtatatgaatatttatgtgtatatacgttaagtgtaggggtgttcaatgttttggcttccctggaccacactgaaagaagaagaattgtcttgggccacacacaagatacactaacactaacgatagccgatgagctacacacacacgcacacacacacacacacacaaaaaaaacacctcataatgttttaagaaattttatgaatttctgttgggccacattcaaagccatcctggaccacatgtagcctgcgggtcatgggttggacaaacttctgtaagtgtatacacacgcatgtatttcctgacaccacctgctgaaaggatgaagaagcaaacacccttcagtagcaatgagcacacccagcacccattccccactaaaggaatctgggttacttatttaacaatggacttattccagggctggggcacaggaggtataagatgagcttgtaacatcttgttacaccaaaaagtatgaagtgttcaagtaagtggtgagggcacaacaccagcgccagcttgaaggagcaactgacagcaagtatgggactatttcagccaaaaaataattaggtaatgagttgtaaatgattgaagataataggagctcatgagtcagtattaataagtaagtttaacatgtgaaagaagtgttcttgcttacaaaagaaagcagagggctaactggtaaatgcggtgggagtgctagagctggaaatgcatcatttgcaaccaaaacaaagcaggttaaaatggcatcatcaggcagtaagtttgttgttgttgttgttgttgctgttgttgttgttgttgtttttgagacagagtctatctctgtcacccaggctggagtgtagtagcatgagttcggctcactgcaacctctgcctcccgggttcaagcaattctcctgtctcggcatcctgagtagctgggattacatggcacccactatcatgcctggctaatttttgtatttttattacagacagggtttcaccatgttggccaggctgatctcgaactcctgacctcaactgatccacccgcttcagcctcccaaagtgctaagattataggcatgagccaccacacccagcctagggagtaagtttttcaaatctagaaggaaattctgaggaaaagcaagatatttgcatggtcttaaagtgtccttacatactgctttattagatacaaaggagggggaaaagaaattggacaacagcctgaccaggtgattcccatgagggaaagtggaataatgtgtgcttccagctgtgataccctgaggatggatcagtactttgcagtattctggccaataatgcatgcctctcatctaattataaggggatatcaaagacaaaatggggaaatttgtttgaaaaaaagaaaaaaacaagtatatcgagaagaactctattcttcaaaaataccaatgacaaaaactaaatcctagaacctacttggaggaaggggtaggttatgaaggacataagatcaaatgacataactggaatatggctagtacattagataaacatactacattgatgtaagtttaggaagttgatagcaggattgtgattttttaagaatattcctactattaagaaatacatactgaaatggtggtaaaaaggcacaacgtatgtaattaaccctcaaatagtagggggttagggggaatagagacaaaaacacagacacacacacgcgcacacacacacacacacacacacacacacacacacacacacacagagaaagcaagagagggcatgcccagtgacaatgaaatgctaacaactgataaatctaagtaaatgcgacatgggtattatttttattttctccaacttttagagtttgaacttattttcaagtaaaaactttctaaaaacacataacataccaacaaacagacattcttgagataaaaataggaaaaagaaacctatctgacaatgactggtttacaataaagatcctgaaaagattacccccactccagctcaccagggagcagccccaaactagactgacagccctgtgggggcacactgatttgtcccaacatctccagccttcactacagtttcacacacagtaaacactcaaaagttaaatgcaaacaaatgagcaaattatgactcaagactacagagagaactacagaagaatttaacagcagagaaagatgatcactcttcaaatggttcaaaggacaaacctttcaatccatgaaaaactctggtaactatttctgtacttactttgtgttaggcattgtgctgggcactttatagataccacttcattaaatccaacatccctgtgaggtaagtaccgttaaccttctatacactgacttagggaagttaaacaggtagccaaagatcatcaatttagtaactgaaaaaactgcattttgactccacagcataagctttgaaccaccacactatagtcccttcatagaacaggataaaaagattaagtatccaatagtattcccagaaattatgtaattctgtcactctcaaaagagaatagcagattacaaagagcaaattagaaagaagcacaccaaaggggagacagaacaagctgagaaagacacccagaattctctaccagttctcaagataatgaaaaccctaataaagaagatcaagagcaagaacaaaaattatccagtagttactagatattattagagagtgtaaagaaggtaattttttaagtaaatatatttttttaaaaaggtgctggggtggcgtgggggatggggactcacacatctcccaaagctttcaggaagaaaaaaaggattatgattaaattttttaaagttaagatttttcttgtgacagcataaactgaaaaaactgaagaaaatgttttcagagtataagaaagaaaaatttgtaatatgaaacattatactgtgccaagttcttatagcctaaagggaacagtctctttcagacatgtagggtttcagaaaatttataattatttttaaaggaacataaccaagactccgaaagattgagggtaaagttggaattaacagaggaaatatatttttgaaagaaaattgtgacaaggtttataatctaggttaatcaaatcaaacagagaaaaggggaataaaaacttcattttcagtggggaatgggagaaattttatatctttaacatttataatcatttacattcacaaaatgagattctgaattataaatcattgcaggaagtaaaagaagagaaaagtagaaaggaattataagaacaattttgcctcaaaacagccaagcatttcaattacaaccatcaatccaaacagttacctctattaagcttttcaaaagataacatttttataacacaaaagaatccaaaataaaaagatgtgaaaagataaccattcaactgttaaactaacaccctacgtggccatagtgtcaggcaaagcaaaatacctgcccttcctgatccctcaacaaaaaacacattacatagaataaagaacaatttcatactggtaaaaagcacaatatattaacactggcgtgacctacttgctaaataacagccacaaggtatttgtttaaaaatatgataaattgataggaacaattaatagtggtcaattgtaacaacttgttgaatcaacaagtcaaaaaataaggtaaaaggacttcatctaactaaatgaaattaataaacacaaatgctacacctttaaaaagtcactacaagtatcaacacatttattttaaaaaacctaccttagttaaattatctgattaaatgaaatgaaagcataaattaacatacttcagcacaacttaaaaaaaagataaagatattcggtaaggtatatacatacataaagttacaaatacaataaatttggcttcagccaaagctacagccgaaggtaaacttatagtcttaaatgtcctttttccttaggaaaggaaagaaaatgaattacaaattcaacttcatattaaaaataaaaaggcaagtagaggaactgagtgaagataagagtgtaaatatacaaatcagtcaaatagcagagtttttcctttccaatgataagtcattcagcaagagaaggaatctgaactacctgaggaagcaggccagagttcatcacaatccttcagccctcagaccccacttcccaggtagccacagctgagcacagttacccagcagctctttttccccccaggagagaaagcccctcccctcaacccccaccactcaggcagatgcctaataggacttgctgaagaccacaaaagaacctggtaatactgcttgcagttctaggtgccaaacctcactggcgaggacagggtgcaggtacagaatctccctgcgtctgctccacctcctcccccagctggggacctggggttctggccacatcaccctcctttcccaggccctccacctcctcactagaaaaagcagttccaagaagagcaatgacaatgctgtgccttccactcccgcacacgggccatcatgccctctccagctccaggaaaaacccgctccaggcccatgcagcacctgagggtcatctccatccctcaacctcgcaacaccagcagcccaggaagactaagcttaaaagctaaaccgcaccttggattccaagggctatctccactaccccactgcccccaacccggctctgaacgcctcaccctgaaggggcagaagccaagtgaggtaggaagttagttaatgagctcatcggcattttttgtaatagctcaaaattttgaaggacccaaatgttcaccaacaggtgattcaatacacaaattgtggtatctccagcactcagtaataaaaaagaatcactactgatctgtgcagcaatatggatgaatttcaaaataattacactgagttaaagaagccagaccaaaaacgagtatatagtatatgaagcttttattaaaaattctaggaagtgaatactaatctatagtgaaaaagcagactaggaagacagagtttgggtttgaacagccacaaagcaagccaagaggcaccaggaaacttttgagggtgatgactatgttcattatcttgaagagtgtacagtttattatatgtcagttatatgtcaataaagctgtttttaaaaagctgatggtgatgatgtacagatttgaataggtatccgatttgtctggtctccatataaaacatagagaggatttaaaaaaataaataaataaacaacttactttgcatttccagccattggttggtactgatttcataactggttgaagacaaaaagtatgataccctttgtcacacgtatcacacactagcatcttgctatcttctcccgattgtctaaaaaataagatagcattaatgatgccttatctttaaacttatgttttgtaacataagtaatcatgaaaataatcagtcctgggaactgcacagttcataaatacctcagtatctgttttgtctctgcagatagtaacagaggtaaccctgccataaggattacctcctaaatggtgatctttactcaatgctcacctatggttaacttgctctagccattttaggattcctgcaaaggaggaagggttaaggcaagatgaatagcctctgatctttacttttaaaatagaatttttgagaggaaggtgctataactgataggtgctactgtgtggaaaggaacaaatcttggcacagcgaattgaaaagacactgtcgtataacgtaaagaggatcaaatttggcatcagatctctatttgtattcaggctgctgttttctagctgtgtcactaaacaacttagactaaagctctctgagttccaggtataaaatgggaataataaagattactgcgagaattaaaggtaatgcgggttcaagtgcttagaatgtctattaagcaattaaatgctgaataattatttcaaaatacgaaccttgtcataattattaagaattatagttgaaaacctaaaatctttctctaaacactcttctgcccccaaagattgggcccctgtcctacagctttatctctgttgagatttttgactataatcactttcagatactatgattttaaattcaagaggaggggaaaagaaacaacagggaaagcaagaagagctgagagaggaatctctgaatgaaatctgggggataaatagatgtcaacaggaagatgggtcagttagcctccaattattattcagttcagcctctccataaaaagtcacgttttatctcctcagctacgtggaaagatcttggaggacaagtactcttccttcaagttcttttaatccttcccaagaaactgagcgcagatataaggtatcgaataaatgtttactgaatattttatctaatttttaccaaaatatggaggtacatagtcctatttatgtcacgtaactctaagatactgacgtttatttcttatcaaactaaataataaaaacagactgatcatggcagttgggcataattcttgctggttacaacaaaaattctcagcctgtaaatgaagatactggtaacatccccaaattatcatgctcattagaatcatgggggtgcaagcggaaatcacagaaaagactggagaaatgaccaagagatgaaataccataggaaaatataacccccttacaaatttgtaaatgccacatatttcgttttggaattatgctgaccaggatctactcaaggtggcttttagagagatgcagatgtacattaaaataatagtagaaattgtccttcctggaatggaaattcaaacacatgactgattttttggctcaactctaattcttctacttctgtagttagacgtttaaatcctattaaatctcctccccagtaccccttaagaaaaactactttattcttctgtttgttttaaattgttaatatcgcttattttttaaattgttggcaaatttaaattagctctttagacgaccagagcaatttaaatgattaaaatcagttttgtttagacttctttcaaaattatataaatgttatttatattataatataataacaaattatattatggatatatactggataaatgttataatatccagtaatttttttaagtatgatgaagtcactgaatgaatatagctaaaatatgaacaacctctattatattacacaaacctttagcacctagtaatagggtccctcttaaacccaatacacagctttgaattgaaatgaaaacttacttgcagttctggcacactttgcactcaggacattgccaacctgcacgttttaatggagtaaccgctatatccaggcacattccatgatagtgctgaccacaagtagtacaaaagaactgatctaagaggtctcccgggctgtcgcacactgcacagtttgcatcttccttcgctataattaacagtgaaacaatgaaattgttgtataagaatttaaattttttctgactatacagtaaaatcatttgaaaggatttgcatcatgaacctttcagacatttgaagttattcacattgaattgtcatctaatcagaaagaggtaccaataaaaacactgtagggtatttaatctaaatgtaaccacattaaatttaatcgtatagttttgcaattatttgtggctatatctacttgagaccataagcaggtcttctttaattttctattcctaatgccaatgataatgctggatacctaattaatgctcaatatatgcttactggaaagaaccaaacaaggaaaatacaaattaagaaatgctttgcagtgtaacataaacattttctttgaatgttaaatatattttgaaattacaaaatcagataagagacaaaattaagaaacattaatatcaattagactaagatgcttcttaagcataaacagactattcaaatcatataagggcttttttttaattactggaaaatgccttatgtggaagaacattaaagacagaagctacatattcatacacaaacacattacttaatatactaattatatattcatctatattaatttctagttgtaaaagcattaaaatccacataattatggacatcatccatccctaaatgtggattaaaagaaaatgtactaacagttcttttaccatataaaacagaaaatataaggataaactgccctgccaaatatacagttaaacttatgcatactgcaaaataaggaaaataatgtattctaaaatcataccaatcttagataatgtataaaaaatatgcctgtatataacaagtatcacaaagtatatgaatcttttcattttttgaaggtttgatcattcctatctactattctgactcatacgttctttcttttccagtcaagcctatcataccaaccttagataatatatataaatatgcctgtatttaacaagtatcacaaagtatatgaaccttttttttttcctttttttttgagacagagtttcactctgtcacctaggctagagtgcaatggcacgatctcggcttactgtaacctccgcctcccaggttcaagggattctcatgcctcagcctccccagtagctgggcttacaggcgtgtgccaccatgcccatctaatttttatattttcagtagagacggtgtttcgccacattgcccaggctggtctcaaactcctgagctcaagcaatcctcctgcctcaacctcccaaagtgctgggattacaggtgtgagctaccacactcagccttttttccattttgaaggtttggtcaatcctatcaatttctctctgactcacacgttctttcttttccagtcaagcatcttgaaacagagtaaaaatatatttcttttatttgtaccggagtctgcaaacttttcctgaaaagggccagatagtaaatattttaggctttgtgagccatagcagtctctgacaaaaagtcagactttttgtttttatttgcactcttttaaaaatgtaaaaataattcctcgcttgagggcagtacaaaaacaggcttcaaaatgtggacgctggctggacctctgacgtacttcatgaaggctggcttagcacctaatactcatctgaagctacattagtgaggttgccaatgcccataggaaacccgattgttactttttagtctttggctttttgcactttgtagcatttgcattgctagccactcccacattaaaacgcccctttccttagtttctatcatggcaactctctcctaatttctccttagttttcccttactttcatctcatcctcctttgttggcttttgtacctatacaatctttctaaatgctggagtttcttaggatttcatccttttccttctttcctaatcccccatagtttccctttgtgatcacatcaactctcatgccataaaatgccaccatgattcctaaatctgtattattggccctagaattctttcataaaccccaaacctttattcttcaagtcttactggatctcaatagccagatgttctaaaaacactcaatctcaactgctctaaagtgaaacttttttaaaaacccgaaacatcatccatttttctcaagaatagataaaggcagaaaccttagtatcactgttcactctgaactcagccctgacccaacacatccagccagatcccaattcttatgtattaaacttcctacacatcattcttccttgtatgtttatagtttagtctatcatattaggttggtgcaaaagtaactgcagtttttgacattacttttaatggcgaagactgcaattacctttgtacctacctaatactctgtctcgctaactgcagtatcttctgcatcaaatcatctctacttatggttctgacatcctgtctaaatcattttctgcacatccagaacaatctttcaaaaatgtaaatctaattgttaacctctgtataaattaaaactccaccaatacctcatttttcacctaaaagaaaatcagaattttcaagtatgaggcaaaaaggcccttatctccctttccaactgaatctcagaaccactcactatctcgtggtcatggtgggttgtctgccatgcacctcacataacatgctattcatgtctgtgtgcttttacacattctgttccctctgcttgaaattttgtttttctgctgtgctcccagccttcaaaactctgctcatggctgggcacagacactcacgcctgtaatcccagcactctgggaggccaaagcagatggatcacttgaggtcaggagctcgagaccagccgggccaacatggtgaaaccccatctctactaaaaatacaaaattagcagggtgtggtggcacatgcctgtagtcccagctactcaggaggctgaggcaggagaatcgcttgaactcgggaggtggaggctgctgtgactggagtttgcgccactgcactccagcctgggggacagagtgagaccctgtctcaaaaaaaaactctgcacattatttcctgaatacctattaccacacccaaatacctttagttgttgaatattacttttacccatatgcttacaagaaacttctgttacataatcaattaattacagcacaactctgtgaatccttgaaggacaggggccttaacttttttaactttgtatccccaactgcctaacatgaatcaagtcttattgaacatattttaagtgaaggacttactgctaaaatcacttttaaatggctctttaagtgataggcatttaaaataaatcattaatctaacaatggaagcatcataaattagttcatttttgatagaaaggacataactgggatgttatgtttcttaagacagtaccagtatttatctttcaaaatatgtacatttaaaaattgatctttttgctcaccgtaaaacttttaaaaattgggggaaataataaactaattatcagataaacaattcatttttctattatactttcctaggaacactaaaatgcttctgtgaaactttctagagtttgctcccctgacacttcaagttgccatggtagctactagcgacatgtggtttccaaacaagtgaaatgtaattagttcaaatcgaggtgtgcagtaagcataaaatgcacactggattccaaaatcttaacaggagaaaaagtatctcaaaatttgagatattactattttggattactgaattaaataaaatttactacaattattcccaatgtttccttttactcaaatttttaacatacccactagaaaaattacttatgttgctcacattgtatttatactgcacagcactgttatacacaacaaagttcgctctgcaacaagacaactgtcattgtcacaaaaatcactttttagactatgatgatttccaccaattccttactgataaccttgctgtgttctttgattactatggatcattggtaataaattagtcaaagaaaaacatccatgtaatacatacatctggtgcaaaaacacttaatatgccttatgtgaaacacaataatttttaaaagcactacacaaagaaatgaggttggttccaaccctcccagtcagggagaagatgtgtgggaatactgaaacaaccttttggaggtcatgtacaagattatcgatactactggatagctttggtgtcatgacagaaattaaatatgaatatttagacacacatgtctgtaagccagagacactaagtttaaagcaataatcaactaagaaatttttctttaaacagttgaaaaagcaaagacaggctataactaaagataatttaaaagggcagaggagtaaattccaggtctatttggattctaagatcaggctcttgactactaatcaaattgactcctcagcaaactttactactgatcaatgaaagtgatgagtatttgagtatacacaaaagtagacatgaaatgccaacagtggcataagatgaagctaaatgaagtaaagggagcaaggttcttatggcaggagaaaagtgagaggaaacaaaatgatcatctttagagaaggtcatttcctaaaagacagccgtaaaaagagaagagataaataaaaaagacaaaaacattgagcttaaattagaacagagcttatcacagatccttaaacctgatgaaactattacttaagaaaatccagacaacacataagaataaaagcattggtgaacagcaacaaaagtcaaaatagctgtcatacagtgtgaatttaagaaggaccaaatcagcattgctttctaatttccatcacaccctatcatctgccaattttcatcactggcaggacactgtgctgagtgatttgtctataaaagagaatctctgggaagaaaaaataaatcatggatgtcatccaaagaggctagaccgtatcattggcaggtagataagaaaggtcagaggactgacagaatttagggtaaaagaaaagcaacaggacttaatgtcaagaaatacaaagataaccaaagaaaagaggctggagttaaagcttaagtgaagtaaaaggaattaaagctaaatgatgagtaaatacattgaggaacagggggtgaattaggatatgtagcatttccatgtttaaaccttgcaaagacttctcattgcagaccgaatagaacccaaactccttcccttgcttacaaggcctacatgatctagcctttgttcgccttgatgatgtctctactacccacctagtaggctactatgctccaagtaaaatgacatgctgcctgttcatgaatcatgccaaatccattcctcaaggtctgtgtagtggtctgttccctctccctggaatgttctttcctcttatcttgcatgattggctttgtgccattcagttttcctattcaggaagtatatctggttgtatctactagatggatttttagggtaaaatttccagacaaggttaatgtatccttgtatcatcatgaaaataatgttgcaacaatgaccagccatttacctatgacagagcaccctaaaagtgtttcctgaagaaaatcttggccttcttcacagatactctctttagtgaatttctttataatgagatgcatgcttttgttaaatttctcaacttttataaaaagatgtcaaccttactcctaactcagtcaactatcacagctactgctctgccccttaggaagcaacagaaaatacatatactcaatatgtattatcattctcataacttaatccttagataggaggtaaaataactaccctttttaaagcaattaatacatacaaggcacaatgttatgtgaattccattcattgttttcatttaaccctcataataacactatgatttaagacagtatcattttaaaagcataaaaattaacttctgccatgacacacaattaggataggaaaaaatatttataaaacatgttaaaaaggtgacaaaacatcctatctgcaatattctttaaattatatccttggtacttaatccaagattatgatcgtcttaacagatgggtcagaacgctgtgtagttagaatgcactgcttaagatccccaaggaggccgggcacgatggctcacacctctgtatcccagcactttgggaggctgagacgggcagatcacgaggtcaggagttcgagacgaatctagccaacacagtgaaaccctgtctctactaaaaatacaaaaaattagccgggtgtgatggtatgcgcctgtaatcccagctacttgggaggctgaggcaggagaaatcgcatgaacctggaaggcggagtttgcagtgagccaaggccatgccactgcattccagccagagtgacagtgcgagactccatctcaaaaaaaaaaaaaaaaaaaaaaccccaaagaaatctaatttagtcatttaggccttgattttacaccaccgacttagtttgaaggctgctataagaaacagccctatgaaactgatatttttctactgcaaggtggctactttaagataatttttcattgcattgtatcaagtgatgtcttgttattattatatcattatatcaagtgacgtcttgttataaatagtaagaatcagattaagggctcatatttccttctttgtattgactgctgaaaaggtatggggccaaatttgtggttacgtctggagttatatatttttggggggggtctctctattaccttcatatttatcctatctaaattttccattgccaaatttccttactttagttttatcctattgctcatgtatttttatgagtctccataagtctattttggaaaaaggcagagtactcataattttagtgtatcttttagctttatgttgccataaacctttcattatatacatgatcaacaacagcatattatctcacctcagtatttattattttacaaactgatttatgattgctaacatgtaactgaaggtatacactgttagaacacagttttcagtagaaagtagcactgccattaagtaataaaatattctaacactacaacaacattcttgtaaaagtttgcatgttgtttgctgaggtctaaagcatgattaactacaaaaggctgaataaaattcagattcctatatacacacaaaattgttttattgagatgacaaagtatatttattatgccacccagaatataatccactctgataactgccagtttatgcacttgctgaagtaactcagtacataaatagtagccgtaacagttgcagtgcatgaagttcttctcttccagattgaagagtgtacaatctaacgcattttaaaactttaaatcccttattagcctaaatataatttaaaattctagtttgccttacctataatttgtacactaggttactaatggtgatatgattacatatgtggacacaaaataattttaatggaaaatgaaattatggtactcaacaaagaaaagggtaatgatcatgtagactaactgtatttgagattagtttaagcctggggtagctatacttacgtttcacagacctggagaagataggaaaaaagcttttattaacattgctaaggaacagataaaagctaacattaggtaactaagaggtgacataaaaaagattgaataaaatatcatggaggtttcataatgagattggaaattcaatagactaggagaaaaaagatcccaaaacatatatgctcatagggaaaacacatagtaagaaaaaggagagatctctatttaatgatacaatagtaaagagttataatttcctgtataatgtaaatttcacgcatttaaacattttcattgaattataaaatactatttggaaaagaaaaacagcacaactgcagattacagaagactaagatagatgaatcatgaaaaggtactagcagagatttctattatacctatcagggaaacacaatttctaagaatttcagaagtctttggtgttcttattaacgtaaatcctgaaataacacctgagtgaactgtcttctaattcttcaactggatggctttttagtgttgattgactttttaataaattattttatagtataaatcagaaatactgcatagtccctatttacatctttctacagtggtttttaaaatgttttaagaataaaaaccatgcaaactttatttgatttttctgaggaaataactttttggatttaatttcaatgaaaccactgataacatttccctccccagcgatccctggcaacgatccctcagattttaaagattatgtattattaccttttaatacaagtagaataacactcagggaatttacaacatttgttattttcagtaaatacattggttgaagtttaaaagtctatccgtagtaaacttacatctttcaggagcttggtcaatgtgttctggacaaagcaggaagatgtgactgaaatcctgaaaggtgccggctcctgcagcacaaggataatgatacatctgggtacatttctcttcacagcatttgatagtggctccaaggtgcttacaaaatgcacatcgctgaaaggggtaaaggagagaaatctctttataaaaccttgaaaaggaatattcaaatataagctgggaaggtataaaaaactctctgtatatcacaagtaaaacaaattgaacctgcaaaatattaaacaaaggattcgttaaaaataataaaatctacattactcaatttagcgcttcgtgtgctaccaactcatccttccattcaaattagaaagttagaatttcattccttatattttcaaaaataaattttgaagcatttttgaaacaaaacctaaagatttttttttaaagcaaatagtaatatggttaaaagggcaggtttctatattgaggattattataaagtttttaaatcccaccaaaactagtaataggaacatatattttatttatgagacatattactattttttaccctgcctaaaaataaatacaaaataaactcatcaattgtaagttaacagggacacaaatggttaaagactcacagaaaaaaacacaaaactacatacttcaatgtagcaatcaacttcaaatttcttaacaaaagatggaaatgtgggcgaaaaaaaattagtcatctggtatctttcccatttcaacctgcctccattatcttgcaagtggtaaaacgcacagaaataagccccaaacaagaggggcagtctagggcaagtgaacacataagaagtcagaagaaattatgtaaaatgttgcatttacttattcagttttcccttagaatgattcacaaactcttcctcattctcccaagtccactttgagcatcattttctttgaagagagtttgatgggccctgtactatacagtatgacatctctctgtgggaaatgactatctaacataaatttttgtttacaccattacatggtacttacttgcttatgccattacatgatcagtttatcttttcctcatcctagtccaagatccttcaattgaggcaccatactatctttgtatccaaagcaccaaaaatgctgcttgaaacaggccctaatagaaaggtgttcctatacatataccaaaaagacttaacttttggtgatcttttttgtgagtgtggctcataaacagcttagctgagataactggagcctcatgtaacacagacagttggaccctgctaacattactgtggatatcttcacatgttactacactgactttatattctgctaattaaccagggactacagtagttaaaattataattgttttcaatgttttatgtgtaaatctgtatatcacatactatcaaactcttcctcactgtcatcagtctactgcactgaatcaacataacaaagctaagtgactcctgagggctgaatcagaaagaagaaaagaaagagatacaaaaatttggctgggccgggtggctcacacctgtaatcccggcactttggaaggccaaggcgggtggatcacgaggtcaggagatcgagaccatcctggctaacacagtgaaactccatctctactaaaaatacaaaaaattagccagacgtggtggcgggcgcctgtagtcccagctacttgggaggctgaagcaggagaagcttctaaataactcataaacagtaattactgttgtgacactttaattttatataatattataagtatacagaataacatttcagtgctattttggcactcaagggtattaatgcattagaaacacagaaaataaatatttttcttcattgataaagtgtaataaccagcttttacaaaacaggtaattttttataactcccaaggtatctaaatatgtttagtgcattaacagaacccagaattaactacaaatacaacacctcggtagtctaaatgtctgaatagaaagaccacgtaaatgtcgaaaggaaaagtacaatcaatctgttgaaaaatgtttataacaactcattaacataactaatttctgctaaattgttaaaatctaaaatcgcttattttgataccatatggcaagttttgcagaagccttttacactaaaaataatcttggcagataaaatataatgagaggtaagtatataataacagaaagtaatttaaattgaccagcttctcaatgtctttctcattttagaaacaccaatatgttctcttaatcatatctgcaatgaaaaatattatattagctaaactactatgagaagtactggaatatatctaacatactaatttacaatatcatataaagatatcagtgaataaaagaaggaaaataaaacactacatttaggagaacgcttcaaacccatctgttacaattaaatagctaatgaagagcactcggcattaaaagaaaatgtttactatatatacacagtctggaatgtatcttcctaaaccaagtaaaaagtacttgtaaaatcgtagacaatatcaaagaatggatttccacagggaacttctcaaatgtcaacactcttatacactacacataaaagaaatcaagcaagttaaaatattaataatacaataagtaatatataatacataagtaacaattacgaagctaattaacatttggggaggagggataaagtaaacagctcttggccgggcatggtggctcatgcttttaatcccagcactttgggaggctgaggcaggtggatcatttgagctcaggagttagaaaccagcctgggcaacatggtgaaactccatctctacaaaaaatacaataattaggtgggcatggtggcatgcacctatagtcccagctactcacgagcctggggtgggaaaactgcttgagcccaggaggttgaggctgcagtgagctgtgatcacgctactgcactctagcctgggaaacaaaagtgagaaccagtctataaaattcaaaaaaaaaaaggcccttaaatggtgtatcaactaaatggtttatttgaatcaataatgaaaattcctagacagcattttttctttttacttttattcatcattaaaaagacagggagtaagaaaaggaaaaaagtaacatgttataataatattttcccatattaatccaagaacacaataacaacaacaacaaaaactcagtgagaactcgtattaccaattttaagaatgagtctgaggaattttcaagacttttatttaatagtttgaaataatctgtcaaaatgtatccataaaacaaaacagaatgaacaaaatttgagattaaagttgtatcataaaaaaataccaagaagttaaatattccacagttcatttaattaattatccagtatttattctgtaccaactatagcaatggttttaggctacgtgctctaataaataagtattataaggctccccatgctccaaatttgtttttaatcttcaccagtctttttttagtattaggcaactaggattctcccaggatgcagtaataaagaacaaagatggaaagtaagagaaagaggtagaatgacatgaaaatctgatccagaaggtgcaatgtctgttttatatgagtaccagaatgggagaaaatgggagggattataatcaccaaaattctaaaggaaaagttatgtaaatatctaataataaaagctaacatttaattaagcataatcctcattcaacagatgaggaacctaaaaccgaaagagtcattatcactgttccacttatttctatatccttacaaaaatacccactcttgatctgtaacaatgtctccttaaactccctgaatggcagcttcaggtaaaaacttcccagaaactttgaaataacaaggataaaaggaaaattcttggagccacataaaaaagaaaacagatcattacaaaaaaagaagaatcgggcatcagttctcattatcaatactgaattaaaaagaaacccaaaaaaaatcattatttttctaggcctataaaaaattatttaaaaccaaaattttaatgtctgttaagctaacattcaagtccatggataacaaatgtaaataggttaaattctctagtaaaagatagcaactttcaaaacatgcaaaatatactacataacacatatacatattttacatattactacagacttcatttatgtatgtgtgtgtgtgtacacatatataatatgaaataaatgaaatactttggatatttgtccccgccaaaatttcatgttgaaatgtaatccccaatgttggaggtggggccttatgggaggtgtttgggtcatgggggcaaatccctcatggcttggtgctgtccttgcgataacgagtgagttctcacaagatctggctgttcaaaagtgtatggcatctccacccctctcctttgctcctgttctggctatgtgagatgcctgctcccccttctccttcaaccatgatttcaaactttttttttttaatttatatttatttttttgagacagagtttcactctgttgcccaggctggagtgcagtggcctgatctcggctcactgcaacctctgccccgcaggttcaagcgattctcctgcctcagtctcccaagtagctgggattacaggcacctgccaccgcgcctggctaaatgatttcaaacttcttgaagccctcaccagaagcagatgccagcaccacacttcctgtactgtctgcagaatcgtgagccaattaaacctctttttgttatcaattacccagcaacaggtatttctttacagcaacacaggagcagctatatatatgcacaatgcacagtgacatacacaattcaaaaacagacttgaggggaaaaaacacaaacgctaaccaaaaaatgcaggtatagcaataattgcaaagaaatagaatttaaactaaaaagcagtgaacaagtcaaagataatatttcataataacctaagttttatgttacagtgtaaattccaaaagaagccatagtcattaaagtttatacacctaataaatatatgtcacatataaaaagtaaagctgagtagaaataacatgcatagattagactttaacatagctctcaaatcaggatattaagtagatatgaaataaataataacaatgatcgggtttgattcaaacagacacataaaatacacacagatctctgtattccaaaaatagagaaaacattctattcaaatatacatagaattttcaaaaaaaaatccacatgtatggtcgtaaagaaatgtccacatattttaaaaagcaggtatttcctaggttatattcagtaaaagcagatgtgtccctagacctaatacaataaaaattagaaattcacaatataaggataaagtcccaaatctatccactggcaaaatttaaaagtcctttctatataacggcagagtttcaatcaagaagaaaaatcatgtattatttttaaatgattaagaaacatcaaaaaaatctctgagacgtggcaaatgtggtcttcagaggaaaacatatagcttcaaacatgcaaaactataagactaaagaattaaaataaataatgcccaattcaaaaattaagccaataagaatcaacatataatccatgagattcacaatctagggaagtaaacccaccctaatactgtgtttattaaaatgctgttaatgagatccgaggtttaaacaactgttcactttagaaaatgaaataaagctgactgaaataaaacctaatctatgaaattattctgtatatgaattgacctgaagtaatgaacagttcattgactgactcataactcttgttctggtccaggctaatcattctagttggcatactattaaacacacatttctgattgaaacatctgctaaaaaaaataacatcaaacgacattacaaaatcaaaatggagactgctaagagtgggatttttctcctgccagtacctttcctttctgccacattctcctccctgctgccacagtaatctttctgaaggaatacaaatatattctgaatcacacgcaaacccctcaatacagaatgtgtggtaggcagtattctaaaatgcccgcataccaccgaccccaccaaatttcctaccctaatacagaggctgtaaatatgatgaaatatcatggcaaggataatgccattaatatattatatggcaaaggaattctgcagatgtgattaaagccaccaatcaactgcctttgaattaatcaaaagggagatttgcctaatctaatcaaataacctctttgaaagcggagttttctccagctagtagcaaaagggaaattcatagcaagggaacatttcaatacactgttgctatctttgaagataaaaagagccacgaggaaaaaccaaagagtggcctctaggaactgagagtgacccaagccaataggcagtaagaaaatggtgagctcagcagggtgcggtggctcatgcctgtaatcccagcactttggaaggccaaggcaggcggatcacgaggtcatgagatcaagaccatcctggctaacacggtaaaaccccgtctctactaaaaataaaaataaaaaaaaaaaattagccggcgtggtggcgcacgcctgtaatcccggccacctgggaggctgaggcacgagaatcacttgaacccgggaggcagaggttgcagtgagccgagactgcaccactgcactccagcctgggcggcagatcaagaaagaaagaaagaaaatggcgagctcagccctacaactgcatagaactgaattcctcccacacctgaatgcacctagaagaggattcacccccagagcttccacccaggtaacaccttgatttgaatcttgtgagaccttaaacagagagcacaggtgagcctaccctgagttctgacctaagtaaatggatgctgttttaagatattaagtttatggtaattgctttattgtaacagataacaaacagagcagcatttcaaggccctccatgctttggtctctgccaaatcactattacatttttaagatttttttttaaacattatacttacattacacaatgtcttaacactatgaagtaaaaatgtaaatattttaaactctggcttggaaatgaggaggcagaatctcagatattttcctaaaaaaataggagaggcaagctttctgagtccacaaaagtgccctctacctattgggtcaaagaaaaagtaatctctctatttgtaacaacatacataaattataaaccctgaagaaataggtccctaatagctataatctttaacataaccataaataaaaacatgaataaatctgactacatagaaatgtaaaaacttctatgtggtgagaacacacattacagaaaaaaaatcaagtgacaaaaaataacctccaatttgaattacaaatatctagtatcctggatatatacaaataaagcatgtaagttataaaaatgagtataattttaaaatagacaaggatagtttatagaatttcataatttaaggaagacataagttagccaataaactatgggtaatatgcaagaatcagtaagcattattatttgccagcagctaagccaagtactttataagaattactttattcccatctacgccaggcacagtggctcacgcatgtaatcccaacactttggaaggcagaggtaggtggatcacctgaggtcaggagtttgagaccatcctggccaacatggtgagaccccgtttctattaaaaatacaaaaattagctgggcctggtggcaggcgcctgtaatcccagctacttggaaggctgaggcaggagaatcagttgaacccaggaggtagaggttgcagtgagccaagatcgcgccactgcactccagcctgggcaacagagtgagactccatctcaaaaacaaaaacaaaaaaaaaaagaaattactttattcccatctaaccaccaccatttcaggtagatattactatttttcattttacaaatgaagcagagaggttaaatatccttgttcaagcccaatgagtcaggaaatgaaaggaactgaactcaaggagttcataattagttatatacaagtaataaagacaaattcatcgactatggaaatgtactaagtactttgtcttgtttacgtaatggtttttatttaggttgtaagaaaataacatatggacaggcacggtggctcgtgcatgtaatcccagcactttgggaggccaaggcaggcggatcacttgagaccaggagttcgagaccaacctggccaacatggtgaaaccccatttctaccaaaaaaaaaatacaaaaattagccaggcgtggtggtgcacgcctgtaatcctagctactcgagagactgaggcaggagaatcgcttgaacccaagaggtggaggctgcagtgagccaagattgcgccactgcactccagcctgggtgacagagctggaccttgtctcaaaaaaaaaaaaaagaaagaaagaaaagaaagtagccactttggggttagaatccataaaatactctcagtgtcaaccaaaagaaatgtactgcaatgttcatagaacacaattcataatgacctcaaattgaaagtcctcaaaatgcccaacggtaaaataaataaattatagtactcttaacaacagaatactatacatcaatgagaaaaataaacgactggaaggaacaatttggatttatctcacaaatatatacatgaaagatgacagaaaacagtacttagtagccaattatacaaagtacaaagccaattacacaaagtacaaacataggcaagactcacctatgttgttactagatgatagtgcatgtctttggggagttaggaatagtaaccaacaggaggctgaatggaatttctggggcgctattatttgtttcctgatgtgattttagtatatacgttctaatatttggggtattcctagaaatgtgtacctattattcacttgctatatatatagcaaagtgaattttatatataattcttcaacatatttttagaaaaattaagttttttctagaaaattaagagaattttagataaaaactcaacttttaatggaaaatattttcctttttctttctcacatgaaattctatatcaaggttagtatcctacctggtatctctccaatagtgggttaagagtttgttttcttctcaagtaacctgtattatattaagatgatattaactgaaataatcagatagatgaatgcgccataaagctaattctaagatatctgtccttagccaaaagcagaaaagggatacacataacttccacataaaacatccacccccatttttttggttattcttaaaagctcataatgtatacaatgataaaatttattgtttcaaattagggtttttgaaattgaaatattaatttaaacacgtttgcttaacacaactttaaagttaataagaaaacactgcctattacagaagagttaaatacttcaaaaagtgggaaaaaatttaaaagctttcattttagtaggagtaaacacagacacagtaagaatcaagttagttggatacacttaaatcatgtcttttaagaacatgagaacagattatttgctttctctttagtccaaaacctgggtgtaattttagtccaaatttgaaactaacagaagaatactcagcttcttaaaagttttatttcaagaacagtaaaagaacttctggtcttacaaacattacacagataaaacgagtttctccaaacagatgtatgtaaaaatctagtacatatacccccaaggtgagtcaataaggtgaaccagattctggttgaatggaatccttgaaacataactttggtgaacaaactgtttgtgttttccacttttcttaaaaaagaagtgataaagcagatttccagtacctgccaactgataaaatgctacttaccaggtaaaaaccactaccaaaaatcagaatcacagaagggctatcagtaaaattactaatgccacaaattaacatgatgttaactgctgaattatgcatcaaaagagtatttatataatcacagcaaataactcaaatcttttacatcactagtaaactcaaaaaaagatagaaaaaagcaataacattaaatttccttattgatctactagctttaactatttaatactagtacacttagttttgattactttgaaattgaaacaaaaacaataatcttttcttcttttaatgactttttcagttataggaaagatgatattaaaagaaaatatacaactatagcttagctacaggtataaaactgttttaaagatatgtaattgtgctattgaattaaactgaaaacataaatatcaactcatgattttgaaaaaaaatctttatgtttggttttggtaaaaggagagacaaataagtcagaaaaacagaaaatacagaaatagactcacttttccatattcaattaatttttgaccaaggggccaagataatccaagagagcaataaatagtcttttagaatgatgctggaactgctaaataatccgtatggaaaacaaagaaacatgaatcttatctcaaattcttttatcatatgtgtaatttaaccataaatggattttttaaacctacaactaacactggggcaagcaaagattttttaataaagcataaacagcataattttttcaacttccaaaaaattaacaaatgaccaatgtcatcaaaattaaaccctctgctgttcaataaacattgctaaataaatgaaaacaagtcacacattaggcaaaaatatttataaaatgcatctccaaaactgacttctgtgaataatatataaaaaaactcttacaactcaagaagatgacaagtaaatcaattggaaaaaaatggtagagacaaaataacagacatgtcaccaaagatacacaaatggcaaaaaaagacataaaaagaggctcaatctaattaatcatcagggaatgcaaaatcaaacccacaataaattatcactaaatgccaaccagatggctaaaatttagaaacagtggcaatatccagtgctggcaacaatgtacagcaaatggaactctcagatctctagaaacggagaagtatacagacacttaagaaactgtgaaactgttttccaaagttaagaatatatttccaacaagtcagaaattccagtcctaggtatttacccaagaaacatgaaaagatacatccacaacgaagcatgttacataaatgctcacagcagctttatatactggccaaaaattgaacgaaacttaactgtaagctagtgaatggaccaatctcaaaaccattatgctaagtaaaaaaaggcagacagaaaagattctatactgtatggttccattcatatattagtctagaaaaggcaaaactataggaaagcaacagatcggtgattggcaggagctggagtgggaggtaggcagtaacttcaaaaggtcatgagtgaatttatgggtaaagggtctattctgtatcttgactatgatggtaattacatgactgttcatatttaccaaatcacattcaatacacaccttagaaagggtgaattatagcgtatgcaaaatataccttaacaaaacaatggctctcacacataaatttatttatttattgggtaacagcatagggactaatatcagagtaactttcctaaaatgtctcaaatctgaagaaaacgtaaaagctaactaattgaagttacctgtaaataaccaaaaactggctggaatgggaggacattatacccttggaaaaaaagcagaatatcattggctaaaatctatatttaaatagagtttcagtctgggcgcgatggctcctgcctgtaatcccagcactctggaaggccaaggaaggtggaccacctaaggccaggattttgagagcagcctagccaacatggcgaaaccccatctctactaaaaatacaaaaattagctgggtgtggtggtgggcacctataatcccagctacttgagaggctgaggcacaagaatcgcttgaacctgggaggtggaggtggctgtaagccgagatcgcgccattgcactccagcctgggagacaaagaccctgtctcaaaagaaaagaaaagaaaattctacaactaataagtatggtaatttcaatgaaaattttagtggatgggcttaacaagagattggtagaaaattggtccatctccttgaaaatacatgaatagtgtatctattctgaggaactaaaagtaaaaacactgggaagaaaacgaacagaccctcagtaatctacaaaatatcaaatatactaacattcatgtaattagagttacagaggaagaggagagagaaatgagacagaaaaagaataagaaataaaagtcaagcttttcacaaatttggtgaaaaatatcaacttacagtttcaagaagctcagcaacccccaagcaggatgaatacaaagaaaaccacacctaggcacatcatagtcagactgctgaaaaccaaagataaagagaaaatcctgaaagcagccagagaatatcaaaacattattatatacatgggaataatgatactactgacaccacacctgacttctcattagaaaccatggaagacaggaaacaatgcaacatcttttaaatgcttgaagaagaaaaacataatcatcccagaactctgtattcagggaaaaacagcaaaaatgaatgcagacttccacttccagacaaaatgcagaaaatgtacttttccctgttctttccactaaatacagctttaaaaacccttagccgtgatacataagacaaacaaaagaagacaacaaaatgtagagagagggcagaccaattagggcttcaggagccaagaaacaaaagaggatgaattccctaggtttcctttctgactcatatatacaagaaaagttgctagagaagcagacaactcagaaacaccaacaggcacacacatacgtaaaactccaagaaaattctgctgtcttttgtcaaaaaagcagggaagcggcaggctaccaagacaaaaaactcatagacaacaacaaaccagtttaagccaaatggtacaaataaaagcccaagccatataccttttgcaaagacttaaaaggaggacatagtcagccattccccactcctgcccacggacaacatgataccacagcaggccaactgggacacaggacattcatacccactgagcagtaacgcggcttcctccctctagagtgtgggtggaaaaaaagtggggagcctgagttcaacacccacccagtgataaggacatatccctatccctccctctacagagatatgacaggagaggcctattggagaatccaaactcaaagcactgcccagtgataacttaaccacccctccatcccattcagtggaggccaagtgaaaagcaggaaccttttgagccagggtggtattcacaaaggtgtaatgcaagtccagagttttcactcctactcagcatttactaggtgtacgtctccatcaatgagtcaacaaaggcctactaaggaactggaatcttcacatacacctgggagtagtaacaaggctgtgccccacctccaccccaaaagcaaagtttcagataaatcctactaaaagggggtatttaaataaaatgcagagcttcataacacaacacttaaaatgcaaaggattcaaccaaatataacatgttataccatactaagaaccaggaaaatctgaacaggaatttgaaaatatagtcaaaaggtgcaaacaatgagaattcatagatgtcataattatctatcaaagattttaaactatataacactgcttcaacaagcaattacagccggacacagtggctcacgcctgcaatcccagcactttgggaggcagaggtggttggatcacttgaggtcaggagttcgagaccagcctggccaacatcatgaaaccccatctctactaaaaatacaaaaattagccaggcatggtggtgcacgcctgtgattccagctactcaggaggctgaggcatgagaatcacttaaacccaggaagcagaggttgcagtgagctgagatcatttactgcattccaacctgggcaacagagcaagagtctgcctcaaaaaaaaaaaaaaaaaaaaaaagcaattacaaacatacttttgaaacaaaggaaacaatacaaagttttgcaaagaaatcaagaaagaaacaaataccaagttgaaaactaaaaaatatgctaacaaaaataaaatacaaactaagctgaacaacaaaatgggagagattacccaacctaaacaagagaagaaaatgaactgatttaaaaaaaaaaaaaaaaaaaagtggccaggtgcggtcgctcaggcctgtaatcctagcattttgggaggccgagatgggtggatcacctgaggtgaggagttcaagaccagcctggccaacatggcaaaaccctgtctctactaaaaatacaaaaattagctgggcatggtggcacacacctataattccagcgactcaggaggctgaggcaggagaatcacttagacccaggggcggagtttgcagtgagctgagatcgtaccacttcactccagcctgggcaaaagagcaaaactctgacaataaataaataaataaataaatattttttttttaaaaaagacattaaagacacttgtgggactataataagtgatgcaacattcctgtcactggaatctcagaaaaggaacatgacgcagctgaacaattattcgaagacccacagattcaagaaattgaataaatcctaagaggatacacacaaataaatcaatgctaatatatatcataaacttctgaaaactaatgactaaactaaaaaaccctgagataaataagagaaatgacaccttatccacagatgaaaaacaactcaaatgacagcagatttctcacctgaaaccatggaggccagaacaaagcagcataacatttttgcaagtcctaaaagaactgacaacaaagaattctatatccagcaaaaacatccattagtaatgaaagggaaatcaagaaattgtgagatgaatgagaactaaaaattagtcatgagacaaaactacaccaaaagaatagtgagaaaagttattgaaccagaaaggagaatgataaaaagaaggattctcagaacatcctgaaggaagaaagaacaaacaaatagtaaaaatatgggcaataaaacagactttactgttccttgagttttcaaaataatgtttaacaattgaagcaaaaattgttacacgatgcaaaagctatggtgggtaaaactgttgatgcatttccaaaactgaaagcagttggcaccaagctgtattagaagttgtcacattctcaattggcactacaactacagtaaaaataatgtagagtatcattgagaatatcactgatgaagcagcaaaaatcattaatgttttaagtcttgatccatgaatacacatcttttaattatctatgtgacaaaacgagaaataaagagtaaaataattgttacaccatagtttttcttgaggaaagaatttgtgatcatgtgatttataaactgaaataaatgcttttttcatggaacaccggttttacatgtaagaacaaataacaaaccacaattattaaaacttgattatctaacatatttcttgaaaaaaggaataaagtgagcctgtcacttcaaggaaaacaacttagaacatgagtggacaataagaagatttgaaaaacttatatccaacaatgtaagcttaactaattccaatacttaaagacttttctgatgagatcagtggattataacaaatgtgaattttgttatttattaaaaatgtgtaggactaggcaaggtggctcacacttgtaatcccagcactttgggatcactggaggccaggagttcaagaccagcctagccaacatagtgaaaccccatctctactaaaaatatgaaaattagctgggcctggcggtgcatgcctatagtcccagctactcaggaggctgaggcatgagcatcacttgaacccaggagacagaagtgagctgagatcgcaccactgcattccagcctgggcaacagagtgagattctgtctcaaaacaaacaaaacaaaacaaacaaacaaacaaacaaaaacaaccgtatcaatagttggaatatctggatcactcagtgaaccaatattttccaaagaccacttagtaatcttataaaatcatatatgggtaaaagatcccctgaaattgcaaggtagtctaataaattttatatatatatgtgtgtgtgtgtgtgtgtgtgtgtgtgtgtgtatgtgtatatatatatatatatatatatatatatatatatattttttttttttttttttttttttttttttgtctgagatggagtctcactctgtcacccacgctggagtgcagtggcacaatctcggctcactgcaacctccaccacctgggtttaagcgattctctgtctcggcctcccccgtagatgggactgcaggtgcctgctaccatgcccggctgatttttgtatttttagtagagacggggtttcacaatcttggccatgctggtcttgagctcctgacctcgtgatccacccgcttcagcctcccgaagtgctgggattacaggcgtaaaccactgcgcccggcccataaattataattttaaagggtaaagatataaagttcattgatgggattgcagtcttcagattgcaccaaaccacttgaaaaacttgcgaaactaccacttctcaagctttggtttagtatcaaacaagaatattcattagggcttgtgctttcattcttatagtatcttttaataaacagaagttatttctcaaatgtagttgaatgctccaatattttcctttacattcagtgctgtatctcaagaactcttttacaaaaatattatcctatattatctttttaaatataaataaaaataattatctttttaaaagcttatgagttcaggtagaaatatgaagggctaaaaggaattggaagacattttcctactatttgttctttctcttgattttcatgattcattattcttgtagaagtgaccttaccacagtataaggttcacttataatcactgttctgccttgtaattttaggtgaatttgttacaaaatattatgaaatctacaggaaaagccaactttcaaagctattaagtatttgacttaatagttgagggcattattattcagaaaaatttcaatctcattccgcagcgcaaaaaactgcaataaaactttaccactgccaagtcactaaattgctatgtagaatggcaattcagtatattctgcctctatatctaacaaaaattcataggatttgatgatgaagtccacaaatgcaagtcaaaatcactgctgacactattatataatagttcactaaaacatgacagatttaaatattttctgcaaagtacctgctaataaataatacagtaaataatcaggctttaaacacctgacatttaacaagctttgtaaatttgtccaactcaagtctttctgctccacagttatttttgccactatcaactgtaacgcatcttagcggattccacttcaggttgtactaagttagtgtttgctcaacttttctgaaaatattttctcttgtagttgtttcacatagactatgcataaacactaattcttccatcacttcaaactcagcactaacttctggagtatgtaacaactgaacagtactggtaacacctattcatccatcaaaagcctaagaaaaccatgaaaaatcattcacccttctttccaaaatgacttgatattactcccaacgtccttaacttttagagcaattactctcgctgaaaggctaatagtcttttttaaagtttattttctatggacacatctttgtttaccttaataaaacataatttaattaactactgttggtaatggttttccttgcttggctaacaaataagccattgaaaaacttactttaattatagcctaatttccattttttgtttttgagaagaaattctgctgtgataaaattttgttttaatttactatttttttttctgaccttttagttttattcctgttggctgggaatattgtgagaagtgccaagtctggtaatgctgacatatattatattcttttagcacagccatagtcttctagcataataaatataatgctttgctatctaatttgttaataataatatacattccactatacctctaaagtgttacatataaagtccacttttctccttttcttgttttaacatgataggtgggtatgcactggtaatgagagaaataaataagatgccagggcaatatgtgtggcgcgcacacacacacacacatactgacaaactgtaactatgtcattgtgattcgtagcatgcagagcagcaatttgaaatatatgtgctctctgcagcaaccaactctgacactgtagtgcaacagaagtcatatataatgcccaaataaatgggtgtggttttgttcccataaaacattagttttaaacactcatacctgaatgtcgttatgatttcctgtgtcataaaatattattcccttttaaatttttttcagacattttaaaaggtaaaaaacatttttagctcatgtcccacataaacacagctggaggaccgaatgtgaccccacaggctgtcatttgctgacacctccatccacccctctgtagccttcagggtcctaaataaacttctatagcatttaatgacccctaaattccctttttgtcttcccagctctgcagactgccagaagcttctcagcttttcaacctctcagctggatttttttgaactgagtaattaactcaaggggaaaagaaaatttaaggtcaggccaaactctgcacaaccttaccctctgaattctcactccctcaggtcctcaccactcttctagttttctgatcccttaaatatttatttgaaacaacattttatacagcttttctaattgttctcagtggaaaggctagtctaaaccaagtatctctgccataggaagaggtggaaataacacttatactaccgaatagaaagacttagtataaagctacagtaacaatgacatcatgatatatcactgggattctcaaatacacaaagaataaaacagagaacctaccaacaatctaaaatacattgaacgtttgctatataataggttatatttcaaatgtggaggaaaaagatgtttcaataaatggtgtagtaacaattggctgtccatgtgtgaaaaaatgatactggaccccttatatcacatgatacacaaatcaatttcaaatagataaaacacacaatagtgcacaactagagaaataagtttttgaagtatattttcaaaacaagttagaaactgttaaaaggtttttaatttttgaaataaaaacattaccatggttcaaaagttcctaaagggtatgcagtataaaatcactttgtatacaactatataaaataagtttcctacaggcaaagaattttaccagtttcctatgcatccttcacaagatattttatgcagatgtaagttcatattattctccacccctcccctaaactttacattcaaggggtcctttacaataccaaagaataccacccacctcatcacaaaggtaagttcatttctttaaacttatttaatactaaaaagaaagattaaaattaaattgagacatcttcattgaatgggcctaccaaaatttaactgtttttaaataggcatacaaaactcttaattttctaaaacaaatttttcagcttcctcttagctccagagtcaaggtgtcaaggtgacgggaaataaacatattcattcattccctcattcattcatttttgagacaaagtctggctctgttgcccaggctggagtgcagtggtgcaatctcagctgactgcaacctctgcatcctgggctcaagccatccctcccacctcaacctcttgagtagctgagactacaggtgtgcaccaccacacctgcctttttttttttttttttggtacttttagtgaaaagacagggtcttgtcacattgcccaggctggtctcgaacttgtagctcaagttatgtgcctgcctcagcctcccaaagtgctgggattacaggtgtgagccactatgcccagccacatcaatttttaagtagatatatgcctaacggcattccaaggtcaaataaatatctaggattatcttgctgtaccgacaccttgcacttaacattgtgatgaaataatccattgttaattttttgatgccttccttctatccctgcatttcagagtgaaaagataaaacaatttcttactgtgtacatgatgattgagtactgacaggtaacatgacctggggaagaagtcacttgacattagctaacaatgtcagagacagattaagaagtgaagactcccgattgcttcccattaaaaataataattatgaccaggtatggtgacatgtacctgtagtcccagctatgtgggaggctgagctggaaacattgctagagttcatagttgcagtatactatcattacatgtgtgaatagccactgcactccagcatgagcaacacagcaagatccctctctgccggacccgccactcccaaaatagaagactctatctcttaaaaaataaatattattaggttttatttagaaacttttatttagaaaatcttataatacaaaaacacacttgagaggcatttgagattattgaccatacctccttaaatctattaatccaaactactataatttctactatacttcctgtaacttattctgtgttaacatccaccttttcactggttcttcctcagagcattgaccaaaggatcaatcttccatcttcttttctcttcttgttctccaaagtcagtttgatttgccaccactgctagttaggaaaactgtctatgattcctaccctgacatttagtgtcaaagccatttcacacggtttcaggctcagcacaaccaaacaaaacttgtgatcttccaacatacttagacttgaaaaaaaagacatctgcagttcctccatctaatttataaagaatcaaatactatgcattctattacaatatttcatctttatgttttacacataatacctaaactcaagattttacactcattggcctttaatttatagcagtaatcctaaatatgtttgtcttcaagtaaaccttttccaattcaattacaaagggctgggggaatttagatcatttaatactgctcttcttatttaaaaggtacattactgaaattcctcatcttggtatgcaaagccaaggaaattttccattcctgtcccctagtattctctaccctacttattctccagtcattcttacgtatgtgccatttttccaaaatccatataccctcatagtttcaaaccctgtaaagggtgaccctctgtctagaatccctatgttaatctactgaaacttacccatcctccaagcaccaccttaaatctttccttctttaaaaatattttcagattccctcagttaaaacatatttccaataatagacactgtttattgcctataaaatatccattccccctttttccttcctacagatttccactttttcagatacgcaccctgctctaagcagaaacatgcttcagaggggctaaatactctccccagcctcagaggaaagccatcatggctgtctcaacttctttatcagttattggtttaagatatgaacgctcggctgggcgcagtggctcacgcctgtaatcccagcactttgggaggccgaggcgggcagatcacgaggtcaggagatcgagaccatcctagctaacacggtgaaaccccgtctctactaaaaatacaaaaaaaattagccgggcatggtggcgggtgcctatagtcccagctactcgggaggctgaggcaggagaatggcgtgaacccaggagacagagctggcagtgagccgagatcacgccactgcactccagcttgggcaacagaacgagactccgtctcaaaaaaaaaaaaaaaaaaaaaaagatatgaacactcaaggtaattctagctaataaaatgttaagaggaatatgccaggggcagggcgtggtggctcacgcttataatcctagcactttgggaggctgaggcgggcgggtcacctgaggtcaggagttcaagactagcctgggcaacatggcgaaaccccatcccatccctactaaaaatacaaaaattaaccgggcgtggtggtgggtgcctataatcccagctactccagaggctgaggcaagagaatcacttgaacctgggagacagaggttgcagtgagccgagatcgcgccacttcaatccagcctgggcgaaaggcgaaactccatctcaaaaaaaaaaaaaagagagagagagagagagagaaatatgctaggatgggacaagcatctggcaaggatttttccttaattaacataataataaaaaggttcctttttcctttctgcctctgaatgctatcctgagagtacaatgcttagaggtcctgcccactatcttttgctcatgagaggaactggatcaagaaagagaccaatatgttctggatgcaccaagaaaagatgttaagaccctgacaacttgttatcatgaagctactgaactacccatcaccctaactcctaattttctattgtgaaataataaacttcttagttacttgcataatacttctaattctgaccaagatggagtcacagagaccggattatcggatttacgctcctcctgaaacaaccataaaaaatgaagacatggcagggcatggtggctcacacctgtaatcccagcactttcagaggctaagacaggtgcgtcacttgaggtcaggagtttgagaccagcctgacaaacatggtgaaatcccatcaccactaaaaagaaagaaagaaagaaaaagaaagaaagaaagaaagaaagaaagaaagaaagaaagaaagaaagaaagaaagacagagagagagagagagagagagagagagagagagagagaaagaaagaaagacgtgaatatatgtgaacatatatatgctatgtgaacatcaggcaacaaaggactgtagagctttgagaaatgagaaacaaaagaggtgagccctacatatgccccagcacacaacgataagagtttccaggccatggcatagagagtggcaactgaggcaaatctcagctgactcctgagttggaaagagaaagttaagagccaggagagaaaaaagcagcaaggaataactgcacagaatgctgagaggagacagttgcatagaaaagaaccccagaggtctatagagatcttctctcaagcattcaccagataactgatcagcatatgcatatgaggaaactatgagaatccagaaaaagaaccatcagaaacaatgggagggaacagggcctgatactcatacaaagccaggaatagtatctgttcccactagccaaactgggaaaactattaattcatggaacattcaacagagtccacagaaagtcttgcctcagtggtgaggaataattagtcctggactaagcactccttcatatctgtctaataaatcataaaaacaaaacccaaaagaatgaaacggtttataagtaactcaactacatctcaaaacaaagctcaagaagatttatagaataaagaaaatagccagaacccaaggtaaattttacaactaaataaagattaccaggcataaaaagcagcagacaatcatgatgcaaactgaaaataatcaatcaaaactgacccagaacttaaatagatgttaaaattagcagaggaggacattcaactgtttttatacatgtatcccatataatcaaaaagttaaatagagacatgggagataaacaagaaaagccaaaatcaaactttcaaagacaaaaacatttgagatgaaaattacattggatgaactaaagcagattagaaactgcagaagaaaagattagcaaacttgaagatacaagaacagacactagctaaagtacaaaaagaaaaaaaaaatcttaaaaagtgatttttaaaaagcatcagtgagcagtcaggcaacttcaaatagcctaataatatgcaggtaactggagtccccaaaggagaaaaaagaggaagagaaaaaaaatacttgaagaaacaactgctgaaaatgttctagccataaaaagacctattaactcacggatccaagaaactcagcaaaccccaagcacaagaaacatgaagaaaattacattaagggataacataatcaaattgttcaaaatcagggatatattattaatagcagctgtataaaaagacatgttacctatagaagaacaaagataagaacaacatcagatttcttttgagaaacaatgcaagtgagaagacagcagtacatctctaaagttctagaagaaaaaaggccaactagaattccatgcctggcaaaaatatctttcaaaaatgaaggtgaaataaaggcacaccagaaacataaataatgaaataattcatcaccaggagactttcactgcaagaaatgttaaaggatattctccagaaacaaaatgatgtcagatgaaaatctggatcaatacgaaggaataaagagcaccacagtggtaactatatgagcaaacatcttttaaattttttattatttaaatctctaagagatatatgtttaataaaagacagcaaaatattacagagtttataacatatataaaagtcaaatgcatggcagcaatagcacaaagtgcacgagggaggaaaagaaagcaaatgaaggaatgcttttattatagatgaagtgtacaatattacttgaaggtagacctctctaaatgtacactataatcttaaagcaactacaaaaataatttttaaaaacaggtaaaagtaataaaaagaggcaaactggaatcataataaataatgtaggctgggcacggtggctcacgcctgtaatcccagcactttgggaggccaaggtaagcggatcacaaggtcaggagatcgagaccatcctggccaacatggtgaaaccccgtctctactaaaaatacaaaaattagctgggtgtggtggtgcacgtctgtaatcccagctactcaggagactgaggcaggagaatcgcttgaacccaggaggcggagactacagtgagccgagatagcgccactgcactccagcctggcaacagagcgagactctatctcaaaaaataaataaataaataaataaataaataaataaagtaaaagaatccaagaagaccaggtgcaatggctcacacctgtaatcccagcactctgggtggccaaggcaggagactcacttgagctcaggagtatgagaccagcctggacaacatagtgagaccccatatataaaaaaataaaacaaagtagccaggtgtggtggtgcacaactgtggtctccactattgggaggctgaggtagatcacttgagcctagcaggtcaaggctgcagtaaggtatgatcacaccactgcactctagcttgggtgacagagtaagaccccatcttggcaggtgggggatgcaagaaaaatgatgcaaggaacagatagagataaatagaaaacatataagaagacaatcacattaaatgtacatggtctaaatacccccaattaaaaagcagaggttttagaccatatacatttaatgtgattgtcttcttatatgtttttatcagagaaataaaactatcgccttcaagaaacacaagttaaatacaaagatgcaaacaggttaaaataaaagaatggaataatatacaccatgcttacgctagtcaagagaaagctagagtagaaatactaatatgaggcaaagcatatttcagagttaaacacaacatttttctactacttgcagtcaaaagtatcattaacagtctctttactctgctcaaagttacaaagttcttttgtataaacattagaacacttatcacagcctgtctataatggagaataattcaatgttatatactatacaacactcttactatagtccattagacagaaatatgtagcatttgagacaccttccaattataaaactctatgcaaacaaaaattaacaaagcagatctgagactattacattatcctgtgaaggagggtctgtctgtttgcacagttggtcctaggctggcttctgagaacttgaatttcaagagggttccctaactggtaatcatggtttactatatctagactatggaaataatgtggcttatcctgctattctttttatgagtctggaaatttcacacatgctaggcagagagtacacctacatgaccagcctagataaaaactgtgtttcttgggcagtcacatatgttgttgtattttcgttaagggggaaagaaggtagtctgtgtgatcctcatggaaggcacagcacataaggaagctggtacatggatttttccagactctgtcagtgtcttttgccattgaggtctttctactatatatccatactatgttacagtaataaatcttagccattacaaccctaagctgatcccatgagtccttctagcaaatctccaaacatggaggcagtcttgtggacccctgacacaaatatatggttgtgatctcttaaggtttatccttcctcttaaactataaagagctggccgggcacagtggctcacgcttgtaatgccagcactttgggaggctgaggcgggtggatcacgaggtcaagagattgagaccatcctagccaacatggcgaaaccccgtctctactaaaactacaaaaagtagctgggcatgctggcacacatctgtagtcccagctactcgggaggctgaggcaggagagtcgcttgaaccagggaggcagaggttgcagtaagccgagatcgcgccactgcactccagcctggtgacagagggaaacttcatctcaaaaaaaagaaaaaaactataaagggctgggcgcagtggctcacgcctataatactagcaccttggcaggcccaggtgggagaactgcttgggcccaggaattgagaccaacctggaaaacagagcaagaccctgtctcctaaaaaaaaaaaaaaaaagaaaagttggccgggtgtgatggatcacacctgtagtcccaacactttgggaggccgaagtgggcaaatcacaaggtcaggagttcgagaccagcctggcccacacggtgaaactccatctctactaaaaaaaaaatacaaaatattcgctgggcatggtggtgggcacctgtaatcccagctacttggaaggctgaggcaggagaatcacttgaacccgggaggcagaggttgcagtgagccgagatcatgccactgcattccagcccgctgacagtgtgagactccatctcaaaaaaataaaaaagaaaagaaaagaaaagttagccaggtgtggtggcatgcatttgtgatcccagctactctaaaggctgagacgggaggactgcttgagcctaagaagtcaaggttgcagtaagccatgatcgtgccactgcattccagcttaaacaactgagatgctatctcttaaaaacagaagtagaagcaaacaactataggggaaaatgagggatacatactttaagaatttctaaaaatttacatggaaaaacactaggattctatagaaaataaaacagtattaaataacattatttataaaatagatactagcaaattaccttacgtaaagattcaagtcagtaacttaaaggatcttacataaaagtactttccattggttggaggagagacttttactatacactgtttttcaacttttttagacaaattacatttagaagtttaaatttgcctatctacattcttaatgtgaattgccaccttactataggaaggctatttttgtttctgcagtctacaaaaagaacaaaaatattaaaaacgtacaactcttctcacagaactaagttggttttacacaaagacatctggcacaaaatacaatgaaatttcaatatagaattacagcaggggatgagggtggagaaggaagagattaccaattctatgaggggagacaacagaagtatttttttaatgtcttattttaagagtaaaacacctggttttttttgagatggagttttaggcaggagtgcaatagaacgatcttggctcactgcaatctctgcctccaggattcaagtgattctcctgcctcagcctctcgagtagctgggattacaggcacacgtcaccatgccaagctaatttttgtatttttagtagagagggggtttcatcacattggccaggctggtttcaaactcctgacctcagcctcagcctcccaaagtgctaggattacaggcgtgagccaccatgcccagccaacactgaacattttattcagaaatagttaagaaaacagaaatatacattgggggtttatggattacttctttttggggggcaatactgggaatagaagagaaaggagcttcctttccctttccttctttcattcattcattcattttgagaagaagtcctgctctgttgcccaggatggagtgcagtggcgaaaactcagctcactacaacctccacctcctgggttcaagaaattctcctgcctcagcctcccaagtagctgagattacaggcacacaccaccacacacggttaatttttatatttttttagtagagacagggttttgccatgttggttaggctggtctcgaactcctgacctcaggtgatccacccgcctcagcctcccaaagtgctgggattacaggcatgagacgccgcgcctggccaagaaaggaactttagataaataaaatgattaaacatttgtagcatgtagaatgaaaatattccctcagtaatactcaaattatccagatttccaagatgttggtagcaccctgagagcttcaaaagggaaattaaaagaaaaacgacgttacccttcctgaaacacagattcactgtttgccatgttcttttctctagtaaaaaatgaataaagtttcccctggaaaaactaaaaacaatctgaggtatgtttcagagaaaacaaaattgcttgacaaaaatgccatgttaacaaccgaggaaattactttaaatatattaattttaacacaggaataatatgtcaaaccaggatttctcaacctcagcactatcggcattttaagctgtatagttttggtgtgggaggctgtcctgcatattgcagaatgtttagcggcagtcctggcctctacccaagaggccagccagtaggacctacctcctcattcaagctaatgcactaaattttgcccttcattgacaaatcccattaatgcatgtatttatcccattagtgactctcttgtgttccagatactttgttaggcaccagagaaaatatgataaagcaaaacagctattttcctcactctcatggtgcttacagccatggtgggaaaaatccatagaaaaagactcacatacacaaatgcagacagaataaaaaactcacacaaacaaacgctgcagatgttaagttacataaaggagatatgcatggctgtgcatggtggctcatgcctgtaatcttagcacttggggaggccaaggcaggcggatcacctgaggccaggagttcaagaccagcctggccaacatggcgaaaccctgtctctactaaaaatacaaaaattagccaggcgtggtggtccacgcctatgatctcagctacctgggagactgaggtgggaggatgacttgggcccaggaagcagaaggtgcagtaaactgagattgcgccactgcaatctcagcctaggagacagagagagactatgtctccaaaaacaaaaaaaaagagagagaagacatacatattccactgagaatgtataataaagctgcatactcaaacatttcttattaaaagatgtgcacaatcaaaaaatttacaaaatactgcaacccctcacctgagctttatagtatctcattcccttccattttcttagattaaaaagcctaattctaactttggtttattttaatacctagtttctatggctctcataggtttaaaaaaacaggttctccccaaaagtaaaatgatctaattagaagtagtacatgatttctgcaaccatttttaaatctcaaccgaaattatcaaaatttaagcaaataaaatttcaccctctctaataaaaatattgaatgtttaataaatgggcttaaaccagagctctttagaatattttaaacatatcagaaaattccatgttcaagtttcttttaaggtgacaaacatgagagttttttgttttgtttttacaaccttcattatttctgacaataaaatatcaatataaatagttcaaaacatctgttttcaaaatgttcaacgccccaggacatgtttctttgaaaagtcactgcattctcaatgttgaaatgtcatctttatcttgaaggggcaggttaagtgtttgttttctttgaaaatagagctaggtatcagaatatactcagctacataataaaggtcagcaaatttcatttttcattttttattttaatagagacgagatctcactatgttgctcaggctggtctcaaactcctgggctcaagaaatcctcccatcttggcctcccaacatgctagaattacaggtgggaggcactgcacctagccaaggtcagcaaaatcgaccttttggcaaaataaaaacgtcttctaagttcaatagctatatcgcccctagggaaacttttgtgatagcagaaattttccttggctcctccttcccaatcatttctgtagaactgtaaagatttgctctatttagagattaagtatataaactttcatgtaattagccatattgataacctccagtaacacttttgggtacttagaacttatttgctgcctatgaatgattccatgaatgatcttcagtgctattaattagtctacaaatattcactgaggaataaccaaaacagaaaaaaaccccatccgaatggcactagtatactagtgagagggagatgaacaataagtaagattattacgtgaatatacactctgtcagaggtgataagtacgaaaaagaaaacaaaaaagcagatattatgggaaggcatttgaaatctttgacagcaagcctagcaaaggcctcactgtaaagtcacgcttgaataaatacataaaggatatgagggggcaacacatgcattatgaaaggccctgaggtggatctgcgtctgcgtacttgagtaagaccaatgaggtcagcatggctgaaggaagtaaatgaacaaacggttatagtgaaagatgtctgagaagtatacgtgaggtgtggtgaagatcatgtagagccttacaggttagcaaggaatcttttttttttttttctcagaataaaatgggaagtcactgaagagtgttaagtagagcagtgacatgactggacaatctatttacatcagtatggactcgtgtacttattctatggatgaaaatgcaatattatcattatttttgtggttgctaaaattggtccagttcttaggagctccttcaggtaggttcccgtgctttgaacaggttttcatctttttaagcacttcattactttctggcaccacaagatgatctaggcttaccttgtattttctctgcaccagtcccgtaaggaactacttctcaaggagccctggttcctttcattgaagagcaatggttggagaccaagatctaagcactaggtattctcaatgctactggggtgtcattgtttctatgccctctcaggggatagaggtaggaaatacacatattcaaattaactcatacatatgcacacatctatatttctgtatgtctgtgtaaatattaaaaaacatgagtttattttcatacttctgatctcaacactacagcatgactgtacagttctttttgcctctagttttatgttatttaatcaagacactattttctacagttacttaggtgagttctttccctccctatcctcttttatgtgaattttactattcctttttgggttctcctgcatctgggtaggtggtaattgcttatttggtctcccacatcctggttggtggcaattgcatagaagcatttaaaacattcctatggttctaagaatcagagttatactgacaaatatactctgagaagtgccactcacatttcatccatgctacacagatctccactcccttcttctccctcccactccctacaggtaaccaatctctagtttctgatttatctgcatggtactccattatatggctatatggatgtaacacagtttattcaaaccttctcctctgtgtgggcatttagtttgtttccaatatttcgcaaattaaataatactataattaataacattaagtaatacataatttgtattgttagaggcatattcagcatagattcctagaataattgagaggtaaatgcatacagtttgttaggtatcaccaaatttccctccaaaagatgtgtaccaatttgcatctgcagcagcaaagaatgagagtacctgtttccccacagccctgtcaacaaatgtgttgttttatgtttgaatttttgccagtgagacaagtcttcctttcttgagacaaagttctagctaactggtccatcttgtgcctatttgataatgaagaataatgaacaaaagccaggcgtggtggcacatgcctataatcccagtacttcgggaggatgaggtgggagtatcgcttaagctcaggagatagagactagcctggacaacacagcagaacctagcctctacaaaaaatttaaaaactagttaggcgaggtggcgcatgcctgtggtcccggatattcgggaggctcgggggagaactgtttgagcctgggaagccaagggtgccaatgagccgtgatcatgccactgctctccagcctggacaacagggtgagaccctggaaataagggaggaaagaagaggaaggaaggaaagaagagggaggaaggaaggaaggaaggaaggaaggaaggaaggaaggaaggaaggaaggaaggacggtaggaaggaaggaaggaagaaagaaaggaaggaaggaaggaaggaaggaaggaagacgaaggacagaagaggaaggaaagagggagggagggagggagggaaggagagagggagagagggagggaaggagggaggaagggaggggagaaggaagaaggacaaaacaaacaaccgtacaaatggcgacacaaaactgacactcctgtgagttttgagtgattcaatctagtggagaggtaaagatttgacagagttaccactagatcccttctaatccccacatggtctaccaactccaagtactcaatctgcatttaacttgcttaggcccaccaaattctaatgcctaaacaaagtcggaagggatgcaatgtctcctaagggcttgtgattcctctgccagtggtaggacacagtcttcatctctaaataccatttaattattaatcagtaagaacaaaaatggtaacttctgtccaaaagggacagagtgaggcaagttttcttttaactaccttcctagcaaacagaggtaggaaatacatggacacatacaaactcatgcaaatacatacacctacatttctgtactaagtatcaaacactacgagtttatattgattcctctggttctaatccaccaccaaaaagctcatttagcctttgttaccttccctgtaatacttttcactgtcacaaaatagcccaaaataaaaattacttttatgaagtaattcataaaacagatggttttcactgaaatatcattgtcttaatccagtctctaagaatgttcaggctggggaaaatactattatgcattaaactgttcaaaatttgatgacatatacactttaatgtaaaatttccaaaacaagcactctgacttcactactcttgaggtgatgcttactcatctatgtaaatcagttcattttgataatccaagtaaagctaatgttctaatgattgaatttttacttgaatctaagtccttgtctcaactatacttttgaaagctttgcctatgttctatctattaaagcccatatagtttctaaggtcaaaatttccagttttaatattccattggaagggctgtctcacttctcccaaatatacttgttaaaaaccaaaggggccaggcacagtggcttacacctgtaatcccagcacgtcaggaggccaaggcaggcagatcacctgaggtcaggagttcaagatcaggctggccaacgtagtgaaaccacatctctactaaatatacaaaaattagccggtgtggtggcacgagcctataatccaatctactcaggaggctgaggcggcagaatcacttgaacccaggaagcagaggttgcagtgagctgagatcatgccaccacactccagcctgcacaacacagcaaaactcctctcaaaaaaaaaaaaaaaaaaaaaaaaaaaggaaggccaggcacagtagctcacaactaaactcccagcactttgagaggccaagaagagaagagaggatcccttgggtccaggagtttgagaccagcctgggcaacatggtgagaccccatctctacattttaagaaaaaagaaaaagaaaagcaatttgtagacagcaaagcagtatcacttcacagagtttgctgtctttatagatgggaggaagccgtttcatttgcatttgtttcaaaattacatgaaaatcacaggaaaagctctgaaaaatggcagactatgcacatattactttgatacaatgcaataaagatgaactgaactgctgaccgaactaaaaaaatttttttaatcactttttaaaatatcaaacagaggtagtccacattatggactaatgaccttcaaatcttttcaaatattttctttcattttaaatcattatcaaatagttttgtcttaaaaagttaccacatgaatgtataagcatagtgcaaaattttcatttctaaaattttaatttctaatttaaatgtaaactacttattttaaaagattcaagttcactgagtaacatactacattccaatggcttacacaaattaatttttttttttttttttttttgaggcagggtctcactccaacgcccaggctggagtatggagtgcagtggtgcaatcatggctcactgcaacctcaatctactggactcaagcaatcttcccacctcagcaccccaagttgctgggtctacacatgtgcaccagcatgcccggctaatttttgcataaaataactttttttttttttttttttttttttttaattaaacggagtctctctctgtcacccaggttggagtgcaatggcgcaatcttggctacgggcaacctccacctcccagattcaagcaaattctcctgcctcagtgtcccaagtagctgggattacaggcgactgccaccatgcccagctaatttttgtatttttggtagagaaggggttttaccatgttggccaggctagtctcaaactcctgacatcaagtgatccacccacctcggcctcccaaagtgctgggattacaggtgtgagccaccatacctggcctagaatttctcttaataaaaattaataatttcctattttgagagcttttacactacagcaatcatttaataatcctttcaagtgaacttctgattaaagtgaatgttataaaactatgatttaaatatttgctttgtctacttacttctgtgctccctgagacaacagctttgtccacgttcactaacaatggttcttccatctggcatactcctagtgaccactccacacaacggtgatgagcccaacaagtgcctaaaatgggaaaaatgaaaaggagcaaatgagcaaacattaaaaaaattaaagctaataaataaagacataaaacttcaaaatcaactctaatatgtaaatatacaatggcatcctgtatttgtgatagcagtaaagtggcccttctaaaaatgtggaccaaccactgagtgccagtatcaatatcaaactgagaaattcttagaaatacagaatctgtctgggtgcagtggctcactcctgtaatctcagcactttgggaggccaacgctggtggatcttttgaggctgggaacttgagaccagcctggctaacatggcaaaaccctgtctctacaaattagctgggcgtggtggtgcacgcctgtaattccagctactcaggaggctgaggcatgagaatcgcttgaacccaggggacagaggttgcagtgagctgagatcgcaccactgcactccagcctatgcaacagagcaagactccgtctcaaaataaaaaccaaaaaaatgcagaagcgcagatcacaagtgagatctactgaatcaaaaactcgtgcagtggggcccagcaatctgtgtttggttctgtttttttttgttgttgttgttttgttttggttttgagacagggtctcactttttttgttgcccaggctgaagttcagtggcatgaacacagctcactgcagcctcaacctccagggttcaagcaatcctcctgtctcagccttgccaaatagctgggactacaggcacatgccaccacactccgggaatttttttcattttttgtagagacagggtttcaccatgttgcccagtctggtcttgaactcctgagttcaagcgatccacctacctcagcctgccaaagtgctgggattacgggctgtgagccaccgtgccctgccagcaatctgtgatttaacaagccgtctggttattatgatgcacacacaagtttaagaataactgaattagtgattatttcttcaacaaacaaaattagtttttagtcattttatttaaatattatatatgtatttgatatgtttctggtatctttatataaagcaaacaaagtattacttagtactttgttgaggtgatatacaaaggaaatgtatagaaaataaactacacatacacctctacttccctcatcccacagtgagagcacgtatcaatgattattaacacttcagcctttaaattatccatcacataacacttgaaccactatcagtcaatctgcagttcaactacagaatgagatgtactttaaattccagtagcaccatatcatgagtgctgagttacaatactgttataataagataatctacccggctaagacctattttcattcatgcccaaataaaatagactcagaatgccacattccccaagttctcactttaaaattttcccctttaaaattttctcttttctcaattgtcagatctccatggcaccgctatctacacaagaaaaaatacaagtattttaaaaagcatccagtccggtggtggtactgtacagattttaaatagataaaccttttcttttacctaaccaggcatatttaataatgatttttttatagtatgattataattatttctagatgaaaggtatttattattgaggacattaataatgtattaaaattaaaatgcttccagaattaagaggcagtcattattgaaaacatgcccatacctgtagaatcaaataaggcttggatatcaatggcatctggaagcccaaccagactgagttcatcccacagtttaccagcttgatcatctgaagctgtctgggtgcttacacttacacaagatactatattctgctgaggagatcgttctctgaaaataaaataaaataactgtgaaagtgaaaacaagcagaaaattgtttcatttttaactgtttaaatgcaatgtactgccaaatcaattttaatttatcagccattaactgtcataaaacaacttttagaattcatctgttagtattatccatggtataatattaaactgggttgccatattatatcgtataagtaacaagtaagaaaaagagtctccaaacccacagggaagtattaaattgtaaatttgtttttccattccataatataatgtttttaaaaccaactctcatatcctagtcaggaattgtatttaacacataaactgagtatttcctttggctttacttaaacgcttacaaaacaaaacttgatcaaatcagaaatgtttagtctgctgtatcttgactgaggactgccacaacagaggtggcagttaactgtgtaaagaaaggatattttccagggaaaatgaaaacccactacagagtgtgaaaacagaggcaggaggaatggaatgtatcagctgtagctttcttatggtcccgtcaacaaatctcaacagctggtctgtggcatgacgttgcaagtactctcaatcaagactgtatgtcacaaattggaagtaaaaagcaaaagcaaaatagctaccaaaggcatgtagaataaggaagatagtataacagcaaaaactatagtctaaaaaaagaacattgaataaagtaaacaacatatgggagatttcaggctttcaaggtctaacactttaggtattatttaagaccattaaataaataaaaatggctattgtacttaattattaaatatgggaaatcagatgactaccactaaaacttaaatcttctcctaatatcatagtatttaacctgatcataattctggattaaatcactattgaatatagatcataactcactgcacttctgtatgctggatatttatcatgattcctattaagagaaaatcagcacaatgaccagggtactaaacatttttatacctggaatcattgaaagaaaaaaagtattaacatatttcaataagtacatttaaatatcaaaccatataaaaataaccagtaatgtttttatgttcagcattagaaatgcatagactttttttaaaaggtatagcatgctatgctaactttaaattctcattttaataaatgcccacagtaaaatgagaacaaattctttcctataagtataatctctattcctacaaatatatgctccattacaaatcattgttattttattgggagaaaaaaaaaagaccaacagttcatctataactactaaatgttgttttagcatactgttttgcactagtatttgatgagggaaaggggtgtaaaaaaaccaagagaatgactaatttattactaatcaggtcctaaccagcagcttaatcaaattcaaccttcaagttttgagactggtttgtatgtatataccatatcagtaagatatcaatgtcaacactaaggatgacagcagcccagcttagaaagagatatcaagaggaatcagctgaaatgcatacccacaaaattcttagttataaaacaaaaaaaggaaaaaaattcttgatttttttatttagtgaaaatgagcaaagacattttcaaaacctttgtaaaattgttttttaaattaactagctatttaaacttcattagcaacatacattttgtaaatatttgaaatcattaccaagctaaattaattgcctacccttcaatgatgccaaatttttaagtgtacttcattaactgccatattatcattacttattaagttggtaagcactaagtatatataaagactttcgtttaacaaaggctatttttatataattatctgagctcataagaattttcactaaaaattaatttcacttttaaaacaaggaaatgaaaccaattccatttctcaggagaggattttatataattgccattatttaaggcagaacatgaggatataagatacagcctgattcactccattaaatttgctaatagacattttaagtttgctggccttttgattattttattaagatgtgtgtactcaactgacaactaaagaaaaagctatagcctccaaaacatcacaactctccaaatatagtacttctaagtttccttaaactgttccaccttaaattcttttaaaagattctccctctttttattgtttcatttcctacttcaggtcttcaaggcattggcagcagttcaaaacaatgagccaatcaaataagtacaacacaacaatgatttagtacttaaatttggatataagccagataagcacttgagtgattacatcataaccctcaagaggcagtgttagctttgcaagctaaattaatttttacacattctcatcaactacagaaacttctactcccttaaccagcacagccaagtctccatattaatatggtctttaaacacaactgtacaaaatattttaaactatatcagacaagacctttaggtaattacaatgtgcccgtgaatacagacatacacacatcattacaaaaaaaaaattccttaaaaaagaaaaaagcatcttctgggagggaaggcaggggagggagggagggaagaatgtataggacagtgcaacattttctgaagcacacaaacttatatataaattaaataaatgactgaatggattgatgaatgaatgacacaaaagacatgagtagtgaaaaccaattctggatttgctattgtattatgttatattcttaaaattaaaagcttatttagagaaacaaaagaaggactttattgatctgttttattattacattatttccatttataaattccatgaactccctccctctcagcttgtgttatgttctttgaagttttcttccaaaagtttagttttgtgatcacaccgctttcatatacaattaatataaactttttaaaaaataacaagaaaaatttgtgaaaaggatagtttgttggattaattgggttaatggtgagtcagagtatcccataaatgtggagaacaggagaaactgttcaacaagaacaatcccatttgaaaatttataaacattataatggaaataaattatatgcagtcttaatctattccaacatttaaagtcgaaactgcttactttctctgtcctctttgttttcgtggtgctgagttttgcattttctcataggttccattgctgttgtcatcaatgtccttcttgttagaaggttggtttctccatggcaagataaatccaggcgttattctgaattgttttaagtctccttgtcctaaggaacttttttccccacagtaacaaaaagcgcagagctgttcactagtaaaaatgaaatgtaagtcagagaaggagaaaagtagctttattcaactgctttaagcgataactatagatacttgtgcttttaaattatgtctaaagcacaagctaagcttttcaatctattttctacagtctattcagtgattacccataagaacaattaagtttaataattatacatttggaattctacttttccatagcattttaaaaagtagtacacatatcaaatccaaaaaattctagttagcagttagaaaagttattttcttttatatttgactagaaaaaaatccaagtaagaaagctaaaggtgggggccaagcacggtggctcatgcctgtaatcccagtactctgggaggtggaagttcgagaccagcctgtccaacgtggtgaaaccccatctctactaaaaatacaaaaattagctgggtgtggtggcacacccctgtaatcccagctactcgggtggctgaggcacctcgcttgtatccgggaggtagaggttgtagtaagctgagattgaaccactgcactccagcctgggtgacagagcaagactctgtctcaggaaacaaaaaaaatgcaagttaaaaatgggaaagaaggtagagtttagtagccacccaactgtatgacagttctgtaaaacatatggtgacagttttatttaaccacttgatagaacgttcattatgcatgatatatatataccacacacatgcatacacacggggagatataaaaatataaacttaaatagttcctgggttgagtggtagtagatttttagggaagcagaagagctgaactggaagaaggaaagggatgattaggagcaaaggggattttttaggccagtgaaaccattttatatgatactataatggtagatactgagccctaatgtaaactatggactgtagttaaaaataatgtatccatattggtttaccaactgtaacacagcacacaatactaatcatgagggaaactgctgggggtagaggtgggagaatgagctcaatttttgtgtaaacctaaaaatgctctaagtctattaataaaaaaggagaaaacattaaaaaattaagagacaacaatcaatatacatatatagaatatacacttactaagagatcttagaaagaatgaaattaaaaggactgcttcctcttgattatatttacacttcacaagatatttactgctgctatacccaaatcctccttcttgggcattaaagttacctctacagtatttaccccatgatcttacatatcttgcattaccaggtgatagaactaacctatagccttttgaggtgactttttaaaacttaggtttaaatcatattggactctcaactaattacttttatcaaaattagctttgtttttgtaataaattacctatttcaagttcatgagaaactatgttgtctgctggtaccgagacatacacaaattaaatgtagtgtaatttcaaaaaaaaaaatcaagtcaagttgaaaaagaaaatttcttctttccaaaaagagaccaccaccttatgctttgccagtatcttactatccccttatttgtaatgttctctgagctattaagcttacatttatttcaccatatcccatttctggtttgtttcttcccctagaaacactacccatgagaagcaacaatcagattgacattagtcttatcaacattgattgtaacagcactgattagaaaatggagcaatattttaaagctattgcagaaaaataccttagcattcaattttatattcaaaactatcgcttaaatgtgaaggtataataaaattactctctggcttagaagacctcagaaattttgccagacaacagatcaaaaatgaaaatacttttagagaagtacttaaattattaaagaattagaaaaggttgtatgaagtaagggaggtcaaacacctcagagtaatttattgttgacttttttttaatacgaggtcaagggaaatttctagcttttggtctggctgtagaaagctgcaaacaacattgtgcccaaccacacaacataacccaaccagagaatctgcaaattcacttttctgaaacccatcagagggcagaaatcacaaggcaaccaactcaccaccaaatgaaagacacttccataaagaaatgtgacaatagcacctctgaggaagaggccactgatatcataccagcagggtgataagaactcagtaaaaatttttaagaaattgctagaagccaagtgtgaaacacagtgagactatgttaacacctgtgaccaaagacaggggaattctaacccacacaaaggctcctcttcatgtacctcattagatgtcacgcactacagcaactcagccaggaacagtggctcacactgcaaccccagtgctttgggaggtcaaggcaggaggattgcttaaccccaggattttgagaccagcctgggcaacatagtgagaccctgcctgtattttaaaaagaaaaagaggatgggcatggtggctcacacctgtaatcccagcactttgggaggccgagacgggcagatcacaggtctggagttcgagaccagcccagccaacatggtgaaaccccgtctctactaaaaatacaaaaattagccaggcatggtggcaggcgcccgtaatccaagctactcgggaggctgaggcaggagaatcacttaaacccaggaggcggaggttgcaatgaactgagatcgtgccactgcactccagcctaggcgacagagcaagactccacctcaaaaacaaataaaagaaagaaaaaacatatatacagtgactaaaaaacattttctaaaatagcatacgaaatcttactagccattacaataatgtaaaccaaaaccaccaattaaaaggcaaaaatcaccaattaaaagaccatttttgagattagattaaaattagatctaacaattgggtgcagctgggtgtggtggcacacacctgtaatcccagcactttgggaggcctagttgggcagatcacctgaggtcagttcgaaatcactctggccaacatggtgaagcacacaccacccacccaccccctccccatctctactaaaaatacaaaaaaattagccaggcattgatggtgtgcgcctgtaatcccagctactcgggaggctgaggcaggggaattgtttgaaccagggaggtagaggttgcagtgagccgagatcgcaccactgccctccaacctgggcaacagagcaagactccatctcaaaaaaaaaaaaaaaaaaaaaataggtgcaaaaaatgttggaagtataaacacaaatgacatataaaacaaggacaaaaatgttgatgggaaaagaggtaaaaagataccaggcaaacataaaccaaaaggaagtttgagtggcaataattttatcagacaaaatgaaagttatgtcaaaaagaaaacatgacattagagatgaaaaagatgttacacactaacaaaatgatgaatagtataatagatatcgatcataaccatatactcagaccaacatgaatctggtctcaaaatgaatctcgaatctgaaagagatggttaagcatctccaatctgaaaatccaaaatctgaaatgctccgaaattcaaaactttttaagcaccaacatgatatcacaagtagaaaatttcacacctaagtacttaatataaactttgtttcaagcataaaattacttaaatattctataaaattaccttcaggctatgtgtataaggtatatacgaaacataaatgaatttctgtgggcagcaagccacccaggtgccgaggcaagagaccaagggcacgagctgttccagtataacaaaatatataaaataagaatagttatatagatcatagatatgattatacatgaatatcattaatcattagtttgtagcaattactctttattccaatattataataatcctcactctacaatcataacctaggaaaaaccaggccatacagcaataggagctgaggggacatagtgagaagtgaccagaagacaagagtgcgagccttctgttatgcccagacagggccaccagaggagtccttggtcccagcgtctgggaagacacctgttgccaagtggaccgtggtctagcggtagcgtcagtgtcaaggaaaaacacccactacttagcagaccgggaaagggagtctctaaactcttttagagtttagagaagactctactcctccacctcttgtggagggcctgacatcagtcaggcccgcccgcagttatccagaggcctaaccgtctgcctgtgatgccgtgctgcagtggtcacgctcctagtccgccttcatgtttcatcctgtacagctggctctgccttttagatagcagtagaaaattagtgaaagtactaaaagtctctgataagcagaaataatggcataagctctccctctccctctccctttccctctctctgcctcagctgccaggcagggaagggctccctgtccactggacatgtgacccacgtgaccttacctatcactggagatggctcacactccttaccctgcccctttgtcttgtatccaatacatatctgcgcagcctggcattcagggccactaccggtctccgcgtcttggtggtagtggtcccccgggcccagctgtcttttcttttatctctgtcttgtgtctttatttctatactctcgtctccgcacacggggagaaaacccaccgaacctgtggggctggaccctacaaatttcatgtttatacatgtctcccatccccaaaatatcttattatgtatgtgcaaatattccaaaatccaaaaaaaatccaaaatccaaaacacatctggtcccaaacattttgtttttgttttttttgagatggagtctcactccgttgtccaggctggagtgcaatggtacggtcttggctcactgtaacctccacctcctgggttcaagcaattctcctgcctcagcctcccgagtagctgggactacaggcacacgccacaacatctagctaatttttgtatttttagtagagacggagttttgccatggtggccaggctggtctcaaactcctggcctcaggtgatccacctgccttggccacctaaagtgatggaattacaggcatgaaccaccacacctggcctgtcccaagcattttggataggagaaactcaacctgagtttctcagaacaaaactggaagactaaaaaaattaaatcaacaacagtggaagattttaattatttttctcagaaaatactatgtcaaaccaataaaaattaagtattgaacatctttattgttcattatttattaattacctgagcataataaattagtttgagatactatattcagctctatctacaactaacggttcacattcttttcaagtatattaaaatatttcaagagtggattacatagtaggccataaaagaatacatgatacatagcaagtgaccaacatcatgcaggcaacattctctgacaataatgcagtaaaactaaaaatgtataataaatggataacttaaaatcttctggccaggtgcagtggctcatgcctataattccaacactttaggaggctgaggcaggtggatcacctgaggtcagcagtttgagaccagcctgaccaacatggcgaaaccccgtctctactaaaaatacaaaagttagctgggtatggtggcacacgcctgtagtcccagctactcaggaggctgaggcaggagaatcgcttgaacctaggaggtggtggttccagtgagccaagatcgcaccattgcatagcctgggcaacagagcaagactccctttcaagaaaataaataaataaataaataaataaatttggaaactagaaaagatattgtttaagaatctttcacttaaaatggaaatcccaatatgtgaaataaaatcataatgaaaatactgaatataaaattgatataaaatataaaatactgaatataaaaatttcaatatattactggaagtcctaggcagagcaatatggtcaagagaaagacataagggatcccagtaggaaaggaagaagtgaaactgtctttatttgctgatggcatgatcttatatatggaaaaccctaaagactccaccaaaaaactgttagaactaataaacaaatttgataaagtagcaggatacaaagtaaatatacaaaaatcagtagcatttctatatactaacagcaaacgatcctaaaagaaaattaatgtaataatcccatttacaatagcaacaaaaaaattaaatacttaggtgtaatttcaaccagggaggtaaaagacctgtatactgaaaaccataaaactcacaaaagaaatttaagaaaacatcaagaaatgggaagatatcctatgttcatggactggaagaattaatactgtgaaactaactgtccatactacccaaagtgatctacagattcaatgcaatatctatcgaaattccaatgtcaattttcacagaaataaattatccttaaatttatatggaagcacagaagacatcaaacagccgaaacaaccttgagcaaaaagaacaatgctggatgcatcaccctgtctgatttcaaaacattacaaaatgattgtaatcaaaatagtatggtactggcaccaaaaaaaaaaaaaccatacatctggacaggcatggtggttcacacttgtaatgccagcacttgggtaggctgaggcaggcagactgcttgagcccagagtctgaaaccagcctgggcaacatggtgaaaccccgtctctactaaaaatacgaaaataagccaggggtggtagtgaacacctgtagtcccaggtactcaagaggctgaggtgggtggacggctccagctcagaagacagaggttgcagaaagccaagatcacaccaccgcactccagcctgggctacaaataccaccctggctcaaaaaacaagaagacacatcgaccaatggaacaggaatgaactcacgcatttacactaagttgatttataacaaagatgccaagaaaacacaatgggtaaagaactgtctcctcaataaatggcactgaaaaaactgtatatccatatgcacaagaataaaatcatacccttgtctcacataacacaaaaaatcaattcaaaatagatgaaagtcttatgtttcggatgtcaaactataaaactactagaataaaacatagggagaaagttccatgtgggcaataactttttggatatgaccctgaaagcataggcaacaaaagcagtaatagacaaatgggatggctaaaccaccaagctccttacggcaaatgaaaatattaacaaagtaaagagacaacccacagaatgggagaaaatatttaatatccaaaatatatatggaacccaaataaacagcaagaaaacaacctgattaaaaaatgggcaaaggacctgaacagacatttctcaaaagaacacatacaaatggccaacaggtacatgagaaaatgttcagcatcactactcattagggaaatgaaaattaaaacaagtatatatcacgtaacacctggctattggctaacacctaacaaatggctactattaaaaagatgaaagataagtattgccaaggatacagaaaaaatgggagtcctgtacattgctgtgggggtgtcaattagtatagccattatggaaaatggtaaagaggttcctcaaaaaactaaaaatagaattaccatataatctagtaatcacacttctgggtatatatccaaaggaactgaaatcaatgtcaaaaggatatctgcatgcccatgcttactacagcattacttacaatagccagatatggaatcaacctaagtatccatcaatagatgaatggataaagaaaacatggtatatataaacaatggaatactattcagccttgaaaagcgggaggatggggagtggtggctcatgcctataatcccagcacttcgggaggccaaggctggaggactgcttgagcccagatattcaaaaccagcctgggcaacacagtaagactccatctctacataaaattttaaaaattagcctggtgtggtgagcacacaactgtagtcccagccacttggaggctgtggtgggaggattgcctgagcccaggaagttgagactgcagtgagttgtgagcatggcactgtactccagcctgggcaacagagtgacaccctttcaaagaaaaaaaaaaagagagagaaagagaaagaaaggaaggaaagaaaaaaaggaaagaaggaaggaaggaagggaaggagggagggacgaagggagagaaggaaggaaaaaagagggagggaaggggaggtagaaaaagagggggaggggaagggaagggaggcagggaggggaggggaaggggattaaggaagagtggggagagagagagagagagaagcgggagggacctgtcatctgcaacaactcagatgaatctagaggatatcatgctaagtgaaataatccaggcacagaaagacaaatacggcatgatctcacttatatgtagaatctaaaaaagttgaactaaaagaaccagtagtagagtgatggtaaccagacactcggagaaggtaaggcaggaagaaggaaatagtaagttgttggtcaaaggatatgaagattgagataggaggaataggttttgagatatactacatagtagggtgacctatattttaaaataacaatttggtgcaaaggatacgaaggttgagacaggaggaataggttttgagatacagtgcatagcagggtgacctatattttaaaataactattagtttggtgcaaaagtgattgtggttctgccattaaaagtaatggcaaaaaccgcaatcacttttgcaccaacttaagagtaaatttcaagtaacaaatgagagttaatcaaggtaatggatgttaatttacttgattcaatcattccactttgcattcatgaattgaaacatcacactgtactcataaatgtacaattaggatttgccaatcaaaaataacattcaaaaataataaatgtatcatgaatcattttagataaaatgtatatgttctgagaaaaatataacatgagaaaattggtacaagatgaaacagacagctgaatagaaaaaaatttggaagtggggagcaaatttatggaatacatattccaagaaaaaaaatctttgaattgaactggtaatgacttcattttctagaagaaaccccacagacccatgtaattttatgacagttacttcagacctacatggagtcaattcctgtcttaaactagctgttccagaaaataagaaaactgaaagatgcctcacacacgaggctagtgtaattttgtctccaaaactaggacattacaatattacaaaaattcatattgcttatgaacataaacaaaatattagctaactaaaacccaacagcatgtttaaaaaatgtcataatcaagtaatgtttattgaaagtaatcgagtaatgtttattgcaagtaatcaagtaatgcttactgccttctacagaagcttcttcttattgcattgttttgcttcatttttaaatacatatgaacataagttctttgttagttatatgctttagaaatatttttcccttttctgtcatttatctttttactcttggtatttttcatgaaaagttgtaaatttaagtatagtggtattaatcaatccttttcttttctttttttgagatgcagtttctctcttgtcgcccaggctggagtgcaatggtgcgatcttggctcactgcaacgtccacctcccaggttcaagcaattttgcctcagcctcccaagtagctgggactacaggtgcccaccaccacgcccagctaatttttgtatttttagtagagatggggtttcaccatgttggccaggctggtcccaaactcctgacctcagggatccacccaccttagcctcccaaagggctgggattacaggcatgagccaccgcacccggccccttttctttttatgtgtgttttttttttttgagacagggtctcactatgtcacccaggctggagtgcagtggcaggatcacagctcactacagcctcgacctcctgggctcaagcgatcctcccacctcagcctcctgagtagcaccaccaagtcctactaatttttgtattttttgtagagacagggctttgtcatgttcaagtcaggctggtctcgaactcctgggctcaagcaatcctcctgcctcaacctcccaaagtgctaggattataggcatgagccactgtgcctggccaatcaacccttttctataattagggctttccatttgttttttaaaagtctttccttaccccaaagcaatgaagaaattcctctacattaacttcttttattaatttgcttctcacgtgttaagtctataaattaactggagtagacatgaataaattaggtctttctttttttttttttttaaagtatgtctaattgttctagcacaattgttgaaagagacttccttcctcactaatttgtgatgcccctttgttataaataacctgtccatattaatcatgtatctgtatctgggttccctattctgatccattggtctatttgtctgtttctgtggtaatacagcactgacttaatttattagtgtgttacaaaaagtcttagtatcaagtaaagcaatccttcctcttcttcatgggtcctttggcttatcctgtcttttgcatattcatataaattaagatcagcttgtaaaatttactgtagaaatttttattagaattttcttgaacctacacatcaattgggaaagaatatctttaaaatactgaatcccctaaaatgtgagtattatactgctattatgtctgtgatccttaatctttccaaaaagttttataattttctctataaaagtcttacatttttgcacataatcctagtcacatattattttatattattggaaaatattctaaaaaataccatttaactctgttcctaatatataaaaatacatgtgatttttgcattttgattttgttatctagtaatcttgctaaaatcctattaattatacatattcatttagaacattttatatactgcaccattaaaattcattaaattcaggccggggacggtggctcacgcctgtaatcccagcactttgggaggccgagatgtgcagatcacgaggtcaggagatcgagaccatcctggctaacatggtgaaaccctgtctctactaaaaatacaaaaaaattagccgggtgtggtggcaggcgcctgtggtcccagctacttgggaggctgaggcaggagaatcgcgcgaacccgggaggcggagcctgcagtgagctgagatcgtgccactgcactccagcctgggcgacagagcaagactctgtctcaaaaaaaataaaataaaataaaattcattaaattcaatctgttcatcctattttaaggaaactgtgggacagagagataaaaatgaataaataaaggtcaaaaagtcggagcttggaataaacaccaagtctgtatttacagtatgctggctttctcagtgtacattcactctgtcctgtctaatgaaaataacagtggtagtggtagtatagcccaggataaataaataacaatggcattgcttattaatctacctcaaggttatttttccatgtggcatgagcatcaatctacctatattttttacatggatagccaattattgagtgacctattcttttccactgataggccatgattattataaatgaaattatcatatattcatgagtagcttttaactttcattctctgtacaagtattagatgaggactaacagtgacagtgtgctactcacaggtgacaaaaagataagtcagtcaggcatactgtgtccttaagatctgcagaagaaccaagcaagaaggttaagaactacaatgggttcccgaagtaggcctagaggatacagaggcacagaatactttcagaaggctctcaggcacctgctctaaactagcaaatattctgcattctgtacctctcaataccacatatgcattacaccatttctaatctctatataacacatagcaaaaagtaaagttcatggtagtatcaaactacaaaaatttaagcagaactttaaatgcttttcaatcaactagaattcattattcattaaaaatatattgggccgggcgcggtgactcacgcctgtactcccaacactttgggaggccaaggcgggtggatcacgaggtcaggagatcaaggccatcctggctaacacattgaaaccccgtctctactaaaaatacaaaaaattagccgggcgtggtggcgggcacctgtagtcccagctactcaggaggctgaggcagaagaatggcgtgaacccaggaggtggagcttgcagtgagccaagatcgcgccactgcattccagcctgggcaacagagcgagactccgcctcaaaaaaaaaaaaaaaaaagaaaaaagaaaaaaaaatttatacagcacctaatctccgtcaggaactattaagtgcaggacacagtgtggtgaacaaagcccaccaacaaagtgcgtgtcttcagagttcacatgacagtcaaatgaactgttggaaaataataagtgccacaaagaaaaataaagcaggttactatgtaaaatatggtgggagctgctgttttcttttccatcctactcctttattttgaaaatgttcaaacctcccaaaaaatattggaggaggaggagaggactacagtataacaaacaccagtgtgttctttcgttgattcacattgtatgttctttttcctaagctgactgagactaagctggatgtggcccttcagaggaggctagtattatcagcaaggtagcctctctgggaggtaagccaggagacaagcagagcaagcaccaaagctctcagacagaaaccccatcagcacatttaaaagagtgaggccaatgtggtgagagcacagtgagtgacaaatgacatgagagaggcagtcaggaacagatcacaccttgtagacatggtaagtacttgaaattatgaatataatttaaatataatagtcatgaaagagagtggagagtggggacctgattatcattattagaataatttttgcaactgtgctataaacaaattggactatggaaaggtaaagagaagcagaaagactggttaaaaggctactacaacttccaaaggataacagtgacttcaactaaaatgttaggcaagttaagacactaacaagttgtttgggttatcgagttgagctacaaggtatgagaaaagatagaaatcaaggattaactttcaaagtttctggactaaacaactgagtgaatactggcattatttattgaaatgaggaaatcgtagggagaagcagatttggggcagaggtggaggcagaatcaagcatggtactggacatgttaagggtgaggtgtctaatacacttccaaatagagacgtcaagcagacagttggacataaaagtctggagttcaggtaaagaagagtaacggaaatgaacacgtgagactcttaagggcacacacagaggttacagccattagaatgaatgagctttctttcccagggagtgaacagagacaaaaagtagacaagatatctgaggacttatccttaagaactccaaaattataaacatgtagagtctccacagcaactagcaaaagataaaatgaggagtgagatgtcccaaaagcaaaagaaagaaaatggttcaagaagatgagagaggtcaggtgcagtggttcatgcttgcacttccaccacttagggaggctgagacaggaggattgctttagcccaggagttccagaccaacctggataacataaagagacccagtctctaccaaaaaaaaagcttaaaaattagccaagtatggtggcacacacctgtagtcccagccacctgggaggctaaggtgggaggatcacctgagcctgggaggttgagcctgcagtgagctgtgatcacactactgcactctaccctgggcaacagagtaagaccttgcctcaaaaaataaaaaaaaaaagaaaggaaaggaagaaaagggaagaggaaaaggaagtagaagggaaacgaagggaggaaggagggagaagggatggaggggaaggagggagaaagggagggaaggagggcgggaaggaaggagggaaagaagggagggagacaggtaaggagggagggaaggaaggagatgggagtaccaaactgatggataatttcattattttattcatgtctttcaaataaggtctaaaaactcttaaaacttcaaagctgaattatacaatgatatattacaggcccagtgtagtggctcatgcctgtaatcccagcactttgggaagccgaggcaggtggatcatgagatcaggagatcgagaccatcctggccaacatggtgaaaccctgtctctactaaaaacacaaaaattagctgggcatggtggtgcatgcctataatcctagctactcaggagcctgaggcagaagactctcttgaaccagggaattggaggttgcagtgagctgagatggcaccactgcactccagcttggtgacagagcaagacgccatctcaaaaaaagggagggggggaggggtggtggggggggggagaaaaagaaagaaaaaaaataggttataatgtcctgtgtttccttttttaatgaatggggagaaggtaaggaacaaaactatcaacttaagtttacaggtaagtatcaaaaattaatcctcatgctaaatgctcacatttatgtcttctgccaggaacagcacattggtaatattctgtactggcctgaggtgactagagtaaaaccgtagtgtgctgccctgctctacaattgcctaagcccacagatgtaactcatcccaactaaacacagaggtatcagcttcaaatttagctactaaatcataaaatcccacccagattttcatcctaaactcatactccttgaattttctctatagtcatttcactgctttattcctgtcactaatatccaatccagctgcattcattctctaacctgattttggcttctacaccaacagagaccagggagtttgccgattcctcagacacagatcgctgaagagttggaattagctgtttgctgttatccacttctgcttcagcatcctcttctgcagattgttctttgatttctgcttaacagtaaacaagagaaaacaaagagtcatttttgtgtttattttaatcactggtgaatgtatctataaagcataggtcataatgtaaaaagaaacaacaaataacaatatttcactaacacaagaaaagttcatgcacgtaattagtggtattgtgcatctttattctctaccgcaaaatgattatcaaaataatgtgaagcatggtatacttttccttgtgcccaaattatagctgactcagagaagtttcatcctagtaataaatgttaagaatcttggccaggcatggtggctcatgcctgtaatccctgcactttgagaggccaaggcaagcaaatcccttgagctcaggagtttcagactggcctgggcaagatggtgaaacctcatctcaacaaaaaatgtaaaaattagccaggcaaggtggtgagtgcttataatgtcagctactcaggaggctgagatggaaggatatgccttgaacctgggagccagaggctgcagtgagctgggatcgtgccactgtactcaggcctaggtgacaaagccagaccctgtctcaaaaaaaaaaaaagaatcttatttttggccaggtgtagtggctcacacatgtaatcccagcaccttgggaggctgaggcaggcatattgcttgagcccagtagttcaagacagcctgggaaacatggtaacaccccatctctacaaaaaattagctaagcatagtggcacacacctgtagtcctagcgactctggtggctgaggtgggagaatcaatcaagccccggcagcggaggctacagtgagctgtgatggcaccactggactccagcctaagcaacacatctagatcctacctcaacaacaacaacaacaacaacaacaacaaaaagatttttttttttttttttttttttttgatggagtctcgctctgtccacccaggctggaatgcaatggcgcgatctcgactcactgccacctctgcctcccgggttcaagcaattctcctgcctcagcctcctgaatagctgggatgacaggcgcccaccaccatgcctggctaatttttgtatttttagtagagactgggtttcaccacgttggccaggccggtcttgaactcctgacctcaggtgatccacctgcctcggcctcccaaaatgctggaattacaggcatgagccactgtgcccggccaaaaaaaaatcttatttcaggattatagcaattggtctacagaacaaatgtatttcaaagtgactcattaaaaattgcttcacactttataaaatcatcattaaaagactcatcatgtatcttaattattacccattctaaaagcttaatatttgaaaaggacaaaccttcactttattgcctttttccattctccttgaatccaaccccaaacaccttaaatgttctttctcaggaggcagcctaacagctgagaggatttccacacaccactacccctaacatcattcttcttgtttaataaaaattatatgtccactctgtctgtcatgctctattactacaatgaagggacattacacctccccaccagtgctcatgatgcagttccatgctcttggctggctccttcttttctaatttgaaatttatttagacctttctgcatcactaaccccaaacaaacaaaaacatcttaaagtcctttcaagcgcctcttctctgtctttccttttaccaccaaattcatgagatggcatgactgaactctactaccttccccttcaactatacctttctaattgtatccagcctcctattataacaattattctcagctgggtatggtgatgcacacctgtaatcccagcactttgggaggccaaggtgggcggataacctgaggtccagagttcgagaccagcctgaccaacaacatggtgaaaccctgtctctactaaaaatataaaattagccgggcttggtggcacatgcctgtaatcccagctactcgggaggctgaggcaggagaattgcttaaacctgggagatggaagttgcagtgagccgagatcatgccattgcactccagcctgggcaacaggaatgaaactgcgtctcaaaacacacacacacacacacacacacacacacacacacacacaaattattctcgtcaacaccaccaatagaccaacggcaaaagaattaacaatccagttagcacccacaagctttcttcaaacatcctaaaagttcacttcacaccaggatcacttcctccttagtgaaatgatcttctatcttttataagcacagagatataatagtctaatatctatctcttcagctgatttcctttagacctctaaatataggtacagccctctatacatcctttatatactcctggggttgggtggttgtttttgtttttgagaaaaggactcactctgtcgcccatgctggagtgcagtagtatgatcattcgcattcttgggctcaagaatcctcccacctcagcctcccaagcagctgggaccacaggcacatgtcaccacattctttttcatttttttgtagagatgggggtctcactatgttgcccaggctagtctcaaactcctggcctcaaatcatcctcctgccttggcctcccaaagtgccaagaatacaggcatgagtcactactcccagcctataagctcctctttgaagaacttattatccacatttcaacaatttcctctggactttatgatttgtaagtcaacatctctagcactaactcctctcctgagttccacaccatattttaactatacactagacatacttagcagcttgaacactaaatttcacacaaaactttatctcttatcgctcagattagcacttcaatctgacttccctctttaaaaaaagaaaactatcttctacattcaaaatgaattttagaaaagtattttgaaaaacaatttgtataactattcttgggtagttagaaaaaactacaaataattgtaaatcctatcaaatcataaaactaatgataacatgaagcatcaaacagatggttttggttttcatacttaaaataacatgtttcttttcttttttaaaaaattgaaatagaaaagctgaccttaaattaagtgtttatacagtctatcaatcaaggtgtcctgtctatcccgagacaaaattgataaagtatctagaatcaaatctacaaatacgtaagcttgtattcaaaaggaataataaaatgaaaatttacatttctatgtgacaaatgacctcatgaacaaaatgaatgtgtcacagatgagagaaaataaatacaatttgaatccccccccaaaaaaaaaggtattcagatcaagaatagctaaataactccaaagatgaacaaggcacataaacctgtagaacgtagacaaaggggccgggtgcggtggctcacgcctgtaatcccagcactttgggaggccaaggcaggcagatcacctgaggtcaggagttcgagaccagcctcaacatggagaaaccccatctctactaaaaatacagaattagccgggcgaggtggtgcgtgcctgtaatcccagctattcagaaggctgaggcaggagaattgcttgaacttgggaggcggaggttgcggtgagccgagatcatgccattgcactcaagcctgggcaacaagagcaaaactccgtctcaaaaaaagaaagaaagaaagtagacaaaggacaaaatccatactcttcatcttctatgctttccaagttttagtaggacacataactgctcagctagagactttattccccaaccctctttgcagcaaaccatggcaagttctcaccgagagaatatgaccagaagcaactgcgcaacctcatcatctaaaaggaagtgagctgctcttcactaaattatagtcccctttcctacagactggaatggacatgacagcaacccagtcgcaatgctgccaatgaggcgcaatgctccaggtgatggcagagagacaagacagaagaaacctgggtcaacaaacaataatatggagcaaaagacaactcatcagcctatacctctccatcctcagaaatattacatgagagaagatcaatttgttttatttaagccactgctatattttggggtctctgttacagcagtttaacccatgccctaattaacacagaaaactggtattaaagagtgaagaattgccgtaacaaaatcttcaagtggcttgatcaggccgtgaaacactgataatggagtctgaaaatcaactgaccctttttaggctatattaaaatatttaatatagctatgacctacaacaatttggaatgtagactgtacctacagagcctgtagctctaggcaaagcatctggaatgacccaaagggtattctgtgttgcctctctctagtatttttacagccaaagatagaaaagaatacagttctgctagagagactctctctgcctgcctattatattcaaagtactataaaattatcacatatataaatacctgtatgaaagcatttcatttctactcagagagtcccagaatacattttgggatatacccattttataccattcttactactgggtaacaagaaaggggaagagaaaaataagtgacaaacttaaggaggaataagaatagtgccttcagaaacttaccaacaatgagccaaatggcccagggtcgcaaatcattacattaccctgaaaacacattttttcctggagccagatccatttgtctccactcccaagctgtgctctctccaatccagtatgacttgtctgcttccttttactatgctgctatctaccatatatgacctccagtcaaaaatttccttctcctagcgaagtatataacagtttcagctttttccttatttttatccccaaaaaagaaaatacatagcacttttattatttttaggggagttttattgcttacagctaagggaaaagaagcaggacaatgtctatctctccctcaaataagagccagaaggaaatagaaaagttaaacgttaatgttactggttggccagtaggtttgcaggtatacaaccttttgaaattatgtttcctgcatttcaaagagaaaaaaacagattcagactatagggtttttttgttttttttttgttttttaagaaataggatcggcaccagatctgatcccataaagcaggtaagaagacaggctttcagagttcatcctgttctcttttctcctctagctattattattactggctctgcccatgattctaacttggatctgctaaagaaacagtagggagcgatagttttggttttacttttggtttagattttgttgtttcagtcttgtgttctttaacaaataaagaggactctatgactgcttcctagatagcagtaattcctgccacaaaataggaacaaacaacaaaaaaggtatcactaaatatttgatacttcaggtaataacagaagctgtctttaactgtcactcttcatttggtagactatgttagatcttagtatctgtcaaagtcaaggcaggacaactgagtgtttatgtctctctctcttctcctaatcctagtcttcaaacaattgtcagagtttggcagcagaatgtgaaacagactgctctggataaaaatgatgtcaaccagggatccaaccagagatgtcatccagagatgctctggatgaaatggctacaaacccagtgatatctgaggaaatatgcctgatgccagtacttaattatctccagtttattattaaaaatgtactcttgaatactatcctatgctttgcctaaagaaagaagctagccattcaaccaataaaacagtccaggtttggcgactccaccactttgcagagtttttgcctttcatgaggtccaattagctcaaactgcctgcaagccaaactgtggaaattggagcagacatttaaaaaattacattgcatttttaaaaattcagtgtggtatttttcttgaatataaaatccctaatatatcttttcccttactttgaacctgacctaaaatacaggcaatgacacttggtcacaaaatgcaccaaagtcagaaaggtggggacaactgcaaccctgggataaggacaggcaaggcgatttcatctgtagccactatctacggataatctccatccactaggtggcacatgtacagtggtaaactatactaaggaacctaatcattgacctggcgtggtggctcaagcctgtaatcccagcactttgggaagcaggaggatcacttaagcccagaagttcaagaccagcctgggcaacatggcaaaagcaaaaaaaattcagccggccttggtggcacacaccagtagacccagctattcaggaggctgaggtggaagaatcacttgagcctgggaggcagaggttgcagctgcaccaagatcacaccactgcactccatcctgggtgacagagcaagtccctgtctcaacaacaacaataaaaaagagaacctaatcacatgtaagtagattcctaagagaacttgaagacaatgtgcacttcattaaatagcatcagctatgtgccaggcattatctctggggatgcaaagataaattagatctaaccctttcccttaaataagttcataacataccctcttttaaacctttacttttccacctccaatgactctaatttatcctacacaaattggttctaagacatgagaaagtttaatagcaaaaggtgtctgctgtgttagttaaaaccaaaggcttggaatccaatggttccgagtctgcattctagctctgccatctgctagcaatgtgacctttggcaagttacttaacttcatctcaattttactttgctcgtcatttaagacagacaataccacctagtataaaactgtctttatgatccaaaaataaaaaaaaaagaacgcatgaaaagcacttagctcaacgtcttaagtgtagtgatgtagctgctattctgatgacctctatctacattcacacactatagtctatggattcacttgtccacctcacttatacaacttgatttttttttttttttttaaagacagagtctcgctctgccgcccaggctggagtgcagtggcgcgatctcagctcactgaaagctctgcctcccaggttcacgccattctcctgcctcagcctcccaagtagctgggactacaggcgcccggcaccacacctggctaattttttgtatttttttagtagagacggggtttcactgtgttagccaggatggtcacgatctcctgacctcgtgatccgcttgcctcagcctcccaaagtgctgggattacaggcatgagccaccgtgcccagccctcacctactcaatttctaactcttgatgtcacatcatgaattattaaattgcattatgagaattaatgagaataaagaagacatttatttagccccctccgatctatgctccagagttaatatatcattaatttagaatggttatttaccaaacaaaattttgagtaacaagtacatactataatttctattcaaatggtagtcattacaaagatagtcaagatccctacgtttaatggatctagatgaaagactgaaaataaaaataggacacaataatgatgatgctggtaagcacatggcatgatgggagttaaggggaagaggtggggaatacagctcagaaaggcttcagaaaggtattagaagcccagctaaaactaaaaggataaatcaaagtgtgcctaatagttctctctcaagttttctcttttaaaaaaagaataacatctaacatattttcttcattcaaaagataaggaaactaaaatctgaaagttaattacaagctcaagatcacaaagctaataggaaacaaagctgggatacaaaatcgggttgtgtaactctaaagcctgatgtgctcttttcactacttccaccgcctggcagagcatcaaagtgtagcatgtaagttttataaatacatcaatattaaagagaaatgttaacagtcttactaggaccatgttactgagggatcacttactgaatataaacactatgagataactaaaaatactcttttttaagcactgctgaataaaattatgaagtggacagaacatttatctcacagccaagttcacagaaataaagcattttgattttgaacaattacaaaagtatttccctcaaaggttaaatacttctttgaaaggactgtgtgtagcctacaaatatactgaacaaacttaccaacactgatagcataacaggctatgtcaaaaatattttagaggtcaattttggactcccttatcaatacattagtatattctttcaaagcgtcctactttttcaatggatttttaaagtttactcactcaagggttataggattttagagggagaaattacttctttatttttactaacctctaatttttattcacttccaaaatttagaattctaagaaaatattaagaatgtaagcaacaagcacagtggtattggtggatacctaagtgtttgtcaccaacagaaatcacggatattttcttatcacatgcagttgttgcagatatcccaaaatatcattcaccctcatcactacttcaaaattacagtagttattaaattcactgctagattttataatttaagtgaattaaaaagatgttataagattacaagtttggcttatttttatttcaatgcaattgtttatctttgtaatcctattttggtgtatttttattttattcatttaaaaacattatttgaaaaagagtccatggattacatcatagtaccaaaggggactatggcactgaaaaagttaagaacccctgttctgtatgtgccattcacaggagaccacagccccaatttgactatatgctctatgaaaacaggcactgtatctgtttttataaaccagagctaccacaaaacctgaatgatgttcgatagttgcttaattaatattatataatataaagcaagcagataaatctcatatatagatacaaagatttataaaaagcacagagaaaaataatatatttaaaatgaactcatatttactaactatgcaagtaaacactgacattcattatcgactagttatccaaaaaatatgccttctccctctatgctttaatcaacttttttttttaagagatgggctcatgctctgtcacccaggctagagtacagtggcacaatcatagctcatcagaacctcaaactcctgggctgaaggtatcctcccacctcagcttccccactagccaggactacaaggcacatgcgatcacgcctggatttttttttttttttttttggtagagacagggattaactatgttgcccaggctggtctcgaactcctgggctccagttatcctcccacctcagcctcccaaagtgctagaattacaggcatgagccaccatcaccatgcccagcctaatcagctattaaatagaataactgacttcccttaactccagagaatggcaatacttttcatgcttgcttcctactaaaactacagaagaaaacatagctaagaaattgtgtaaccatgtccctcccttcttttgaaagaagtctgcctcctgacagttatgttttctggatatatctcattgaatctagtgtatccaatgtcatcaaaattgtactgtaaagctaaaacattagcactatattagaaaaagcaaattatttattaacactatctttattcactaaactacttaaaatattgacactgattaataatatgaatatagttgctgctttcacagaacaatgtaagcaactaaaagtaaatacacaaaaaaagcactaattttctctgagagttaacacttttacaggtgacttactctctttataattacccacagttccataaatttctacaaatatacattactgttataatatttaatgtgattttttaatgcaaattcaaaaagcttaagagtccaatacttgtcaaaagccaaaaaatatgcgggcattaatttaaatagtaattgtttaagcaggatagactgctaataaatgaaaaaaaatagtaactgttggaagtcaactgttctctaggtgttttatttagttgttatcagtatttcctttagttttcctacataacttttaaatgttaatggaattttttgcaattaataaaagaaactaaaataaaccaacaaattacaacatacatctttataacaattatttctaccaatattgatcttcttctgaaatttaactttatttaggccttaaaaacaaaaatgaaccaatgaaactgtcttggaccctctagaccagcccaggtgtcacctgaatagcaataaatgactctggtggatgccagcagagcagaactgcccagccaagcctgacctaaattcctaacccacaagatcatgaaatatgtttgctttttaagccactgtgttctgaaatgatttgttacgtggcaataagaagctgaatttttcattttaaacttcagtttgaaaattatgtatggcttatcaaagacatataggtgtctttgcttcaccatctcttcaactaaaccatcgaagcagtcagtatttcaaacactgacagtaactacaaaagaaaaaagctcagagggttttgctccagtccagaagtgacccatatgatttccacccacaattcactggacacagtcacatgggcctgtcaagcaggcttggagctgtgtaattccaccacatatccagaagggagagtgccagaactatttgacagacaacaccaatatctaccaccacagtatataattttaaataatatactaaagttagggaaaattttatccaaagaaaaacctgatacttcaaaaagagaagtgtcaattacaaactttcatatcaaaaaaagataagaaaggacaggtaaagttaaattgttaggccaattaatgtaataagaatccaggctttttctttgtgccaaatgtcaccataatctgttgtgaattagcagctagactcaaaatgtacaaacaataatttggggtgtccactttttaaaataataatatcactaaagtttctattcttgtaaataaaggcatatgtagggtttatacaaagctgtatacttaaaccatatgcaaataaccaaaaggcgctgaagtaaagtaacacgtgtatggctttggaactccaattccacctgtctcatcaagtgtactgacaaagcaaaagacccctatcttgtctatgtcaattaaatactaacatctgaaaaccaccactaaataagaaccaatagtcattacataagcaacagctaaaaattaacaaataattagaccagaagataatctaagattttgatacataactcaaggcagtatgatagacatcattagtggaaatccctcaaaggttagtcacaaatggtaatcttgatattaaatccgatagttttactattttaataagaattattatttatgagacatatttataataatggataggtattaacttagttattgttaacaattataatccattccactatagttagaactggcttaccaaattagaaaagggatataactatagttaatacatgtaaaaagctaaactgaaaaatcaacaactcttgctagaaccataaggtcaataaagtcacagggcaaacaggtaccctcagaactggaggaatagacatgaatcacaacttacctgagcagaaacccatgggtaaaaagctccatgggtacaaaaacctgaaccataattgacaaaacgttggaggttcagtgtggacgagtctggaagatacaaactacagagggacccagtcatcgtggggccccacggttttgtgttttacctctaggagctctaccagtttctcacagtgaacttcacagaaaaatatcttcttgctttcaacagcaggaggggaaaaggaaccatttctcttaacaaggcctgccttcaggagaaactatttaactagagcctaacctacgagaagagaaataaactccagccagttctagcctaagagaactatctaactttagcccattctaggccattctgccccacctaaaagcagtgaaagggcagggtggggaggaagagtaaaaaattcagacttccccctcctcctacaaggcccaccacattactacaggcctatttacagctgttgtctttacccagtgtactacacctggctatcgagaaaaaaaattacaaggtatactaaaaagcaaaaaacacagtatagagcaacatcagaactagacttggatgcaggaaggaatttgaaatgatcagatgaggaattgaaagcaactatgattaatatgctaacggttctaatggataaagtagacagcatgcaagaagacgtgggcaatgtaagcagagaactcgaaattctagagattaaaatgatagagatttttttaaaactaacagaaatgatgaatgcttttagtgggtctattagtagacctcacacagctgaggaaacaatctcattgcttgaagatatttcaaaagaaacttccaaacctgaaaagcaaagagaaaaagactgggaaaaaaaaaaaaaaaaagaacagaatgtttaatacagaaaactacaaaaaggtaacatgtaatggaaataccaaaaagagacaaaagagaggaagaagaagaaatattcctcaaattaatctcagaaaccaaatgacaaagaacatcaaaaaggataaatgcccaaacaaactacacctggtcacatcatattaaaaaccacagaatactgaaaaaacctaaaagaggtcagagggaaaaaaatacctaaggtaacaattacatcaactcagaaaccatgcaagcaagaaaagagggaatgaaatatgtaacatgttgagagaaagaaaacatcaacctagaattctgtaccctgcaaaattatccttcaaaagtgaaggctttctcaggcaaacaaaaatttaagaatttgttgtcagatgacctaccttgcaagaaatgttaaaagtccttcagagagaacaagaacggtacaggtcaaaaacttagacctatatcaagaaaggaagagcatctcagaaggggcaagtgaagataaaattttaaaaaaaaacttttttcttattaactgatctaatagataagtttgttcaaaataatatctgcaacaatgtattcaattatgattgcttatgtataaatacatatgcttatgtataactgaaatgactgacagcaacaatacaagggatgcgaggaaggaattaggattattttgttcttataaagtactcacattacaagtgaaaattacagtggtgccatcttatccatggggaatatattccaagaccccagcggatgcctgaaaccaaataacagcaaacccaatatatccagtatgctttttcaatcatactaagatggctactaagtgactaacaggcaggtagcatatacagtatggatgtgctggaccaagagatgattcacatctcaggctgaaaagcacaagatttcattatgctactgaaaacagcgtacaacttaaaatttatgaattgtttatttctggaatttcccatttagtattttcagaccacggttaactggaggtaaccaaaactgtgaaaagcaaaaccacagttaaagtgggacactactgcacagtgttattagaaagtagacttgggtttgttgtaaacatatattacaaactctaaggcaacaactcaaaaaaaaaaagagagaactgtgctaagaaagaagagaaaacagaatcatacaaattgctcaattaaaaccacaaaaggcaggctgggcatggtggctcacgcctgtaatcccagcactttgggaggccgaggcgggcagatcacaaggtcaggagatcgagaccatcctggctaacacagtgaaacaccgtctctactaaaaatattaaaaattagctgggcaggaaagcatgcgcctgtagtcccagctactcgggaggctgaggcaggagaatggcgtgaacccaggaggcggagcttgcaatgagccaagatgatgccactgcactccagcctgggcaacagagtgagactctgtctcaaaaaattataatacaataaaataaaatgaaaccacaaaaagcacaaaaagagtggaagacaaaaatatgaacaaagaacaaggacaataaatagaaaacagttaacagatatggtagatatccattccattatatcaacaatcactctaaagctgggcatggtggctcatcccagtaatcccaccactttaggaggctgaggccagcatttcaagaccagcctgggcaacacagcgagaacccgtccctccaaaaaaactattttttttttaattagccaggagtggtggtgtgcaccagtagtcccagctacttgggaggctgagcacaggtagtcccagctacttgcgaagctgaggtgcgaggatggcttgagcccaagagttcaaggttacagtgaaatatgatggcaccactgcactccaacctgggtgatacagtgagattctgtctctaaaaataaagaagaatcactttgagtaacaatggtctaaatataccaattaaaagacagaaattgttataataggttgtgtttgtttgtttgtttgttttgagacagagtcttgctctgtcgcccaggctggagtgcaatggcacgatctcagctcactgcaacctccacctcctggattcaagtgatttttgtgcctcagcctcctgagtagctgggacagtacccgccaccatgctcggttaatttttgtatttttaatagaggtggggtttcaccacgttggtcaggctggactcaaactcctgacctcaggcgatccacctgcctcagcctcctaaagtgctgtgattccaggtatgagccaccgcacatggcctagaatagattttttaaaaagaaaacccaagtacatattgtctacaaaaaaaccccactttaactataatataaagatacatacggataagaaataaatggatggagaaagatattccaggctaaaaataatcaaaagaaagcaggagtagctatattaatttcagacagctcagatgtcaaagttatcaggaataaagaaaggcattttataatgataaaggggttaattcccaagacatcagtgtgtctaaacagaacatcaaaatatgtgaagcaaaaaaatgatacaatctcaaggagtaagagatgaacccactattatcgttggaaagtttaacacccctctcagaaatagatctggcgtgcagaaaatcaacaaagacatagttgaatctgacaccgttaatcaactggaaataactgacatctaaagactacttcatcaacaatagcagaatacacatgcttctcatccacatgggacacttacaaggtagaccacattctgagccataaaacataccttaacagatttttaaaaatagaaatcatacaatgtctgctctcagatcacgtcagaattcaactagaattcggtaacagaaagatagcttaaaatcccaaaatactgagacattaaacaatacacttctaaataacacataggtcaaagaagaaatctcaagagaaattgaaaaatattttaaactaaatgaaaataaaaagaaaatttgtgagatgcagtgaaagcagtgcttagaggaaaagttatggcatttaacacatatacagttgacccttgaacaatgagagggttaggggctccaacccccccaccacacagtcaaaaatctgtgtaacttttgactccttgaaaacttaactactaatagcctactgttgacaggaagccttaccaataacataaacagtagattaacaaatatttctgtgttgtattatataccgtattcttacaataaagtaagctagagaaaagaaaatgttattaagaaaatcatggccaggcacagtggctcacacctgtaatcccagcactctgggaggccgaggcgggcggatcaggaggtcaggagataagagaccatcctggctaacacggtgaaaccccgtctctactaaagatacaaaaacttagctgggcgtggtggcatgtgcctataatcccagctcaggaggctgaggcaggagaatcgcttgaacccggaaggcagaggctgcagtgagccaagatcgtgccactgcactccagccagggagacaaggaaaaggaaaaggaaagaaaagaaaagaaaatcataaggaagagaaaatacatttacaagaccatactgtatttactgataccataagtttatgtcacctgtttacaagactgtctacctgaaatagtgggcaacctcagctacagacttccatctatggtacacatcaagcagttcaactttttcttgtatgtcatgactttgcttcttgtagggagcactttaagcatcattagtggcacttcatatgggtcccgtggtgttatgcacaatttatagcactgcactgaacatggtgaaagatacatgagaagcgccagatcactttttaccaagatacccaatttactggagagatgaactgctcaaagatgattggtatcccatggtgttttaatcagatatttgcaacacttgagttcactgcaataacaacaggaggtggccacataattattacagttgtacagtatgtactacagtaaattttattcagttattatttaatactacatctttacatttgtttacatttctctcaattgccaatggtaccacatacagtctttaagtgtgtgcttaagttttgataaattttaactttcagtaatagatttgtgtatattttatggtagtaaacaataaaacagacaagtatctacatatactttatgcattcatgcatacctttttcttaattttttaaatatttctaggctacacagtccatctacgcattttttcaaattgtcacgaatctccacgaaaaatttccaatatatttactgaaaaaaatccatttatcagtgcatgcacatggttcaaccccaagctattaaagggccaactgtttcagaaaggagggaaaatctacactcagtaatatcaaaaatgaaaaatgggacatcactacagatcccatggaatcttaaatattcaagaaatactattaacaactgtatgcccacaaatttgataacctagatgaaatggaccaattacttaaaagacacaatatgctcaagcttacacaagaagaaataatctgaatacgtctatacctattaaaacaaattgaatcaaaaattaataaacttcgaatattgaacacacccagtttggttcattgctgaattctaccaaacatttaaggaagaaattataccatttctctatactctctttcaggagataaagcatagggaaggccaggcatggtggctcacatctgtaatcctagcactttgggaggccgaggcaggtggatcacctgaggtcaggagttcgagatcagtctgaccaacatggtgaaaccccgtatcttctaaaaatacaaaaaaagtagccaggcatggtggcaggtgcctgtaatcccagctactgaggaggctgaggtaagagaatcgcctgaacccgggaggtggaggctgcagtgagccgagattgtgccattgtactccagcctgggcaacaaaagcaaaactctgtcttaaaaaaaaaaaaaaaaaaaaaaaaagaaagaaagaaagaaaaaaagcatagggaatacagacacctcaccaataaacataaacagatgggcagataagcatatgaacagatgttccacattatatgttatcagggaaatgaaaattaaaacaacagggcatcactacacacctattagaatggtcaaaatctggaacaccaacaccaccaaatgtcagtaagtacacagagcaacagaaacttttattcatttctagtgagaatgcaaaatggcacagccactttggaagacagcttggtggttccttacaaaactaaacatactcttgccatacaatccagaaatcatgctgcttggtatttatccaaatgagttgaaaacttacatccacaacaaaaattgcacatagatgttgacagaagctttcttaactgccaaaaccagggtgcaaatagaaattccatcagtaggcaaatggataaactctggtccatccaaacaatacaatattattcagcactaagaagaaatgcactatcaagacatgaaaagacacggaggagggctgggcgcggtgactcacgcctgtaatcccagcattttgggaggctgaggcgggtggatcacctgagatcaggagttcgagaccagcctgatcaacatggagaaaccccgtctctactaaaaatacaaaatagccaggtgtggtggtgcatgcctgtaataccagctactcgggaggctgagacgggagaatcacttgaaaccgggaggcggagactgcagtgggccaagatcacaccattgcactccagcctgggaatacagagcaagactccataaagaaagaaaagaaaagagaaaagaaaaaaacagaaaaggatgtggaggaaacataaatgcatattattaagtgaaagaagccagtctgaaaagactacatatcctatatgattcaaactatttgacactctggaaaaggcaaaactatggagacagtaaaaagaatagtggttgccataggttagcaaggagggagggagcaaggagggagggattaataggtggaacacctattaatttttagggcagtgactatgatactataatgacagatacctgtcattatacctttgtccaaacccatagaatgtaaaccaagagtgaacccttatgtgaactataaactgtggataatgtgtcaatgtaggcttaaaaaattgtgacaaatgtaccactctagtataggatgttgatactgaaaaaggctatgcacgtgtcggggaaggggatttatgggagatttcagtaccttcctcacaattttgctacaaacctaaaattgctctgaaaaataaaggctatttttggccaggtgcagtggttcatgcctataatcgcaacactttgggaagctgaggtgggcggatcacctgaggtcaggagttcaagaccagcctgaccaacatggaaaaccctgtctctactaaaaatacaaaatcagctgggcgtggtggcacatgcctgtagtcccagctactcgggaggctgaggcaggagaatcgcttgaacccaggaggcagaagttgcagtgagccgagattgcaccattgcactccagcttgggcaagaagagtgaaactctgtctcaaaaaaaataaataaataaaataaagtctatttttaaaaacttatgctagaagtaactgaatgtatcgatgtgaactcacatttgtaagtgtgtgtatagatctatgtaattacagtcctctcagaacagggatatgttctgaaatattcatcattaggcaattttgtcactgttacacaaacctagatggtatagcctactaaaaacctaggctatttggtacagcctagtactctaggctacaaacctgtacagcatgttactgtacgcaactataacacaacagtcaagtatttgtgtatctaaatatatgtaaacatagaaacaatggtaagaatacagtgtaaaaacacaaaaaatggtacacctacatagagcacttaccatgaatggtgcttgtgggactagaagttgctctgggtgaatcactgagtgaatgtaaaggcctcaaacattactatgcactaaagtaggctttataaacactgtacacttaggctacaccaaatttttaaaatattatttttctttgctcagtaataaattaaccttagcttactgtaacatttttactttataaactttttttaaactttttgacacttttgtaataacacagcttaaaacacacactgtacagctatacaaaaaaaatcttcctttctacccttattctgtaagttttttggttttagggtttttcttttttgtttctctgtttttgttttaaacttagcccaggcctacacgaagtcgggatcgtcactatcactgtctttccacctccacattttgccctgctggaaggtcttcagcgacaataacacacaaggagctgtcatttcgtatgataacaatgccttcttctgatatagctcctgaaggttctgcctgaggctgttttacagcttttttgcttaagaaaaggggtacactccaaaataatgataaaaagtatagtatagtaaatatataaaccagtaacacagtcacttattatcaagagttatgtactgtgcaagagtgtatgtagtgtacttttgtatagtacatgtaattgggagtacactgggtttgtttacaccagcatcaccacaaacatgtgagtaatgcactatgttgcgctgtgctatgacatcacgacagctatgacatcatgacagctatgacatattgaggtgacagaaatttctccgctccattataattttatgggactactgtcatatatgtgatctgctgtcattatgcagtgcatgactgtactagtatatgactaaagtggactcacataactaattctcaacagtaacaattgtaatatgcatccctttgttgtgggaagtcagggaccccaaactgagggaccggctgaagccatggtggaagaaataaattgtgaagatttcacagacatttattagagccccaaaataatacttttataatttcttacgcctgtctttactgtaatctctgaacataaattgtgaagatttcatgggcacttatcacttccccaatcaatacccttgtgatttcctatgcctgtctttactttaatctcttaatcccgtcattttcataagctgaggaggatgtatgtcgcctcaggaccctgtgatgattgcattaactgcacaaattgtttgcagagcatgtgtgtttgaactatatgaaatctgagcaccttgaaaaaagaacaggataacagcaatgttcagggaacaagagagacaaccttgaactctgaccgctggtgagccgggcagaacagagccacatttctcttctttcaaaagcaaatggaagaaatatcgctgaattctttttctcagcaaggaacatccctaagaaagcaaatgcatccctgagggtgggcctctaaaatggcccccttgggtgcggctgtcttttatggtcgagctgtagggatgaaataagtcccagtctcccgtagcgctcccaggcttattaggaagaggatatccccgcctaataaatttttggtcagaccagttgtctgctctcaaactgtctcctgataagatgttatcaattacaatgcgtgcccgaaacttcattaccaattttaatttcgccctggtcctgtggtcctgtgatctcgccctgccttcatttgccttgtgatattctattaccttgtgaagcacgtgatctctgtgacccacaccctattcatatactccctcccctttgaaaatcactaataaaaacttgctggttttgcggcctgtggggcatcacggaacctaccaacatgtgatgtctcccccggatgcccagctttaaaatttctctcctttgtactctgtccctctatttctcaaaccagccgaagcttagggaaaatagaaaagaacctacgtgaattatcgggggtgaattttgcccaatatctggctgaatttcccccgatatcccttgagcctaaatttttgtccctaatactattctccactaaaaaactagaagtccttagagaatagctgatttcataccttgtggcagggagaattttaaatgggcctgaaaaataaaacttttgccaaagagcacagagctctgaaaggttttgagatgttatttaaaaggactcagaagccagctgacaaggggctcccatgagccaaactatgacaacttgaacactaggagaaaaatgtttaattataactaactgaattataattagctaattatagttaatgaaaacaagtttgcaaagacctgattatgtgattctcaagaaaaaaaaagtttctcttctcttcaagtaactagcacttcactcaagttgattttattcatataaaaaaaatgcgcagagactggtaacagccaccaccaacaaaagatcaaattttctcagctgggtgtggtggctcatgcccgtaatcccaccactttgggatgccaaggcaggtggatcacgaggtcaggagttcaagaccagcctggcaaagatggtgaaacccagtctgcactaaaaatacaaaaaaattagccaggcatggtggcaggcacctataatcccagctactcgggaggctgaggcagagaattgcttgaacccgggaggcagaggttgcagtgagctgagataaagatgaaattttcttaacataaaatattaccaaatgaggtttcttattactttcccaatggctactcctagattactcattcccatccacccaccatggtaggagactcattagcattcttttcttttttctgagacaggatctcactctgttacccagactggtgaacagtggtgcgactgattacaggtcactgcaactggtgtctcccgggctcaagcgatcctcccacctcagcctcctgagtagctaggactacaggtgcacaccatcacacccaactaatttttgtatttttttgtagagacgggtttttgccatgttgcccaggctggtctccaactcctgagctcaagcaatccacccacctaggcctcccaaaggtctagggttataggtgtgagccaccacgcccagcgtaatacccttatattactacaaaacattaagtaagcatgtcaaggcacaggatttacaggaacaagagaaccttcaaataaaccctggggtcttgagacatacatatgttaaaaccttgcagcaaacttgaatgtgcttttaaatgaactagaaatttatggaacaaactctgtctggatttgcaggtttagtggttataacagttattctttctttcactgttctccttgccctatgttcactatgttccctaaaagaagtggacaatggactttccaaggacaaagacaaaacaaagactaatatacacttggctttattaactttagtaaagccaggttaaaaaaaatagttttctgctcctattaaaacatttatctaaactgtatttgccttgacctctcataggagacagcatgagaagacagtccattcgtggggcttactactctccagtaaggaaaaaaaaatgccaggaatttagttttgttgtaatgttgtaatgttccaagaatggtaggtagcttagaaaacataaagaaaattcaagaacacaatactgcttcacttagtgaatccaattcctcctatatccctagaagtattcttggcactggggataaataaggtaacaagacaaatcccctgacttcataaagcttacattctagtgtggaaagcatacaataagccaatatgaaattaaatgtcctatctgttacgtactaggagaaaaataaagcaggagaagacaaagtgacaagtgttactttttagacaagtttgtcaggaaaggtctctgggaaaactgtaactgagtagagacttgactgaagtaagggaataagctgtatgaatatctgagaaaaaatttttccaagcaaagaagacaaaaagtgcaaatgcctgagaaaggagtatgtttggtgggctcctggaaaagccaggaggccagtaaggatggagcccagtgaacaagggaacataagatacggttatacaagtagccaaagtcagatcaatggagcctgaaaacaatggtactgcatgaactttgaattttattctaaatatcactggagtctttggatggttgacagagggaagtaaaaggctctcactttgaatttggaaggatcactctggctactatgtgtgggacaagagtagaatggaatgaaaaggaaaaagaccagttaggaagctattgcagcagtccagtggaatggtagtgtgaagttctggaataatagcagtggaggggtcaaagtaattgaatccaggatatactgggtaggtaaagccctccagtgggctggatgtctaaaatgtgaaaatgtgaaatgtgaatgtctaaaatgtgaatgtataaaatgtaaaatgtgaaaatgtgaaatcaagaaagactccatctttttaagcctgaacaatatacagtggcaatataccagaggtggtaacactggaagagagggtttcaggataacaacaaaaatttccagagaggacacactaaatatgagatcctcttcagacatctaagaagagatgttaagaaacaagctgaaagatacaggttgtgttcaaagcaagaaagagctggtgacgtaattttagagtcattagcatttagataacataataatagcacaaaaatagataataagccattaaactgaataagaccacctaatacataagaagatgagcgaagagaatgagaaaaaaccagtgaaggagtaggaaaaaacaaaaaaacaaacaaacaaacaaaaaaaaaccaagacaatgcagtgacctgaaagtcaagttttaaaaaaaagtttcactcctgagagtggttagctgtgtgaaatgatcctgaaaggttaaggaggatgaagactaaaagctggtctgggcaatatgagatcattacattgacaagaataattttagtagaatgggaggaagaaagcttcattagagtgggttcatgagaaaatggtgaaaaataagtagtaatcataggtataaataactcaaggatttttgctatgatggagcaaagaagctgtatagtacctaaaaggggatgttggatcaagagaggctatttgtgttgaaagggggtgattctgcagcaccccccttatgctaatgaaatcaatgagatggaaaagttattgatgcagaaaagcaaggacaactgcagaaccaaagtccgtaatacatgagaggggacacaatggaagacacaagcagaggagctggctttatccgcagtctttatcccattttaccaggacagaaacaacatacgggtagggatgcaagcaagaaaatagatttgatggtagatgaatatggaacttcttttctaattgttctctattttttattttttcactgaaataagcaagatcatcactaaagaatcaaaaatgagaaggggtgttggaagtttcaggagaaaagaaaaggtggtgaaataatcatcttcaataatcaaagggccgggcatagtggctcacgcctgtaatcctagcattttgggaggccaaggtgggcggatcacgtgagatcaggagttcgaggccagcctggcaaacactgggagaaccctgtgtctactaaaaatacaaaaattagccgggcgtggtggcgggtggctgtaatcccagctactcagaaggctgagacaggagaatcacttgaacctgggaggcggaggttgcagtgagccaagatcacgccactgcactccagcctggggaacaaaggacgaaactctgtctcaaaaaaacaaaattaaaaaaaataataatcaggcacggcgcggtgactcacgcctgtaatctcagcactttgggagggcaaggcaggtggatcacgaggtcaggagttcaagaccagcctggccaatatggtgaaaccccatctctactaaaaaatacaaaaattagcgaggcgtggtggcatccacctatagtcccagaccaggagggagactgaggcaggagaatcactggaacccgggagacagagattgcagtgagctgagatcgcaccactgcactccagcctgggagacaagagtgagactccaactcaaaaagaataataataataataataataataataataataatagcaataataataattagagccagacacggtggctcacacctgtaatcccagcactttgggaggtgggtggatcacctgaggtcaggagttcgagaccagcctcgtcaacatggcaaaaccctgtctctactaaaaatacgagttatccaggcatggtggcgcatgtctataatcccagctacttgggaggctgaggcagggagaactgcatgagcccggcgggtggaggttgcagtgagccgagatcacaccactgtagtccagcctgggagagagagcaagactctgtctcaaaaataacaacaataggccaggcacagtggctcacgcctgtaatcccagcactttgggaggctgaggtgagcggattatgaggtcaggagattgagaccatcctggctaacacggtgaaaccccgtctctactaaagatacaaaaaattagctgggtgtggtggcgggcgcctgtagtctcagctattaaggaggctgacgcaggagaatggcatgaacctgtgaatccaggaggcagagcttgcagtgagctgagatcacgccactgcactccagcccaggcaacagagcaagactcttgtcttaaaaacaaacaaacaaacaaacaaaaacactaaagcttcaaaaagacttttcagtagtaaaagtaacaatatatagtacagaaaaaaaaaccatatgaaaaagaattaacagtttaaagtaatacagtaattcatgaatgtgcacaaaagggtgaaatttagtattctgagcttccaagagtaatactctaactagaccttattggaaagaaactatagattatttgaaggctttccaagaattatacctatataatagcaacacatctgacaactgtaaggatttctggaaaaatgtattttaaaatctataacaatttttaatttttctcatctcttaactgcatgatattctgtaagcatcaagatgatattcaacttcagagaaaaagcctatcactgtgtctaaactttatctaacaactattgaaaactttaccaatgagagactatctcctacaggtatcctctcaatacaatatgaatcctagtccctttgataacttaccactgacctgaaaattttggaaactgctttgggcaaccaactctagctaccttttgcagatgcacaacatacagcagcttatttaagggcacctaaaagtccaacagaccagaaactatttggtctagtttggcctagcctttcacaatattaattccataacgaaacatactacttttttcagaacacatattaacaaaataagctttaaacaaacactagatggttcataggccagaatatactatgagcgattatactaacagcctggattactgtttctcccagtctttatttccttgataaaacatttatcttcagatataaaataattatactaaaccagggcttagggaaaaaagagagatagagggctcagttttttcactttgtcattagttatcaaaacaaggcagatgggaaacttagagttcagtataaaaacaaatgcttaacacagaatattgttatacaaatgctacatgcagtgtacaaacatatgcaaagcatcattatacattcttataaattcttgagttctgatacctgtttccacaatcgtttctgtttctgttgtctccagcccatccatgctgtcctcatcttccactgcagttttccccctacttcgaggtctacagaaaaaaaaaaaaataataagtacatagagttaaatgttaaattttaaggcttagacttatattcaacataaggcacaatttgaaggtatacaaaataagtaattagggcatttttccagcattttaccatatcaagtagaaaatatcagagtttacagtcattttctcccttaaatccagcacttccttatactctaaatgtgaggacagacccacatgaatataattgtgtcctcataattcacttaagtattcctcactctggttttgccccttttttaggtaaccttctgaagtctccctctgtctacagtagtggcttttaactacataatgggttcttcacaaagttcacataccaggtttaacttctatatttaataaagttgatgtgaaatgaccagatatatgtatttttaaaagctttgtaaaaggtgcttttggtgactgtgatgcagatgactaaaaaacaaaattttaaaaattaagcacgattataatcatgtccaccttacaagcataataaaatttaatttataaacacttcaggaaagtaaaataaaggtaagagtcacagcaaggtgaaattcctgacagaaagcaattgaaaaaaaaaaaaaaaactaatgcctttaaattctttgaattgtactaaatacggtatagaaatgagtaaaagaaaaattaataacacataagagcaacaagatattacacataaaaacttggaaactgacaaagcagtactcagataatgtcagtgttttaaattatttcgcagtattttaaactctttaaaagaaaaaggctgggtaaggtggctcacacctgtaaccccagcactttggagggtcgagttagatggatcatttgagtgcaagagttcaagaccagcctggccatcatggcgaaaccccatctctaccaaaaaaaaaattcaaaaattaggcaaacatggtggcgtgccagtaattccagctaaagaaaaaaaacaaagaagggagggagggaggaaatagaaagaaaaaatacaaatcaactcagtatttaattgaaaaacataaaacatttaaaaagtgaaaaacagctggctgtggtggctcacatctgtaatcccagcactttgggaggctgaggcagatatatcacctgaggtcaggaggtcacgaacagcctggccaacatggtgaaactccgtctctactaaaaatacaaaaattagccaggtgttgtggcgtgtgcctgtaatcccagctacttgggaggctgaggcacaagaatcgcttgaacctgacagatggaggttgcagtgagctgatatcatgccactgcactccagcctgggcgacagagtgagactgtctcaaacacacaaacaaaaaaaaggggggtggggggggggggacaatatgaaataaaagaataatatgaaaaaagaataaaacaaagaactatgttttaaacaataagaaatccatttaagtcttgttctcataaaaaagttaaccaacctaggccaggcacagtaactcacgcctgtaatcctagtactttgggaggccgaggtgggtggatcacctgaggtcaggagttcaagaccagcctggcctacgtggcgaaacctcgtctctactaaaaatacaaaaattagctggacgtgttgatgcacatctgtaatcccagctactcaggaggctgaggcaggagaatcgcttgaacccagtgggcaggaggtgcagtgagccgagatcacaccattgcactccagcctgggcaacaagagtgaaactctgtctcaaaaaaaaaaagttaaccaacctaaaccatgaaggagctataacataataatatattaaaaattaaggtgaccagccgggcgtagtggctcacacctgtaatcccagcactctgagaggccgaggcaggcagatcacctgaggtagggagttcgagaccagcctgaccaacatggagaaaccccgtcactactaaaaaaaatacaaaaacaaaaagaaaaattagctgggcatggtggcacatgcctgtaatcccagctactcgagaggctaaggcaggagaattgcttgaacctgggaggcagaagttgcggtgagccgagattgcaccactgcactccagcctgggcaacaagggcgaaattctatctcaaaaagaaaaaaaaattgaagtaatcaaagcctaaatggttttataattaaactactaaaaactatcaaaaagtcggtcttaaccaaaaataaaaaaaaggaagtacctgactcagaattccaacaaacattgtcaaaaactatgaatgaaaataaaaactgagaacaatcctattgaatataatcagaatgccaggatgattcaacattagaaatttgttaatgttacataacaagtcaagcagtcaaaatagcatcacttcaaacttcacagggggaaaggggaaagaaggcagaactaaataaaaagactacaaaacctgaaagatgaaaaagggtgaattagggagaaaacactctaaggtggatcttattgttcatggacaaaaagaaagaacatctttagaatttattaagtagttgtttttaggctgggcacggtggctcacgcctgtaatcccagcactttgggaggctgaggtgggtggatcacgaggtcaggagatcgagaccatcctggctaacacggtgaaaccccgtctctactaaaaatatacaaaaaaattagccgggcgtggtagtgggcgcctgtagtcccagctactcgggaggctgaggcaggagaatggcgtgaacccgggaggcagaggttgcggtgagctgagatcacaccattgcactccagcctgggcaacaagagagaaactccgtctcaaaaaaaaagaatttattaagtagttgtttttaaatttgatagaaaacattaaaataaagtggaaagaagggataagaaaatttgatcaatccaacagcaggcagaaaaggaatgaaaacaaatggtacatagaaaataacataaaaagataaatataaatatgaattttcacagtaaacataaatggcttaaactgtcataatgataaaaaaattaatttacttggataacataagagaacttcagattacataaagcaaacatttacagaacaaagagaaattggtaactaatcattagagagatattaacatcccactgtcggaaactgatagatgaaacattatagtttgaagcattttaaacaagtatttggacaacacattgagcaagcattactagattactctatcaatcttcctttgtgtctgactctgttcaaacacagtggatacagaaataaataaaacaaaatccctcctgtcacaaaactacattctagtgagaagagacaacagtaaacaagtattacacatacaacatccaacaaaagaaagcaaagaaaaagggactagctattttaaataacagatttataaaataaatgttttaaaataaaattttgtaaggagccactttagcacagaactgaagatgaagcaaaccatacagatatctgggagaaaagcattgcagtagaagtaacagcaaatgcaaaattcttgagatgagagcaagtgaggggggttagagggacaagaaggatatacggtggctggggcagagtcagcggtagggggtaagaaggcatgaggtctaagaatttttttttaataggatcactttttgtttagaaacctgtagaccaatacaagaactggggactgggagactagaaatcctcgaaacaatcccaacatggctgcttcaaagaaaatagagaatgacaaaataattcacatgccattatggaggtagagtttacttttcatctttcttttgtgatttttcataatcataaacatccacttttaaagaaattggaaaccgtatggtttagctgactttttaacttaatctctcagacccatgttttgctctactttgagttttttctccactatcttgaccatcactgtctatgctgttgtttgttttggcacaactggctttatttcaagctcgttctgtctagtttataatctctatcaacatatcagttatctgcattgccctacttactccttaaaaaataattttgattttaatttttgcttttcaaatttttcttctgatttctattcttggttttggcactaggaagacatgctttttacgttgatcaattcatcagaattcctttccttctgggcaatggaccaacttattgacatcatgtcattttcgaattcttttatttcatcggtgtccttattgctgctcattggcttctgccatgtgacttttctgactaatcaaacactatattctgaatgcaaagataatggtcatactcttcaaaaccctatcagttgccaactttcatatttaaacagcaaaatagatacatgttttatatttccatattgagtcagatatttccagtttcagtttttaaggaaagtttgaagtctaattacaaatgacaacatgaagattatttattttaacccttctttgggttttcttcgttcccctctttttcctgtctcttaaccctttcatttcagtgttcttcacttcactttattaccaagaaatgtgaagtaaaagaatacaactaactttatttgagaaaattttctaccaaaactttatgttccatattaatctcagaatctgaaaccaacttgagttcctaaagtaacataggagacttctacataaagccacatgggagtaagacaggtcaaaattaccctccagcccaaacaactaggaaaccagacaaatataagaaacaaccttattataagacactgggcaacaggtatggcgaagggaacaaagggaaagaaacagggtgacccctaccatggcacaggctttctgcttggcattaatttagaaactaccacacagagataggaacccaaaatgagagctgaaatgagaagacagaaatcataggttcaggtggctcaagaagactagaatttgtgggacagactacccaagagaagagaggtattcagagaaagagctccagaaatctgcagagggatacccttgagtttcaactgaataccaatctgcacatgtgtgatgtgaaatcccagaagactgaacaagaacaacttccagggagagagcaattacagaagaacaattcccagagctcacagaaagctgcgaatcaactgtattgtctctagccaactgtattgtctttagccagagtggcaagacctcaatgactatgtaacacattcagcagagaccagagtgagacacacctttaggagcagggctaaatgagccacagaacaaatgctattctagaccatccctaaaagagctgacaaataagtctcaacttatcctgagagtgactctgtatgaaaaaaataaataagtctcaactgaacaataatgattcccaacttaactactgggcataatccaataatccagctattataagtatgcctcatatgcgcaagaatgtaaagaaaacatgaatatgagagaaacagaagatattaaaaataacatggaactcaaaggtaacatcaaaagataacatcaaatgtaaatttcaggccgggtgtggtggctcacgcctctaatcccagcactttgggaggctgaggcgggcagatcacaaggtcaggagatcgagaccatcctggctaacatggtgaaaccccatctctactaaaaatacaaaaaattagccgggcgcgtggtggcaggtgcctgtagtcctagctatttgggaggctgaggcaggagaatggtgtgaacccaggaggtggagactgcagtgagccgagattacaccactgcactccagcctgggtgacagagcgagactccgtctccaaaaaaaaaaagaaaagaaaaaaagaaaaaaatgcaaatttcacattgaaaagttaacatgtgattagaaatgacaaaagaagatcattatccctaaagacataacaaaaaaaaatctattcaaaataaagaacagtatgaaaaatgacaacacagctacagtgccctgtggaataatagcaacctacctaactaatatgtgtgaggttggggttaaagggatagggacaaaaaaattgtttagtgaaataattagctgtaaattttaaaagctgtattattataagcccacagatccaagcacaacaaaatctgaaacagacagacacacacacacacacacacacacacacacacacacgtaccagtaaggtactttatagtcaaattgctgaaaaagattaataaagagaaaatattaaaagcagcaaaagaaaatacacattgcttaaagggggaataaagtaaaaatgactgcaggcttcttgtctgaaactatgtaagccagaagacagtaaaaaacatatttaaagtactaaggagaaaattaaaggaaaaacccttctaaacactgaacaaaacatgcagcaaaaaaaagtatccttcaaaagcaacagtaggctgggtgcagtggctcacgcctataatcccagcactttgggaagccgaggcaggcggatcacctgaggtcgagttcgagaccagcctggccaagatggtgaaaccctgtctctgctaaaaatacaaaaatcagccaggaatggtagcaggcgcctgtaatcccagctactctggaggctgaggcagaattgctccaactagggaggtggaggttgcagtgagcagaaatcgcaccgctgcactccagcctgggcggcagagtgagaccctgtctcaaacaaacaaacaaacaaacaaacagttaactaaaaacttcctccttttttcttttcttcttttgagatggagtctcgctatattgctcaggcaggtcttgaattcctggtctcaagcgatcctcccaccttggcttcccatagggctgggattacaggcattagcctcccggcccagtgttttgttttgaagtgtgctttgtctgatattaacatagccactccagcttaatttgattagtgttggcatgttttatctttctctttatgtcattttatttcaattgtctttcaggtagacagaatataattaggtctaaaatagattctattagtggggcatagtggcatgtgcctgtagtcctgggtactcaggaggatgaggtgggacgaacacctgacaaaaacaacccaactcaaaaatgagcaaagaacttccacagacattttccaaagaagttatacaaatgaccaaaaaaacatgaaaagatgctcacgatgactattagaaaaatgaaaaatcaaaactaagatataccacctcacacccattaggatggctactgtgaaaaataaaaaaaagaataacaaatgttggcaaggacgtggagaaactgaaacactagtgcacaggtgtagggaacataaaatgatatgggccctggaaaacagtacggcagtttctcaagcagttaaaaatagaattgccatatgatccacaaattccacctctgggtatacaccaaaaagaatcagaagcagagtctccaaagagatatttatacacccatgttcacagcagcattattcacaataaataaaacataattaacagttaagtaaaatgtggtacagacataccacattggcagtatgtctatggtggaatactatgcagccttaaaaaggaaggaatttctgacatatgcgatactacaacataaatgaaccttgacaacaatctcctaagtgaattaaaccagtcacaaagaaaaaaaaatagtggatgattccacttatataaggtactaagagtagctaaaatcagagacggaaagtggaacggtggttgccagaggctgagagaagggagaaactgggagttattgtttaatggctataaagtatgagtttaacaagattttttaaaaagctatgaaaatggatagtgtctacattatgaatgtatctcacatcactaaaatgtacacttaaaaatagttaaggggttgggtggccacagacggccgggcgggatgtaaccagccgctgagctgcagcccttccgtgtccgcaggcttcggcccggccgccgccgcccatcagctatggaggagctttacaacttcccggcctgcagagccgggcgcagcaagggccagacgcggcgcgagctggcgctgcgagccaacgggccggcgcctggcgggcacgatcgcaaggtcgcgcagaagctcctcaatggccagcgccagttgcagccccggccgcacccttgcctcacctgagcctgggctcttgctcttgcggaatccacaggtctttcttgaagaaatctgtagtcagaactctgtgctgcatttttatccagagaaggaacaggaagagaagagtgtggtctcctagaaatctagcactggagaaacgaggaaaattcttccaaggatggtctcccactcagagctgaggaagcttttctactcagcagatgcagtgtgttttgatgttgacagcacggtcatcagagaagaaggaaccaacattcaaagcagctgccaactattccaagtttcccagctggaggagccctgacctgcaccttcgcagaagccctgaagcagacaccccagggagcacctaccaggggcacccccggctggcaccagcatacaaagtgagacagggtctcgccttatttcgcaggctggtctggaactcctgagctcaaacaatctacccacctcggcctcccaaagttctgggattacaggtgtgagccaccttacccagagaggcgaacctggattgggaaagtcgacattaatcaactcattattccttacagatttgtatgctccagagtatccaggtccttctcatagaattaaaaagactatacaggtggacaatccaaagttttaatcaaagaaggtggtgttcagttgctgctcacaatagctgacaccccaggatttggagatgtagtggataatagtaattgctggcagcctcttatcgattacattgatagtaaatctgaggactacctaaatgcagaatcacgagtgaacagacgtcagatgcctaatagcagggtgcagtgttgtttatacttcattgctccttcaggacatgaacttaaaccattggatattgagtttatgaagcgttcgcatgaaaaagtgattatcatccaacttattgccaaagcagacacacttataccagaggaatgccaacagtttaaaaaacagataatgaaagaaatccaagaacataaaattaagatatatgattttccagaaatagatgatgaagaagaaaataaacttgctaaaaaggtaaaggactgtttacctcttgctgtggtaagctagtaatactatcattgaagttaatggcaaaagggtcaaaggaaggcagtatccttggggtgctgctgaagttgaaaatggtgaacattgtgattttacaattctaagaaatatgctgataaaaacacacactcaggacttgaaagatgttactaataatgtccactatgagaactacagaagcagaaaactggcagctgtgacttataatggagttgataacaacaagaataaagggcagctgactaagagccctctggcacaaatggaagaagaaagaagggagtatgcagctaaaatgaagaagatagagatggagatggagcaggtgttagagatgaaggtcaaataaaaagttcaaaaactaaaggactctgaagctgagctccagtggcgccgtgagctaatgaaaaagaatttggaagcacagcacaaagaattagaggaaaaacgtcgtcagtttgaggatgagaaggcaaactgggaagctcaacaacatattttagaacagaactcttcgagaaccttggaaaagaacaagaagaaagggaagatcttttaaactctctattgaccaccagttacgtattagttgccaatatgccagcttggacatcagtgtttgttggatccgtttgaccaatatgcaccagtttcatccataatgatggatttaacagcgtgacaaaaattattttttcttgtttttcttgatggagattaagatgccttgaattgtctagggtgttgtgtacttagaaagtaacagctctaagtacctttcctacattttctttttcttttttttattaaacagatatcttcagtttaatacaggagaacattttactgttgtacaatcatgttctcgtggtttgattgtttacagcctattccaaaataaaaggactgtggaaggttaaaaaaaaaaaatagttaagggccaggagcagtggctcacacctgtaatcccagcactttggaaggccaaggcaggcagatcacttgaggtcaggagttcgagaccagcctggccaacatggcaaaatcctgtctccactaaaaatacaaaagttggccgggcatggtggcacgtgcctgtaatcccagttacttgggaggctgaggcaggagaatcacttgaacctgggaagcagagactgcagtgaaccaagatcacgccaccacactccagcctgggcaacagagtgaggccctgtctcaaaaaaaaacaaaaacaaaaaaaaaaacaagatggcaaattatattttgtgtatattctaccacaactttttaaaaactcaaatcaaaatctgactgtttgtaaagatcaataaaattgacaagattccagcaaaactaacacacacaaaaaaatgactactatggtttgaatatcatttgtcctcaccaaatctcatgttgaagcttggtctgcaatgtagcagtgttgagaggtggtacctttaagaggtgattaggttgttaagagggattaatgtcgttctgaaaggagttctcactcttggagaagtgaacccacaagagtaggttgttataaagtgaggatgcctctcatgtttggcctctctttgcaaacatgtgcttccccttgcacttctctgccatgttatgacacagcacaaagccctcaccacatgcggcaacccatcttagatttctcagcctccagaaccataaaccaaataaatctttttcctttataaactaccaactctcgggtattttgctatagcaatagaaaatgaactaaaacaggaatgaaaggggatttcactatagactccacagacattaaaatgacaataaggttgggtgcggtggctcatgcctgtaatcccagcgggcagatcatgaggtcaggagatcgagaccatcctggctaacacggtgaaaccccgtctctactaaaaatacaaaaaaattagctgggcgtggtagtgggcacctgtagtctcagctactcaggaggctgaggcaggagaatggcgtgaaccctggaggcagagcttgcagtgagccgagatcacacaactgcactccagcctggacaacggagggagactccgtctcaaaaaaaaaaaaagaagacaataaaagagcagtatgaacaactccacacacataagtttgatatctttaaatgaaatggaccaattcataggaaatgacaaactaccaaaactcacccaagatgaaatatgtaacctgaacagctctgtaactattaaagaaattgaatttatagtatgaaattttctgaaataacaatctccaggcccaggtgctttcactaactaatttctaaccaacactttaagatgatgtaacaccaactctacagaatcccttccagaaaaaggagggaacaacatttctccactcatttaatgaggtcagcattatcctaaagccaaaatcaggcaaagacagtacaaagaagcaaaactaaagaccaatttcctaagtgaacataaacacaaaaatcatcaagaatatattagcaaatcaaactcaggaacataagaagagtaatataccacaccatgtagggtttatcccaggaatgctacacttgttcaatattcaaaaaatcaatcaatgtaatctaccatgttagaagtctaaatcactggtcagcaaactacggtccagaggccaaatccagtcctgtacttggtctttgtaataattttatcggaacatagccatgtatatttgtttacatacagtctacatctgctttcatgctacaatagcagatatcagcagttacaacagacagcatattgccagcaaagcctaaaatatttactatgtgaccccttacagaaaaaaatgtgggaggtcaccaccattagacctgccttacaagaaatgctaaagaaagttcttcaaattgaaacaaaagaactctaaaaacataaaaacatattaaagaataaaactcactataaagataacaatatattcaaattcagaatactccaatactgtaatggtggtacctaaatcagatttaagtctagtataaatgtaaagagacaaaagtattaaatattaactatacatacaacaatttggtaatggatacatgatatataaaagatatacattatgaaatcaataatacaaaatgtgaaaggagacgttaaatgtaaagttgtggtatactgttgaggttgtcagcttaaaatagactattaacactataagatgttttatgtaagcttcatggtaaccacaaaaaaaaggctgtagtagatacataaaccagaaaagaaccaacgcatatcactatcaaaaaaatcatcaaatcacaaaggaagacagcaagagaggaagactgaaacaaacaaacttacaagagtcagaaaaattgacaaaatggcgatagcatctccttgcctatcaataattattttaaatggaaataaatttaatactccagaagacacagattggctgagtgattttttttttaattttttcatttcattttattttttttgagatggagtctcgctctgtcacccaggctggagtgcagtggcatgatctcagctcactggaaaccccacctcccaggttcaagcagttctcccacctcagccacctgagtagctaggattacagacacatgccaccacacctggctaatttttgtatttttagtagacatggaatttcaccatattggccatgctggtctcgaattcctgacctcaggtgatccacctgccttggcctccctaagtgctggtattacaggtgtgagccaccgtgcctggccgagtggatttttaaaaacaagatccaatgatatgctgcctacaagatacatgaaacagaaaatcaaaagcatatcactaccaaaaaatcgtcaaatcacaaaggaagacggctagagaggaagactggaacaaagaaactacaagagtcagaaaaactgacaaaatggcagtagtaactccttacctatcaataattattttaaatgaaaagaattaagctctccaataagacacagattgaatggatttttgattgtttaagacggagtctcactctgtcgcccagactggactgcgatggtgtgatctcagctcaccgcaacctccacctcctgggttcaagcgattcacctgcctcagcctcctgagtaactgggattacaggcgcccaccaccacacccagctaatttttgtatttttagtaaagatggggtttcaccatgttggtcaggctggtctcaaactcctgacctcaggtgatctacccacctcagcctcccaaagtgctaggaatacaagcgtgagccactgcacccagccaagcggatttttaaaaacaagatccacctatatgctgcctacaagagactctctttagctttaaaggactgaggctgaaagtgaagagatggaaaaagatattccacacacatgttaaccaaagagagcagaggatccttacataaaataaaatagactttgagtcaaaaagtgttaaaagagatcagaggtcaattcatcaggagaatgtaacatttataaatatatatacatgccccaatttggagcacctaaatatataaagcactatcaatagaactaaagggggaaatagcaataccgtaatagtggggaacttaaataccccactttcgacaacggataaataatccagacaaaaattaataaggaaacacagacttgaacattacagactaaatggacctaacagacacatacagaacattctagccaacagcagctgaatatacattcttcttaagcagacacagaatattctccaggatagatcatatgttaggccacaaaacaagttttaacaaattcaagaagaatgaaatcatttcaagtatctttctaacaacaattgtatgaaactagaaatcaatgacataggaagaaagctagaaaattcataaagaaatcaaaagggaaaatctgttaatatggttgtcatatttacaaatcaaggaaaaatgatcatctcaacaaatgcagaaaaaaaacagatataaatgcagtaagacttctatgtccacgggttccgcatctgtaaatccaaatgactatggatcaaaaaaatattatttgtttattactgtctctttagctgtatactccatgaagactagaaatttgttctattcactgctgcacccccaacacctaacagcaccagatgaaacataagcactcaatatatgttttgttgaaagagtagatggttctataactcaggacaaaaatatggattcaataacaaatattgagataacagcctaacaattctgaaaagcaagttacagttctgtctcccactgaacaaaataataaaatttcacagggaatcaaactttaaaacaaagccacttaatactggatgttgtgtcattaagctaagtgataagaaataagacactttaataccataaaggaacaggctaaagtgtcataattagcagaaaatatcactaatgtctacttagaaaatacaagtttatcaactgaaatgttaaaagagttctttaagattgtcagatcaacacagtaacatataaacatcaataacttttctatacagcatacagtagaaataattattctactgtaatagaaagagatatcaacaacaaagttactaggaataactttaataagtaatataaaactctacttatgaacataaaggaagaataaagtatcctgagacacaaacctaattttttttaaaaagggacaaaggatatgaacaacaaattcatttttgaataagaaattcagacacaattaatcaacctatagaatatgataaagtgctcaactttaccaagtaatcagggaaatcgaacaatgatatgaaaaatgaaaactactggtcaggcctggtagctcaagcctataatcccagcactttgggaggccaaagcgggcagatcacttgaggccaggagttcaagaccagcctgaccaatatggtgaaaccccgagatctctactaaaaatacaaaaattagccaggcatggtggcacatgcctgtagtaccagctactcaggaggctgaggcacaagaatcacttgaacctggcaggtggaggttgcagtgacccgagattgcaccattgcactccagactgggcaagagagcaagactctgtctcaaaaaatagtaataataataataataattaataaaaattgaaaagaaattttaaaaataataatttttaaaatgagtgaatgagaaaaacaaattctcaatagaaaaataacaaatacagtccaacaactgaaagagtgaaagtctctgaacacatgagatattcaactaaacaattttagaaatggaaatgaaagcaaggagtatcatttcagataccaaattagcaaagagtgataacacactctgctagtcaggttatgggaaaatcgacactagtaggagtgtaaactgaacaatcaggccgggtgtgctggctcatgcctgtaatcccagcactttgggaagccaaggtgggtggatcacttaaggtcaggagttccagaccagcctggccaatatggtgaaactctgtccctactaaaaatacaaaaattagccaggcatggtggcacactcctgtaatcccagctacttggggtggcttgaacccgagaggcggagcttgcagtgagccgagatcgcagcattgtactctagccttagtgacacagggagactctgtctctcaaaaaaaaaaaaaaaaattgaagagaaaaacacaaggaaaaaaatccatgcaaaatcaatttttcagaactcctcgattaaaaaataatgtcaaacattaagaggaatatccattttgcttacagacatacctcattttatttcacgtcacagataataagttgtttgtttgtttggggacacagtctcactctgctgcccaaactggactgcagtggcacaatctcggcttactgcaacctccgcctcccaggttcaagtggttctcctgcctcagcctcatgagtagctgagactacaggcacgtgccaccacacccagctgattttttatttttagtagagacagggtttcaccatgctggccaggctggtctcaaactcctgacctcaggtgatctgcccacctcggcctcccaaagtgctgggattacaggcgtaagccaccacacccagcgagttttttttaaaatagcaaaggcttttgtcaaccttgcactgaacaagtctttttttttttgagacggagtcttgctctgtcgcccaggctggggtgcagtgggatgatcttggctcaatgaaacctctatctcccaggttcaagcaattcttctgcctcagtctcccaagtagctgggattacaggcgcccacaaccacgcccagctaatttttgtatttttagtagagacagggtttcaccatgctggccaggctggtctcaaactcctgacctcaggtgatccacccgcctcagcctcccaagtgctgggattacaggtgtgagccatagtacccagcctgaacaaatctactgacaccattttccagcagcatgcactcactttgtgtctctgtgttacgttttagtaatcctcaaagtattttgaactttttcattattattatatctgtgatagtgatctacgatcagtgatatatatatattttttcctttggttgagaaagggtcttgttctgtcacccaggctggagtgcagtggcacaatcacagctcactgcagcctcaaccttccggactcaagtgctcagcctcatcggtaggtgggacaacaggcatgtaccaccacacctggctgatttattttttatagagatggggtgtcaccatgttgctcaggctagtctcaaactcaagcgatcctcctgccttggcctcccaaagtgctgggattccaggagtgagctaccatgctatctttgatgttactattgtaattgttttggaacaccatgaaccacgcccacataagatggctaacatataatgtgtgttctgactgctccaccaattagccattccctatctctctttctccctcttttcagacctcccgtttccccaacacacaaccatattgaaattaggccaattagttaaccctaatcctacaatggcctcaaacaattcagggaaaggaaaagtcatgtgcctctcactttaactgaaaagctacaaatgattaatcttagtggggaaggcatatcaaaaagtgagaaaggcctaaggctagacctcttgtaccactcagccaattgtgaatgtaaatgaaaaattcttgaataaaattaaaagcactatgtcagtgaacatgaaacaatcttgttgctaatatgaagaaagttttagtggtccatatggaagattaaaccagccataacattcccttaagcaaaaagcctaatccacagcaaggctctaaccttcttcaattctatgaaggctgagagaggtgagaaaactgcagaagaaaaactggaagcaagtagagattggttcatgaggaaaaatgctctcgtcataacataaaagtggaaagtgaagcagcaagtgctgacatggaagctgtagcaagttatctagaatatctaactaagatcattgctggaggtggctatactaaacaaggtgttttatgtagacaaaagagccttccattagaagaagatgccatctaggactttcacagctagagagggaaaatcaatgccttgcttcaaaggtcaggctggggccacacctgttatcccagcactttgagaggccaaggtaggagaatcgcttgagcccaggagttcaaggccagcctgggcaacaaggcgagactcttgtctcttttaaaaataataaataaataaataaaaactgactctcttgttaggggctaatgcagctggtaacttgacgttgaagctaatgctcatttgccactcaaaaagtcctagagctcttaagaattatgctatatctaatctgcttgctgtctacatatggaacaacagtctcctggatgacagcacatctgtttagaggttggcttactgaatattttcagtccactgtcaagacctactgctaaggaaaaaacattcctttcaaaatattagcactcactaacaatggaccaggtcattcgagggctttgatggatatgttcagaaagaagaatgttactttcatgcctgccagtacgatacatctatcctgcagcccacgtatcaatgagtaatttcaatttttaagtcttactgtttaagaaatacatttcggccaggtacggtggctcatgcctgtaatcccagcactctgggatgccaaggcaggcggatcacttgaagccaggagttcaagaagaccctggccaacatggcaaaaccctatttctactaaaaatacaaaaataagccgggcgtggtggcacacacctgtagtcccagatactcgggggagctgagtcaggagaatcgcttgaaccaggaggcagaggttgcactaaaccaagatcgcaccactgcactccagccagggcgacaaagcgagactccgtctcaaaaaaaaaaaaaaaaaaaagtgattcctgtagtagatttgggcaaagtaaactgaaaaccttctggaaaggattcaccaccgtagatgtcattaagaacattcataattcatgagaggaagtcaaaatatcaacatgaacaggtgtctggaagaagttgattccaactctcatggataactttgaggggttcaagactcaagtggaggaagtcattgcagatgtagtggaaacagcaagagaattagaagtggagcctgaagatgtgactggattgctgcaatctcatgataaaacttgaacagattaggagttgttccttacagatgagccaagaaagtggtttcttaaagatggaatctactcctggtgaagaggctgtgaaattgttgaataacaacaaaggattcagaatactatataaccttagttgttaaagcagtgtttgagctgactccaattttgaaaaaagttctacttttgggtaaaaaatgctatcaaacagcatcacgtgctacagagaaatctttcatgaaagaaacaggcaatcaatgtagcaaacttcattgttgtcttattgtaagaaactaccagaggcaccccaaccttcagcaatcactgctgggatcagtcagcagccaccaacatcctctatcagcaaaaaatcttacaatttactgaaagctcagatgatcagtagcattttttagcaataaagtatttttaaattaaagtatgcacattggttttttaaatataacgctactgaacatttaatagactgcagtagaatataaacataatatttacatgcactggtaaaccaaaatatttgtgtgccttgctttatggtgatactcactttattgtggtagtctataatggaacctacagtatctccaaggtatgcctgtatttactttggtaccaattctagatatatatctgcatatacccaggtatttaacttcctggtctcatgttccttaaatagttaataagaaagagtaattatgaaccatgcagagcaattaacaagcctaacttccaatattttcttcactctgaagtaagtatttccaacagtgtattatgtcagaagttctcagttttgggggtgctgtatcttaatttttctgtactctattttcaacttcactgaaataatacaagctctatcttccttacaaatttataaggaatcaaatgaaatgaaatatataaaagttgtcctctttctcccatcttcaaaaaacttcccccgcacttcatttcctgttagccctctctccttcaacagcctggtctgtagaaagagtccatacatggcctccctccactccctcatcttccattcattccttgttccaaggccctcccaacaccactgaaacttttttcaatgccctttttttaaattattattatttttttaaaaagcaaattctgcccccatcttttcattctttcagttgaaccactttttccaaaacactgtgcagatataaaaaatacgtagttaaggccagggtgcagtggctcatgcctgtattcccagcacttcgggagtccaaggcaggcagaacacaggtctggagttcaagaccagcctggtcaacatggtgaaaccccatctctactaaatatacaaaaataagccaggcgtggtggtgggcacctgtaatcccagctactcaggaggctgaggcaggagaatcgcctgaacccagaaggtggaggttgcagtgagccgagatcatgccactgcactccagcctaggcgacagagtaagactctgtctccaaaaaacaaacaaacaaaaatggacaaaggagccaggcgtggtggtgcacacatagagccccagctactcagaggctgaagtaggaggatcacttgagctagaggatcacttgaccccaggagttcaaggctgcagtgagctagaactgtgccactgcaatccagcctgtgtgacagagtaagactccatcaaaaaagacaaggacaaagacatgacaagagagaaaaaataagtataaaagacagagagagagagacttcaaaaaggaggacagggcagggcacagtggcccatgcctgtaatcccagcactttaggaggctgtaatgggaggatcacttgagcccatgggttcgagaccagcctaggcaacacagcgagaccccagtatctacaaaaactagccgggaatggctgggcatggtggctcacacctgtaatcctaacactttgggaggccgaggcaggcggattgcctgagctcaggaattcgagaccagctgggtaacatggtgaaaccccatctctactaaaatataaaaacttagccaggggtggcagcatgtgcctgtagtcccagctacttgggaggctgaggcaggagaatcacttgaacccaggaggcagaagttgcagtgagctgagatcacaccactacactacttcactccaggatgggcaacagagcgagactccatctccaaaaaaaaaaacaaaacaaaacaaaaaacaaaacaaaaaaaactaggctgggcacagtggctcacacctataatcccagcactttgggaggccgaggcaggcagatcacctgaggtcaggagttcaaggccaacctgaccactatgatgaaaccccacctctactaaaaacacaaaaattagctgagcatgggggcatgcgactatagtcacagctactcgagaggcggagacaggagagtcgcttgaacccgggaggcagaggttgcagtgagccgagatcgcaccattgcactccagcctgggcaacaagagcgaaactctgtctcaaaagaaaaaaaaaaaaaaactagccgggcacagtattgcgcacctgtattcccagctacttgggaggctgagatgggagggtcatttgggcccagaaattcgaagctgcagtcaactatgattgtgccaccgcactcctgcctaagtaacagaatgagatcttgtaatttaaaaaataaaaggataggtaggatttacagactggaaaatgggaaaaagatgagagtggaaaaaggaaggaggggtagcacgaatggcgggcaggtggacagaaaagtaaaattcagccatgttcaaaagggaacaaataaaagcaccgaaaggtaagacagacctagtatatttatgacttgaatcccaagctacgaaactggaacataatttagcagagagactccaaaagttttacagcaaaaagtattagaatcatttatatactgggaaaaaatagcctcctcattttaataatccagattgggaaatcagatctaaaacagatgttcaatggacatcccatttcttttgtaaaagcaacttgagtggtcagtcatcaagttttgttctgtttttaattcacaatgaaaatctgactactcatttattcaacaaatatttgagtgccagctatgtgctaggcactgttctaaacacgccaataacatttatttagtgggattgattctgtactctagaacaatggttcttaactggggagagggagtaatttttgctccccaagggacatctggcaatgtctaaagacatttttggttgtcacgggggcagggagggggggaggggtgcgggtgtgctactatatctagcgggtggaggccaggaatgctgcttaacatcctacacacaggagatactgcccatgacaaggaattagctagtccaaaatgtcaacagtgccaaagctgaataaatctgttcaagagcaacacatttctattccctcttccatagtaattgttaataaacattagttccattttctactatttctgttctacaatagaggctttaaaatatcttaagaaatataacaccattttaataatttggcaagtagaagtaaagataccatgaatcctgagatttcactttcaaaaatgtataagctacatttattttacaatataacttttaggaacaaagttgtcttctccttctgacactgactgttatcaaaaactgtgctaaaagctttgagtgatgtttgattattccttttattttggggtccttatagcagttaattaccacattctgccagttctttccaagtgaatgcctcacatttcaacggatccttttctattaccaatgtatcatctgaaatattttactaactggtttttctgaagctcaatgtccatgtctccttccctcccaagctatccctacccattaatactgtatttttcacctgctcaaaagtccatatggttgcccgtaacataccaaataagaacctaattcctaaagcttgacattcaaatccttttttcaactagctacaatccacttttccaactcttttttccactgctctccctcaggagtagccttttttagcaaaatgacttattctgagatacataaacaacctttccagatcagagacatcaaaagccattcaggcttcattgagacaaaagatacgcattcaactcagaataacagtaagaaatcaacttatagggaaaccagatctagccatgttctataaacatgagagataaccctgttggctcatgccactgtccttatttataacggcccctatttgcctttctacttctctgaactccttatccttcaaatctaccatcttttcaaaaacccaaacacagagtcacctcagtcaccattacctgcccttcccccaccccacccaatgcctgtggctttcaggtcatttattttgcaataaacttgtcatctcaattttactggttctcttttagattcagacagctgagattatgatagattcattagtaagctgaatggggaagaaaaggatatttacattcccaggccaattttcaatgctttttggaagattctgttaaattcacaatttccagaactggcaaggaataggtaaatatatacactcatatattactggtaagagtataaattggtataattatcctaaagtgatatctgccaacattgaaagtctttaaaatctgtatactctttggcctaggaattcaacttgaaaatttatcatgagtaaattataaaatgtacaaaggtttaactataaagacactcatctctgcattgtttctaactctcaaagattgaggtggaggggaaaattccttgtccaataaaaaaagactattccatgaatcatttatttaagtaatgtaatactctgcaactactaaaatcctatagtatcatggttattgacatgtaactcttttaatggctttctttcctaagctaagaaaaatacaaacatgattccacataatgtatttcaaatatttgtatacatttttctacttttctatattttccacacatctatatataatttgtgtgtgtgtgtgtgtatgcatgcatgtaaataaaatatacctctaagtcttgtaaccttaagatggtggggcaaaatatttttattttctgttgttgattatttaaaatttagctacattaaattttttctgatttagtaaacatacataaggcctatttatagttgaatggcagtcttacaaaacctaagcaaccttagtttacattatctgtgggaaaagcatttttagtagaatgcttgcacatcttcctacattcctgtaatcaaacagtatttatcatcaactatgttggtgactctcactttgacataggctgaaccagaaatcctaggaaaaactgatgatagaaagctaaggggaaggacaggaagccgggaaaccctgggaaaggagggattatattacacatgttatgggaactagtttgtatatgcggggcacagagcatacacttagataagaagggggtcataaaaccagaaaggcaataaatagaatgttatgagcatgaactctagatgcagactgtttaggttcaatcccacctctgcttcttactacatttattaccttaagcaagtcacttaacttctccctgccgtttctgccccatctgtataatggggataacagaccctaccttagagggttgtcacactaatgaattctgagaatagtgcctggtactacagttaagtgctcattagttgtccacactcatcatcgtcattactcctattactatgacgtgaagagttgtgctgctaggacaggagcagcaacttttcaacaccaatcacttttttagatggcctcctttctagccttgttagttgcccaaattctgaaaaaaaaaacaagaactaagactctagaaggagatccgagaggcagacatgtgtgtctgtgtgtgtgtgcgtgtgtgtaggcgcgtgtgcatgtagatgaaggaggaatcaggagtaatgccaagaatgagaaatctgtataagcagttcagaaaaggggcatcatgagtcactctcctcagtgctgccccaagagttccacagtttgttccttacatcattcacttggataaaacctttcaatgtctctccatggccttcagagttaaatcaaaactattccttggaatgacttaaaacccatactacctctaaagcctcatctcttgactctctcgcaccaagctcactgagcttccagccctactgaatttcttcagtaacaaactctcacatctcagagcctttgcacatgctgctccctctgcctgaaaagtaacctctacctcctccaatagcaaactgctactcaaccttcaaaatgcagctcaaggataactccagagctctttcctgatttcaagctaaatgcctctgctatattatcccccatgtgcataacaccaccaccaccaccaccaccaccaccaccaccaccaccaccaccaccaccaccaccaccaccacgctgcactgatccaccactagccgatgactcctttagagatcttgtctttgggtatttccagatactgtcctatacagtaacagatacattaaaaataataattttaaaaatttattaatcacagctggaaaatacagtgaacctactgattacactggaaactggtaaagaaaggtaaacaagcaaacatttattctgcctttcccatatgaacagttacactgggcaaccaagtaagaggtgatggaaacttttctttttataaaacagtattccagataataaaatgaaggagtaacacaactagaacattatcattttacaactcttaatgaatcaacagatctaggcattagtcaccaacagttgctaatgtcacaaaaagagacaaccatattttgtgcctcctgatgaaagaatgcaccacaatataagaagcagtcttataaaataagactgaacctgactctgaccaagcctctggttctaactactcatttggaaatacagaaaatagagaaacatcggggataaacctggtattgaatctcaggaatcagcaaaatcctgactacaggaactctacagggcaaataacccatttctttaacaaataaattgtgagaataaaaaggaaggtggtatcctacagattaagacacttaatcgcaataagtaagccttattcaaatacttttaaaaattgagacgtgttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaattgagacgtgtttacctgaacatagaatatgatgatattatggatttaactgtcaatttttttttaagtatgatggtggtattaggtttttcttaagccttcactttttagaactacattctctaatatttataaacgatatcacattatgcctgaggccaggtgcagtggctcatgcctgtaatcccagcactttgggaggctgaggcgggtgaatcacctgaggtcaggagttcaagaccagcctggcaaacacagtgaaaccccgactctactaaaaatacaaaaattagcctggcgtggtagcactcacctataataccagctacttgggaggctgaggcaggagaagtgcttgaacctgagaggcgaggttgcagtgagctgagatcataccactgcactccagcccgagtgacagaatgagactccgtcaaaaaaaaaaaattaataaaaataaaaataaataaaagcacagaccctacagaaaagactgcctgggttcaaatcctgtgtccatgactcactctgagccttagcttcctcagctgttaaaaaagaaaaaaaaaaaaaaagggacaatagtagtctttacttcagaggacttttgtaagaattaagtgagttaagatggttataacatatagttctcccaaaacagtgcttcatagaagttttcattatcatcccccttcccactttacagaaagaaacacggacctggagaggtgaaaagtgacttgcttaatgacttgaaaaccatcttccaggaactgtgcttagcactggtggcaaaaactggctatttaccaaagcgtttccttttcctcctggcatatggctaaactacatttcccagcttccctttcacatgactggtctggacaatgaaatgtgggcaaaagtgaaagatgcctctgtactactcccaggccttgtccccaaacctcccatgcaatccctcaccgcttctcaccctcatttgccaggtggacatcaatgcctagggcaacggagaaaagattagcctgagtcccagtatgacttaactgttactgtgttactcttgaaatttcggccaccataaagtcagtaagactgtattttttatggactcatcacaacaaccattattcctattcaacagttgaggaaactgaagtataaagaaagtcatggtcaattactcaatggtagatccagaacttgaaccagcactgtcttaatacagagctcgggatcttaagtgacttccaagatcacaagaccagtaagggcaccaagatttctaacttagagtagatacattttatatagaattttgttaagtattccttaaaatatcactttaatatgccataagaataaccacagaatagtgttactttaaagtaaaaagatataaataggagcccaaaatgttaagtggggttttacaatcaagaagacacaccagaataagatattttttaaataccatgtacattaaagagatcatacttccttaccctaataaacagccatgtagtacaagttttaactttttaattaaatattaaaattattaaaaatattaaatatacaacttctatttggttttatctgagccattcctttatactgacagttacatgatgtgatttcagttatatatgtagttattggtaatttttcaaaaatagaatataatgaaaaaacttcatttcaatcattactgaactgcacctacattaatcacaatatacctatgaaaagatgtataacatatactagtatgccaaaaaaaaaagtgacaaaacagtatttatagtataattccatttttttttttttttttttgagacggagtctcgctctgtggcccaggctggagtgcagtggtgccatctcggctcgctgcaagctctgcctcccgggttcacgccattctcctgcctcagcctcccaagtagctgggactacaggcgcccaccaccatacccggctaattttttgtattttttagtagagaccgggtttcaccgtgttagccaggatggtctcgatctcctgacctcgtgatccgcccgcctcggcctcccaaagtgctgggattacaggcgtgagccaccgcgcccggcctaattccatttgttttcaaagaatatatatgcctatgtctgtatttttttctacatacatacacgtcttatctacaaaccaaaaacatctagaaaaatatacaaaaaaagcttccagtgataacctctggggagtaaaactgaacttgtgatgtataccttttcttagaatttgaatttatgaaaagcacatatacctttagaataaaaaatactttaaagctctatcatttacagtaatgcaaagtgatccaactctgaaattcccacataatcatgttatgcagtgaagctttctaggctggggggaaaaaatgtaacctcttcaaaaaaaaaaaataaataaataaaaataaaataaaaaaattgtaacctcttataatgaatatataaatatatataatttcattaatttcattcattatgggtatacatttatacatctatttacaagtaagtctgtttaaatacacatatccacacctgctaaataaataagtatgctctggccaggcgtggtggatcacgcctgtaatcccaacactttggaatgccgaggtgggtggacctcctgaggtcaggagttcaagaccagacttgtcgacatggtgaaaccccgtctctactaaaaatacaaaaattagccgggcatggtggtgtgtgccagtagtcccagctactcgggaggctgaggcagaagaatcgcttgaacccgggaggcggaggttgcgtaagccgagattgtggcaccgcactccagcctgggcgacagagcgagactgtctcaaaaaaacagaaacaaacgaaaaaagtatctaatcaggagattttggtaagcttttcaagcacacccttttttgtgaaactgagttctaacctgaagaatacctgggattgtatggcgaaaaaacacaatatattaaaattttaaaacagttcttattttaggctcaaattttatgttttggggactacttagacttttttttttttcctgggatggagttttgctcctgttgctcaggctggagtgcaatggcgtgatcttgggttactgcaatctctgcctcccgggttcaagcgattctcctgcctcagcctcccaagtagctgggattacaggcatgcaccaccatgcacagctaattttgtatttttagtagagacagggtttctccgtgttggtcatactggtctcaaactcccaacctcaggttatccgcctacctcggactcccaaagtgctgggattataggcatgagccaccgcgcccgaccaactttttgtatttttagtagagatggggtttcaccgtgttagcaaggatagtctcgacctcctggcctcgtgatctgcccgcctcagcctcccaaagtgctgggattacaggcatgagccactgcgcccagccaactgtcactcttaatttttttaaattaaaagaaattaaatttctcaattctggagactggaagtcccagctactcgggaggctgaggtaggagaatcacttgaacctgggaggccgagactgcagtgagcagagatcgtgcagcctggtgacagagtgagactccgtctcaaaaaaaaaaaaaaaaaaaatactgtcacttacgtcactcagtttgtggtattttgttatggtagctctagcaaactgataggagaggcctctagtttacactatttaaattttctaattatttactttttttttttttaaatacctggtggagtgcagtggcacaatcacagcttactgcagcctcgaactcttggcctcaagcaatcctcccaagtagctgggactacaggcatgcaccaccatacctggctaagttttatttttttgtagacatgaggtttcactatgttactcaggctggtcttaaactcttaagctcaagtgatcctccagccttggactcccaaagtgctgggattacaggtgtgagccaccatgctcggcctacacgaactttttttaaactagcaggggttatgtgaatagtgggattacagacattttcttcattatgctggtccatatttaaatcctctccccctcgcaaaaaaaggtaaaaatatacagccataaaaaagaatggaatcatgtccttcgcagcaacatggatggagctggaggctacactctttttcatcctctatcctaaaagaagtaactcagaaccagaaaatcaaataccacatggtctcatttgtaagtgggagctaaacaatgagtacatgtgaacataaagatggaagtaatagactagagattccaaaagagaaggtagaagaggaggcacacaggttgaaaactacctattgggtactagggtcactttggatgatggctgcgctagcaggccaaacctcggcattacataatctagccatgtaacaaacctgcacgtgtaccccctgaatctaaaataaaataaatttttttttaaattgtaaagaaaaaaagtattaaatgacataactaaatattctagacatcattctaccataagttgtccaagaaaaaccacattttaccttactgtttatcatttgaaataaaatattatgttaagatattttaaatttttaccagttccacaaaggaactaggaagtagaaactgaagaacactttgttaaacaagtccttggggattaaagaagtaatagctacgaagtatacaacagtgtgatgagtgaatccttctcatattggggttaaaatggtcattatagctactgagtaccacaaatccaatcaagttaggtattttgtatacattatcatttaattctcattacaacccatcacaatagatgttaattagtatgtcccctatttttcggataaggacattcaagatcaaacagattaaatggtcaaggtcatacaactaagaaatgaaagtgctgagactcaaacccaagttcatgtcttaaatcccatgccgtttgatattaaggaccatgtgtgtttaacaaatattagacacctgctacacacacacacactgtgccagatgtataagatagagccatgacccaagaaatacagtcactattctcaaaaaacttagaatctctgccaggagcaacggctcacgcctgtaatcccagcactttgggaggccgaggcagatggatcacgaggtcaggagttcaagaccagcctggctaagatggtgaaaccccgtctctactaaaactacaaaaattagccagtcatggtggcaggcgcctgtaatcccagctacttgggaggctgaggcagagaactgcttgaaccagggaggcggaggctgcagtgagccgagattgcaccactgcactccagcctgggcgacagagtgagactgtctccaaaaaaaaaaaaaaaaaaaaaaaaagccttaaaatctcctctttaacattctgttgcatgtatgtttttcctaggttttttgtcgttgtttgttttttgtttgtttttttgtttttgagacagtcttgctctgccacccaggctgaagtgcactgactggttccatctcagctcactgcaacctccgcctcccgggtgcaagccattctcccgcctcagcctcccgagtagctgagattatggtgcctgccaccacgcctagctagtttttgtatttttagtagagacagggttttgccatgttgaacaggctggtcttgaactcctgaccttaggtaatctgcctgccttggcctcccaaagcaatgggattacagacatgagccactgcatgcccggcctttttttttttttttttttttgacacagagtctctggcacacaggctggagtgcagtggcacagctcactgcaacctctgcctcccaggttcaagcaattctcctacctcagcctcctgagtagctgggattacaggcacacaccaccacaccgggctaatttttgtatttttagtagatacggggtttcactatattcaccaggctggtctcggcctcagcctcccaaagtgctgggattacaggcgtgagccactgtggccgttcttgtttttcctgtctttgtaactagactttaaagctcctcaaaagagctggagtataaacgaaaacacaaagagctttgagtctcagatctggaaaaattctagctttatcatatacatacataaatttaaatgctggattcctcaccagtaaaagggtcttggattaagtgatataaagtagtcctgtgcttatccataggaaatacatttcaaccccataccctacccctgcctggctcccataaatgcctgaaaccacggatgctacaaagccctatatacactatgttttatatttttctttgcctgcagtgaattccctctcttggcaatgccttataagttaccatgcaaaaaaatataaatgtatctcatttatctgttctcccctaccccccacaaccctacctacctctcacaggaccaagaattggaaaggccttagtgtagccaccacctaaccacagaaatgatccaaactcacatactactacttctttatttttcagtaaagttctccaaactaaaatgaaatatgcagtttgaaaataggtagtaaaaatacagcttttaaaatatatcctctatgctgtttcatagccacttcacaatgaccctacttccccatttataactcacctagttagttattagtaaacaactcttaatcaaaagtaaaaatgaagggctatggaactgttctcatatccccttcagtgtcttaaaggcactgtgctcagcattccacatgcattatcttattgaaagcgcagtgtttaatgaacttgcctaaagtcacatcagaaccaccaggaagcacaatttcattgtattttgtgtgaatgccctccccagcacaacaagaacggagctgtacaatgaagtggtctgggtcacacagctaattaagtaatggagttaaggctcaaaaactcttcagtatctgatgagaaagctcacactcaaaacctccaaaaaacactgcttcacatcactgaaattaaagaacaataatacaatataagtaaaataaaatgagaattccttgttatataataagccagtttatcagctttttttgaaggaagaaagggcaacatagtgatatcttgtctctactaaaaatttaaacattagccgggtgtggtggtatgcacctgtagtcccagctactctggaggctgagtagagggaggattacttgagccagggaggttgaggctgcaaggagccatgactgcatcactgcactccagcctgggtgacagagtgagatcctacctcaaaagtggtgttttgtttttttccaccaccccaatgctacctctataactcacacatgatagttttataaagataactacctggcattcaggttaaaatgacaactgcacccagaataggaaaaactataaattatgcattggactctgcgatcaccagcccctacttgtaaatttcaatggagattcactttatttcaaaattagaaaactgatctcagagtttaaaacctcatttacagctccaaaatatttagaatctagaattatataacaaatacttactttcttagcatgcaaaaattatttacaaatcatttaaaaaggatgatcgacttaacagaaaaatgggcaatgacaaacagactattagttacctaaccaatagccactccccactcacaacctgttccttacagagtccacttcccattatcatggctgcaaggaacatccttgctctctcaccctcacttgtatctaggacatggatggataccaatcacggctgatgggatttaagaaaaaaatctgttggccgagcgcggtggctcatgcctgtaatcccaacactttgggaggctgaagcaggcagatcacctgcctgaccaatagagagaaaccctgtctctactaaaaacacaaaattagccgggcatggtggtgcatgcctgtaatcccagctactggggaggttgaggcaggagaatcgcttgaacccaggaggcagaggatgcagtgcagtgagccgagatcgtgccattgcactccagcctgggcaacaagaagcaaaactccatctcaaaaaaaaaaaaaaaaaaaaaatctgctaagggcttccaggaaaggtttttaattccaaataaaatagatgtgcatgaacaaatatacttcatctttactggtcattgaacctggtgtgaactacgaatcctctttttctcacatgccacatccctcaacaaatcttttcggctctgcctcaacatatgcagaattacttcaacatttctctgatgcctatcatgcttcaaatcatctgttaccctgctaatattatctaacatgcctgcttcttccttgatctccttcattctagtctcaacacagcagccagcatgagagttttagagtcttggtcagataaagccagtcctccacttaaaagcccccaaaggactctcatctaatccagagtaaaagtcaaaagatctcacaatggtctacaaggccctgcacaatctgactccccacgctacttctcttatgatgttttctccataactcagctcctgccacactggccctttcagttctatgaacatgctaagcacattcctgcctctggggcttttgcactcactgttccccgcatcagcaatgctctttccccaaatatctgcctttgcattcttatttcttttaagattctattcaaacatcagctcactgaggccttctctgatggccccacttaaaacaatccaacccagcccttcccgtcccttccatggctttatttttttccataaaacttaacatcttctgacaatctataaattctacctatttgtttgactgtcttctcccttatccccactaaaatataagcccgtgaaggaaggcaatgaactttgttttgctcactgctgtatttcccgtgcttatggactactgcctaatacattttaggtggtaaatgattatttaagtgaattaatttagcaactatcgacaacaagctgagtataaaacagcaggaaaatgaaaaccatctaggtccgtgataatttaattgagccactgaattacacctggacttccagtcatgtgaggtaaattttatttatggtttaatgcatttttaattaaaatttttcttatttgaagctgcaaagtacccgaaatagggtactggtaggcagtttgcaaaaaaaagtgacaaatataatcaatttaactcaatcgtaaggcatgccaattaaaataaccatgaaataatctcactcaagaaaaaataaaagtttggtacatgtataatcccacttaatatgactcattacaacaatagtagcattaaaaaaattttaagggttttttgtttgttgagacagggtcttgctctgttgcaccggctggagtgcagtggcgcaaccatgactcactgcattctcgaccttttgggctcaagtaatcctcccatctcgactcctgagtagctgggactacaggcacgtggccgcacacctggcttttctttcccccccccagttagagacagtgtctcactatgttgcccagcagactggtctcgaactcctgtgcttaagtgatcctcctgtcttagcctcccaaagtactagaattataggcatgagccacagtgcctaaccatttttaagttttgttttgttttgttttgttttgtttttgagacagtctccctctgtcactcaggctggagtgcagtggcgccatcttggctcactgcaacctccgcctcctgggttcaagtgattctcctgcttcagcctcctgagtagctgggattacaggtgcctaccaccatgccaggctaatttttgtatttttagtagagacagggtttcaccatgttggccaggctggtctcaaactcctgacctcaagtgatctgcctgcctcagcctcaggcgtgaaccaccccactttctaagttttatacctaaatattaatatatataactcagtaagagtgtgatatcctatcaccagtattttccccacactttgagtgctagataggactgcccactcttagccaattatataaaaatattagttgatgctgataaagtgcttcctcttgtgctggccacttttacatgtgtaacttactgcccgcaacaatcctacaacctacaaaaccttgttttcccattttaaagctcagaagactgagctacaaaaatagatcaatgatcagccccaaatcaaacagctactaagtgtgaggctgggatttgaacataggcagttctgaaaaccaaaacccaaagcattacaaacactatcacccataagcagagcattctcctaaactgaatgtgccttttcctgccatttattctgtgtttggattctgacccacaactactgacaaaaggtattcaagtaacagcgccaaacttcccaaaagatattttgacagaaaaaaattaattaaaaaatacataaatgaaaagacaaagattggtggacatcctctgtctcacttcaagaaatcgagataataacagtaattactttttaggttgttgtgaggattaaataaattaatatagtacgtgtaaagcacttaggatagtgcttggcatacattaaaccaattaatagttttcattttcattgtaattctcataattattatgaaaggctccataaataccactaagcctagaaggactgaccaacagctatatgattagtaactggaaaaaactatggccagagacatgttatgactttagggataccaaaaagaaaacgacaattgctgattttcattctaggaacaaagtgccaaagtgatttagtaaagaaaaaatgctattagaactcccactcccattttcagaaatgtaggccctgcctactttctctcccaccaggtatgttgttagtgaggatgccaggaaaaaggcatactctgttgggggaatccaagccaacacctcacttttggagggcaactaatgaatatccatcaaaacttgaaacatatgtactgtcctcttcgatgagagaactttacatctaggaatttatcttccagaatatgtccacacgtacaaatacacaagtacaaggatattccttacaaagataataaaactggaaatcaactaaatgaccatcagtaggggaatggtttaactaatcagagggccttcaatctagtttaaaacctgtttctccactaagatcaatctctaatctaagtaaatgacatttctgtccactcaactactgaagccacaaatctagaagacaattttaattcttctttatctcatatccatctcatcaaatcctttagcagatcttaccgctgtaactttccaagctttttttttttttagatggagtctcactctgttgcccaggttggagtgcaggggcttgatgtcagctcactgcaacctccacctcccaggtacaagcaattctctcctgcctcagcctcctgagctttccaaacacttctgattgcctttctcctctgccatcactctactctaagccatatctgtcaaggttactttcacagccttatgggtgccctggtttataaccttctaagggcttttgctgcactaaggataaaatcccagcttcttaccacggtgtgaagggcactgcttgggctcctgcttgcctctcaaatatggtctcctaagttcccctcattgcacagtaacaccaatcgtttattttgggagatgggaggatcccttgagtataacacacttgatatggtttggcagtgtccccacccaaatctcatcttgaattaaagctcccataattcccacgtgttgtggaatggacacagtgggaaagaattgaatcataggggtggtttccccatactgttctcctggtagtgaataaatctcacgagatatgatagttttgtaagaggaaacacctttcacttggtactcactctctcttgcctgccaccacgtaagacatgccttctgctgtgagtgtgaggcctccccaaacacatggaactatgagtctattaaacttctttttctttaaaaattacccagccttgggtatgtctttatcagcagtaaacgcactaatacaacactcattcttgttttgagtcttcacaataaatcctgctcttcctaaaatgcctccacatcattcacgtgtgtttcaatgccatcacttcatacagaccttcctgaccaccttagccacatgcgttctctctcataccattaacagacacactcagtacagtaccacattttattttcttcatagcacttctcagtatttgagactaattacgagaaatgcatttattttgtgtttctcaccgttgaaatattgttccataagggcaggagcttggtctctctggttcaccactgaatccttacacctaaaacactccttggcaaattaagcacgtgattcatatctttggataaattttgaaaagaatgagatagatgtgtataagctaaaatggaaagatgcctaagatcaaccacaaagtgacaaaatcaaatcacgatataaattaaatgatcccattatcataaaaatggatataagtacatacacatacatagaaatagcaaaggtatacccataacaaaagtcaaggatacagtaattgtctctgaaatgtggggcaaaacagggaaaagagggtctttcacattttttgttttttattttagataagaggctcactctgtcacccagtgaaacacatgttgcccaggctggcctcaaactcctggcctcaagtgatcctcctacctcggccttcccaagtattgagattataagcgtgagccccctgcacccagccccttttactttttaagttatgccctcctgtgctctttatttttaccagaatgtattacattcataactttttatgtgacatcttctaatcttccacatactgtaaaaggcttaacacacataatgagtactcagttttgttttggagacagggtttcagctctgtcacccaggctggagtgcaacagcacaatcttgactcaatgcaacctccacctcctgggctcaagggatcctcccacctcagcctctgagtaggtaggactacaggttcgcaccaccaagcccagctaatttttgtgggatttttttaggggtagggtttcaccatgttgcccaggctggtctccaactcctgagctcaagcgatccacccaccttggcttctcaaagtgctgggatttcaggcgctcaccaccgcacccagccagtactcgcttttataaacacgcaaaacacctcctacaccacttaaagctgctattatatttctacaacctaacacattctgaaacactggataaataaatatctaaataattattagtttttggtctagtccagtttgagaactgaaagagattctctggctcaaatagcagatcaaacatatacatttatctctcttcagcaaaagaccattttaaacagtagtttaaaaaaatttaaagccaaattattattaaaaaacaaagtaaaattaatggaaagagatctcttctaaagtaaagaaactggagtctgggagagaggaaactagtgaacctagcatgggagttggcactttggggtaaaacaatggactcttgaatgtcagaatacaaaagactaattaacagcttaaccctaaagtaaagcctgcctgccaaccattaattcccaccaagagctcattgtgaacccttctactaaatcttaaagctgagtgatatccaaggtcagcagatatttggttaaaagcctacaatataaatgagactaagataacaacaaaaattacaatagagttgacaggtaagagggagggcaacaaaatttaaaaaaaaaataaaccttattaacattttcagagactcaagaagattattaatccataaaatgagaaaagatattggcgggggaggaaatgaaggagaaatctcaaacatttaaaatataacttccaatataaaattaaaaggtccaagaataaataaagtagaagagatggccagaccaaaaaaaaacaaacaaacaaacagacaaaaatattggggaggattaattcagtaagtctaataatccaactaaaagcagctatagagaaaacaaagaaaagatcactagaggccgggcgtgggggttcacgcctgtaatcccagcactttgggaggccgagatgggcggatcacgaggtcaggagatcaaaaccatcctggctaacaaacacggtgaaaccccctctctactaaaaatacaaaaacttagccaggtgtggtagcaggtgcctgtagtcccagttacctgggaggctgaagaagaatagcttgaacccaggaggcagaggttgcaatgtgccaagatggtaccactgcactccagcctgggcaacagagcaagactccgtctcaaaaaaataaaaaaaagaaagatcactaaagccgtaacatgaaaactttcaagaagtgaagcacataaagtattttgcttattgtaatggagaagaaaacacatctggacatctttgagaaatttcagtttaatgaggataaaagaaggctctaaagggatggatgaaaatatgaaacacatcacccacaaaggaagaagaatcacacagtatccgacttttcctcaccaacaacaatggacatagaagacactggagcaatcccttcaaaactctgagggaaaacaattttcagcttaattgcacttgaataaaataataccagtcaactgtaagggctaatgaggacttttacagataagcaaggattcaaaactttatttctcacatattctttcttagctatttatgtgggtgtactgcattaaaacaagttagtaactcaagaaatgataaagctctaataacagtagtagcactgtgcaaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatggcatccggccttcaatattttctggatgaaagagaggacttattactagtcctagattattatgaaaaacagcaatatcatgattaaaattttgttcctcctcccagtactgtgttctattaattagataggaaataggaatgaacaaaaatagacattaaatcaaatgattttactttctaaaagtcaaaaattctaatgctttgtttacctatctacaaatatttatcttactacttctataaataattgaataaaatcttaaatgaactaaaagaaataatgggacttttcactacacaaaagataattacctatacaatgaaatgaggtgaaattcttagagcaaatatgtcatacaacaagcttaaattaatgatacgaaacagttagaatgcccccaccccaataaaccatggacaaaacacgactgggcaattcgcaagaaatacaagtaataaaattcaaaaaaaggctgacgcggtggctcatgcctgtaatcccaacgctttgggaggccgaggcgggtggatcatgagatcaggtgctcgagaccagcctggccaacatagtgaaaacccatttctactaaaaatacaaaaaaatagctgggcgtggtggtggatgcctgtaatcccagctacttgggaggctgaggcaggagaactgcttgaacctgggacgcgaaggttgcagtaagccaagatcgtgccacggcactccagcctgggcaacagtgtaagactcaggtctcaaagaaaaaagaaaaagaaattcaaaatattcattagtcctactaatcaagtaagtaaaagcttagaactactttttttctgttgttaagataaagattttaatatatcatacatgacaaaggtttgataaaactagacctatcacacattgctaatgacattacaaattgatgcaacctttttagggagtggcatttcaaaactttaataaaaataagagatcagggctgggcatggtggcttatgcctgtaatccaagcattctgggaggccaaggcaggggagatcacttgaggtcaggagttcaagaccagcctggccaacatggcgaaaccctgtatttttagtattctactaaaaatacaaaaattagtcaggcgtaggccaggcgcgatggctcacacctgtaatcccagcactttgggaggccgaggcgggcagatcacgaggttaggagatcgagaccatcctagctaacacggtgaaaccccatctctattaaaactacaaaaaattagccgggcatggtggcaggcacctgtagtcccagctactcgggagggaggctgaggcaggagaatggcgtgaacccaggaggcggagtttgcagtgagccgagatcacgccattacactccagcctgggcgacagagcaagactcatctcaaaaaaaaacaaacaacaacaacaaaaaattagccaggcatggtagcgcgcctgtaatcccagctacttgggaggctaagacaggagaaccgcttgatctcaggaggcggaggttgcagtaagcggagatcatgccactgcactccagcctgggtgacagaacaagactctgtatcaaaaaaaaaaaaaaaattcaatgtaatttaaaaaaataagagatcaagccgggcacggtggctcacacctgtaatcccaggactttgggaggctaaagcaggcaggtcacttgagacaggagttcaagactagcctggccaacatggtaaaccttgtctctactaaaatcaaaaaattagccaggcatggtggcacacgcctgtaatcccagctattcagggcgctgacacatgagaatcccttgaacctgggaggcagaggttgtggagagccgagatggcaccactgcactctagcctgggtgacacagtgagacatcatctcaaaaaaaaaaaaaaaaaaaagagtttatatttatctcaaaaaaagagtttatatttattgcttgctaaggcatcaaatataagaaggaaaaaattttaaaaagttcgtatttactaagaacttactaagtaataggcacagctcactgcaaccacttcctcccaggttcaagcgactctcctgccacagcctcccaagtagctgggattacaggtgcccaccaccatgtctggctaatttttgtatttttactagagatgggtttcaccatgttggtcaggctggtctcgaactcctgacctcaggtgatccatccacctcggcctcccaaagtgctagaattacaggcatgagccactgcacctggcctctagcggctttcttaacacatataccctctttaaatcttttaataatcctgtgacaaagatgttattatcatccctattttataggtaacaaacagatacagattgaacagcttatacaaagtccaacaactagaaagtgataagaccagaatttgacaataagcaaatagacattagagcctatatgcttctgaatatctatgaagaatcaaaaaatgcttttttgttgttgttgttgttgagacggagtcttgctctgtcgcccaggctggagtgtagtggcatgatctcggctcactgcaagctccgcctcctgggttcacgccatcctcctgcttcaacctcctgagtagctgggactagaggcgcctgccaccacacccagctaattttttgtatcttttagtagagacggggtttcaccacgttagccaggatggtctcaatctcttcacctcgtcatccacccacctcggcctcccaaagtgctgggattacaggcatgagccaccgcgcccaccctctttcttttaaaaaaaaaaaaaaaaaaaaagatggagtctcactctgtcacctaggctggagtgaagtggcacaatctcggctcactgcaacctttgcctcgatactccttccttagcttcccaagtagctgggactacaggtgtgcgccaccacgcccagctaatttttgtatcttagtagagatggggattcaccatgttggccaggctggtgtcaaactcctgacctcagatgatccacccacctcagcctcccaaagtgctgggattacaggcgtgagccaccatgcccggccaaatgcttattttttaacctaattatcctgcctatggtaatctgtcctataaaaataaccaaaatatgaaaaaggctttatctacaaaaaggtcagccagagcattacacatagtaacaaaaggcagtagggtgagaagaggaaaaggggagacagctgtatggttacataaattatagtgtggttactcagttttttgttgttgttttgagacagagtctcgctctgtcgcccaggctggagtgcaatggtgtggtcttggctcactgcaacctccacctcccggattccagcgattctcctgcctcagcctcctgagcagctgaagactacaggcgcatgccaccacacctggctaatttttgtatttttagtacagagggggtttcactatgttggccaggctggtctcgaactcctgaccttgtgatatgcctgcctcagcctcccaaagggctgggattacagtcgtgagcgacagcactcagccctcagttttactcaatggaaaattaagcacccttcaaaaatgttataaaagattaacaatacggaaattttcttttacatgttacaagggaaagtaggttacaaaactctaaatgtacataagtagtatcacaaaaaaaaaaaaactgtgtatatgaaaaaagtttgaaagagaataggtcaggctgggtgtggtagctgatgtctataatttcggcactttgaaaggccaaggtgggaggatcacttgagcctaggagtttgagaccagcctgggtgacatagtgagacgactgtccctacataaaaagatttgtttttcatttaaaagaaaaaaaatagactgggcatggtggctcatgtctgtaatcccagcattttgggaggccaaggcaggtggatcacaaggtcaggagtttgagaccagcctggccaacatggtggaagcccatctctactaaaaatacaaaaaattagccgggcatggtggcagacgcctgtaatcccagctactcaggaggctgaggcaggagaatcacttgaactcgggaggcggagattgcagtgagccgagatcatgccactgggctccagcctgggcaacagagcgagactctgtctccaaaaaaaaaagtgggggaaagaaaacatttacatttataacaacatcaaaaacaatgaaatacttaggaatcaatttaacaaaaaaagtacaagacctgtgcattgaaaattataaaatactacaaacaaattaaaggagatcagaaattatacttcatttgatacttaatcacatgcaaaaaatcattagttccagttttacagttgttgccggttatttttctaacacagatacaatgtcatacctctgtttaacatcttcaatggctccctattgtttacagttaatattcaaaatgcccaatttactttcccttcctcatttcctcccatattggactgtagtctcttaaaaagcaaaggtcagggtcagacacacctggattcaaatcctgactcaatcacttacaagctatataaaaattcatctttcatttgtaaaacgtactaatgattcaaccccatgtgatcagtaattatcaaaaaggtaacttctggtaagcactagtagtgcctaacacataatagccaggtactagtttctcactcccctttttctcttcggtaaagtctgttttcatttttaaacactcaacaaagatgtcttctttcttcagttcctctgagataagttcttccttctctaagcttcctcagcactttctgaaatctattgtaaaatgtgtcatttgcattatactttgcactgagttaccagaaattgaaggtagggatcttgccttattttggtctctccactgtataatacacagcagattctcagtatttgattttgcctaacatcctccttgggtgattaacagagaacaaataggaaaagcaaatctgactaagaataaaccatgcttcagaaatgtactttgaaaggaagagattttaagtcacctataatctaacacccacaccgatctgtgatgaacacatagcatgagcaagaaatgaacctttgtgactgatgccactaagaattgggatcctttgtcaccgtaacatattctgtatattctgatatacacattaaaggagtttagtatttatctgcatcatccctatctccagtgtttggaatgttctgcacaaagcgggaacttctgcacagcaaaagagattatcaacagagtaaacagacaacctacagaacgggagaaaatatctgcaaactatgcattcaacaaaggcctggcctggctcagtggctcacacctgtaatcccagaactttgggaggccgaggtgggtggatcacaaggtcaggagatcgagaccattctggccaacatggtgaaaccccatctctactaaaaatacaaaaattagctgggtgcggtggtgcacgcctgtagtcccagctactcgggaagctgaggcaggagaattgcttgaacccgggaggcacaggttgcagtgagctgagatcgcaccactgcactccagactgtaacagaaagagactccatctcaaaaaaaaaaaggcctaatatacagaatctgtaaggaacttaaatcaacaagcaaaaaactagcattaggagatatacttaatgtaaatgacaagttaatgggtgcagcacaccaacatggcaccttgtatacatatgtaacaaacctgcaagttgtgcacatgtaccctagaatttaaagtataataaaaaaatagtttataataaaaaaaaaacaagcaaaaaacaaccccatttaaaaatgggcaaagggcatgaacagacacttctcaaaagaagacatatgtggccaacaagcatatgaaaaaatgctcaacatcacttatcattagagaaatgcaaatcaaaaccacaatgagataccatctcacacaagtcagaatggctatgattaaaaagtcacacacaaaaaaaacatgttggcaaggttgtagagaaaagggaaggcttatacactgctagtgggaatgttaattagttcagccactgtcaaaagcactttggggatttctcaaagaactgagaactaccattcaatccaggtatcccattactggatatatacccaaattaatagaaatcgttctaccataaagacacacatacacatatgttcatcacaggactttgcacaacagcaaagacatggaatcaacctaactgcccatcaacagcggactggataaagaaaacatggtacatatacgagacagaatactgtgcagccataaaaaaagaatgaaatgatcctttgcaacagcatggatgcagttggaggccattattcgtaagcgaattaattaacagaaagccaaatactgtgtgttctaacttccaagtgggagctaaacactaagtacatgtggacacagaggggaccaagagacaccaaggcttactcgagggtggaggctgggaggaagttgaggatccaaaaactacctactgggtactatgctcactatctgagtgacaaaatgatttgtgctctaagcctcagcgacacgcaatgtgcccatgttaacaaatctgtgcatgtaacccctgaacctaaaataaaagctggaaggaaaaaaaacaagtgggaactcaggtttattagaaaactttaaaatatggaatgaatgtaggacatttttaaagagaatagtcaaaggttagcagaataaccaaatgttttcaatgaaaagattacaaaagttgaagtaaccacatttttaaaaagcacagcgttagcatataaatgggagcatgcttttactctcctcttcacccaaaatacatacttctactacttcctcaccatgctgaggtcaaaaactggaggcttagggctgggcgcagtggctcacacctgtaatcccagcactttgggaggacaaggcaagtggatcacctgaggtcagtatttcgagaccagcctggccaacacggcaaaacccagtctctactaaaaaaaaaaaaaaaaaaaaattagccaggcgtggtggcagatgcctgtaatcacagctactagggaggctgaggcacgagaatcgcttgaacccaggaggcggaggttgcagtgagccaagatcgcatcactgcactccagccacgcgacagagcaagactctgtctcaaaaagaaaaaaaaagaaaaccctgggggctcaggattcaacaaagcattgttgaaagcagtcactaccaatcaaccgggcctcaacatgaaattatctgccatcgcaagaacttcagtatcataattctcacacatgagaaaattaggcctatggtgataaaccaattgctcaaagtggtaaagactatttactagctatttctgtaatatttattcccaccatcagtaaccagactttgaacctattctaagtagcaaggtactcatctaaaaaaactacattcccaaccaggcgcagtggctcacgcctgtaatctcagcactttggaaggccaaggcaggcagatcacgaggtcaggagatcaagatcaacctggctaacacggtgaaaccccgtctctaataaaaatacaaaaaattagccaggcatggtggcctgtagtcccagctactcaggaggtggaggcaggagaatggcatgaacccgggaggcggagcttacagtgagccaagatcacaccaatgcactccagcctgggcaacagagcgagactctcatctcaaaaaaaaaaaaagaaaaaaagaaaaaaaaactacattcccagccgggtgcggtggctcacgcctgtaattccaaaactttgggaggccaaagcaggtggatcaccagaggtcaggagttcgtaccaacctgaccaacatggtgaaaccctgtctctactaaaaatacaaaaattagccaggcttggtggtgcatgcctgtaatcccagctacttgggaggctaaggcaggagaatcgcttgaactcgggaggcggaggttgcagtgagccaaaatcatgtcattgcactccagcctgcatgacagagcgagactctgtctcagaaaacaaacaaactacattcccagcctcccttgcagctacaggtagccatgtgaactctgtgatagttctagccaattatatgtaagagaaaacatacaatatttcttcaaaggaggaggctgtgtgcccttggactcctttctgtattttgcttcatgggacatgcatgtaatgtaattgggactttagtagccatcaaggaatcttagggcaaaggccacaacctagaaatgtctgagaagttagataaagggagacactcctgatgactttgcagtgtagagggacaataccagcctcagtacctaccctccagattttgaagtgaaacagaaataaacactcctgttcaagtcattattattacggggttttcaatcacataaagacaaacctagtccttactgatatacccggctgttaagaattggcccagaaatagaaatcagttcttctgtcaagagtccaggatgctcaaatatataaagatctctgtacaagtcaacaaaaataaataaataaataaactatatcctttttagggttgatattcataattgttttatctttctattctgtatgacctaactatagcccaatctacactgtgacaattccatttttaaatactatttaaagtcctcaataataaaaatctgtatttcaaaatactttagaaaaataaagggtaaggttaaggagaaacttcatttaactatttcagtaaaagaggatggaaaataatgatttttatcactcgtatcccaaatgcattttttttttctgagaccgggtattgttctgtcacccaggctgggtggggtgcagttgcaggatcatagctcactgcagcctccaactcctctgctcaagtgatcctcccacctcaacctcctaagtagctgggactaaaggcatgtactaccacacccagctccaaatactctttgttcttagcgtcccttaattcagaaaactatctgcttccagcaaaacagattaaaacaaccagcattttacttatttatgatttcgtaacctggactgagcttagctaggtggttcctctgttaatcttttttttgtgtgtgagagagagaaacaaggtttcactctgtcgcccaggcttgagtgcaatggcaagataatggttcactgcagcctcaccctcctgggcttgaccaatcctcccacctcagcctcctaagtagctaggactacagagacatgccaccacactcagctaatttctgtatttttttgtagagacagtgtcttgctatattgcccgggctggtcttgaactcctgggctcaagtgttccacatgccttggcctcccagagtgctgggactgcacagtcataagcccccacgccggccccttcgctaatcttactaatcacttttgtgtctgtattcaacaggcaagtcaactaagggctgaaggcagctaggacactgagatagttaagcctccctctttccatatagtcctggaatctcttcctctccacatcatctctccagcaaggtatgacagcttcttgcacggcagcaactcagagctcccaagagtacaaaagtagaagctgcctgacatgctcaaggcttgtacccaaaaatagcaaagtgtcatttttgctatgttctactggttaaagtgagtcacagggctaggcgagatacaaagagagatgactatacaatagcatgaatacccataggcatgatttactatgggtctacaccaatacagtagactaccatctcctttatttactgtaaaagtaacaccttaatatatgacttctagtattccataatctctctggggctcagttatctataaaatgaggggttagactcaatcttcttgaattctcatctattaatagttctaatattctacaactctataagtatgaaagtctaatataagaaacacttagggccaggcacagtggctcacaccagtaatccctgcactttggaaggccaaggtgggtggatcacctgaggtcagaagttcgagaccagcctggccaacatggtgaaaccccatctccattaaaaatagaaaaattagccaggcgtggtggaggggcgcctgtactctcagctactccggggtctgaggaaggagaatcgctggaaccagggaggcataggttgcagtaagccgagatcgtgccactgcactccagccagggtgacaagagcgaaactccgtctcaaaaacaaacaaacacttggccatactgaccaaacacttcaactatggtagaacaattcaatgagaactttaagaatatggttatgtttcattttgtcattttatattcaactatgtgcttattccaaatgtggtccatatgactagaatcccaaagatcaggaaatcaaggaaattctttttttgctaggctccactaaaagaacaccaccacacagacttcactgagaccatcaagtatgctgcttctaatgtaaatcgattacaataaggtgtaaagatttaaagtgaccaaggataaaagatgtaagaaatcattttaaaaccacctaaaacaagtctcactgagggaggcctactaataaaaccctagccagtagagttataatatgtaaaaatctactctaacaacatttaaaagtttgagcaataaaaaactttggaataatattactacatatacaactcctagggaattgctttgactgtttttcgtgtattgctcataatgaaaaacatttcatagagatttctgctgacctagctttttaaaaatctttcttctatatattggggacatctgcgtacaaagaaaatctttgccaccccactatccccgcctccaataacaactgcattattttatgtcatagtttttttttttttttttttttttgggagatagggtctcgctctgtcacccaggctggagtgcagtggcatgatcacagctcactgtagcctccaactcctgggctcaagcaatcctcccatctcagcctcccaagtaactggagctacaagtgcataccaccgcatccagctatttttaattttttgtagagatggggatctcactatgttgcccaggctggtctctaacgcctagacttaagcaatcctcccacctttgcttcccaaagcactgggattacaggtgtgagccaacatacccagccttatatcatggcatttttggagtgagtttggtttctaatcacttctgtctctaaatagtttataacaggcaactgattgataattgatgattagtggcaatgacagtaacaacagtagttaaatccttacaacagcacctcttaataggacttagtctatgccagaaactgttctaaattctacacatatatataaattcataacaatcctaaattaggtgtattattacgtcctctctacaggtgaggcaaccatagcacaaaaaatttaagtaacttgcccaaggtcaaacagctaatatgtagtacaacctagacttgaatccagaaggtctaggctctataatcagtgatgcccccagaatttggttttctcatttgtcaaatgatttaccatttctgaagtattaagcttttttctttttttaaatgcataaatgtatactgaaagaatatactccccagagtttttttttgttttgttttgttttgtttttgagacagagtctcactctgtcgcccaggctggagtgcaatggcacgatttcagctcactgcaaactctgccacccaggttcaagcaattctcctgcctcagcctcccgagtagctgggattacaggcgcctgccaccatgactggctaatttttgtagttttagtagagacggggtttcaccatcttggccaggctggtcttgaactcctgacctcgtgactcaccctcctggcctcccaaagtgctgggattacaggcgttagccactgcgcccggcccccagagtattaatatttattatgtattcttcccaatctttttatatgcacaaaatatacacacagtttgggtttatgtgcttttcacaaaataaagttactgctaaacttactgctttacaacttttggaaaggtttttctctagttcaacaatgtatcatagacattctcccacttcagggcccacagatctatctctatgtcttgatttaaaactgcatggtagtccattgatgcatattttgttgttgccaacttttctctactactaatactgctgccatgagcatcttgtatgtatatgttgtccatttgtcatgagaatatattctgatttcctttcttgtttttccgggtataactggtcccctatctcctaagggcaacaaagcatcctaatcctttactaattcccatacgccatattctcagtgattacatgttaagtcacatctttaaatacttatcctaatcgattcctcaactccagtcctacttccccgaatgcttagcaggcatccaatctatttggatgcctgctacaacatctatgccagaaactgccgaattcctcctttgcagtgactggaatcttcctccccattcgcactaccaacattctatgctttggcttgatctctcacactacaactattgtaacagcctattatctctgcctccaggtaactcctgtctccatattattaccacagtgtttttttaataataggcatcattaaatcaccaagtatttgagtgcctacattcaaatgcataaatgctaaacagaatacaaagtaatttagtaaggttcctatcctcaagaatactgtaaatacctgctttgaaaactttcatttaaaaaataaaataactgggcataaagcagagattgagacctgtagtcccctggtggtccgcagattaaacctagcctacaaagtataggcgcaaataccgttttagattctaattaatgaaaaacacttaaaatccaagtttaaaaatcataaaaagggctgggtgcggtggctcatgcctgtaatcccatcattttgggaggctgaggcaggtggatcacctgaggtcaggagttcgagaccagcctggccaacatggtgaaaccccgtctctactaaaaatacaaaaaaaaaaaaaaaaaaaaaaactagccgggcatggtggtgggtgcctgtaatcctggctactcaggaggctaaggaaggagaatcacttgtacccgggaggcagaggttgcagtgagccgagatcacaccattgcactctagcctgggcaacaagagtaaaactccatctcaaaaaagaaaaaaaaaaatcataaaaatccaaatttccgccctcttgaaaaatctagaaacagcatctcaaatagcaaccatcagccagaattctgtatcagtttcaccttaagcagggcataaggactcctagacttccccaaggctgttattatttcccattttctccccaacccaaggtctaaagtgtcagttgtcattcagattcttagaagcagcctactgttcatttaaattgcttacctgctccctgtaaacagtttataactcctggactacaggataaagcccaaactcatgagtctggcattcaagaactatcacagcttggcctcaccactacacacagcctctgttctagtcacacagtcagaagccaccccaccttttacacctccttccctcaataatttcattcacattgctccctcacacactcattttcttgtcattctacttggctaaatcccaccaatccttcaaggtctaattcaaatactacttcctccaaatctttgagcacccctctaggccacaataaatcttccagggttgactgttcatcccaggacatatttagcactttgtagctctttaaataacatgtaccaaatgaaagatctaaaaagttacatagaagtatagaaaacttaagacttgttaaacaattttacacttgtagatcatatgtagttactgccatcacaaaattaacagcagaaacaaagtgaaacaattttccttttacctgaggctttttctagaatattacaaagtgcaaaaagagctgtgtcatttgtttctctcaacttgtgctcttaagtccttcaaattctgcaaataaagggatcaacacttccaattataaatccaagattggtctattacttttttttttttctttttgagacagagtctcactctgtcgcccaggctggtgtgcaatagcatgatctcagctcactgcaacctctgcctcctgggttcaagcgattctcctgcctcagcctcccgagtcactgggactataggtgcctgccaccacgcccagctaatttttgtatttttggtagagacggggtttcaccatattggccaggctggtctcccactcctgaccttgtgatccgcccacctcagcctcccaaagtgctgggattacaggtgtgagccaccgtgcccagcctttctattacattttcacagataaccaccagcatatatctacaagcaatagctataataaaaaaagaaataatctcagccgggcgtggtggctcacgtctgtaatcccagcactttgggagtgccgaggcaggcagatcacctgaggtcaggagtctgagaccagcctggccaacatggtgaacacccatctctactaaaaacacaaaaattagctgggtgtggtggcatgcgcctgtaatcccagctttttgggaggctgagtcaggcgaatcgcttgaatccggagggcggcagccacagtgagccaggatcacgccactgcactccagcctaggcaagagagtgagactgtctcaaaaaaaagaaaaaaaaaaaaaaacagaaatcatctctattctacttcgtaacttttgccacttatcctgccaacaagttctcaaaataaccactgtagcacaaacatgataaagaaaatttttaaagagaaaaggaagagattaatcagctttctgaaattaaaagataaaaatggaccaaaacaatatagaaaaaaaaaagtaaaggcaaacacaaactcacacgctgactgtaaagtttattccatggcagctaaaagttgtttggcccaaacatctcacagattaaaaactaaatcacaacctaacgagggtatctaacacgtccccaccaggcaagagtgcagagagaccatctaatgttcctatttatttagagagtcttgctctgtcacctgactagagtgtagtggtgtgatgtccgttcactgcagcctcaacctccaagcctcacacaatcttctctcagctcagtctccagagtagttgggactacaggtgcctaccaccacacccagctaatttttttgtagagacaaggcctcactttgttgcccaggctggtctcaaactccttttaaatgaggattaagtgatcctcctgactcagtctcccaaaagtgctgggattacatatatcagccaccacacccatccttaatgtcctttataactggaaactgaccaattttcaccttggaaggtcaatgaagtttcacgaagcccctccatcataaacttaaagtgacttaagtttacagagttggacaaccactatctacccagagaaacctgactgtggtctgggaaactttgcagttttgcggaacagaggaatgagatgaagcagtgtggcttgtcacttggcagattaacaacaattctggcattatggaattaactgaaatagtacgaaaatgtaataaatcacaagtgtcagaatgggaaaacaaattgttgtgatacttttatatttccatggaaatccatgtttatcaagtttacatattagtaaccaatatgtaaattggtaagtttacatattagtaactaatatgtaaatttatatattagtaaacaatatataaatttgtataatagactaaaaataacatcttctcaaatattagaaattccctgggccaggtgcggtgtttcatgtctgtaatcccagcactttgggaggcccaggcaggcagatcatgaggtcaagagattgagaccatcctggctaacagggtgaaaccccgtctctactaaaaatacaaaaattagtcaggcatggtagtacgtgcctgcagtcccagctactccagctacttgggaggctgagacaggagaatcacttgaacctgggaggcggaagttgcagcgagccaagatcgcaccactgcactccagcctgggcggcagagcaagactctgtcaaaaaaaaaaaaaaagaaaaaaaacaggttcttattcatgggaatttcaggtcaggttaaacaacaacctcctaacaggtaagagagggtagcaatcctgagtcaacttttcaactgaattaaaacatttcagtgcctattgagtcccagagaccaataatatcaaaaattttatcagatctcttggacaataaattattaagaattgctgtcataaaaattacaaatttgcattatctcaaaaagcatgaataatagtgctgtctctcaactataaacttgttttattaaatggtatatattgtaatgcagtacagttttctatcacttatttcaaattcacagctatgaaaaggagaaattttgttgggggaagggcgttacaaatacagagtagcaacctagccatttttgctggtccttgtaatgacaatcactggttgtgcctaatttttctacaacaataatgcttaaggtggctctctaataatagcaattgccctctgaaaagaaagtggttcagggtataaagagtttactcaaaaaaggccaaggatagtgcttcagaaatcctatacctaccacctgctgcttctgtacaaccacccccatcccccacacccacacccatttctaacatcaactttcatgaactggtaagaaacatagtagagtagaatgtttctttggcttcccaacttggtaatgtgaatttacagtgtaaggatggaaaaaataagaaaaaagcttcagaaaaattttttaacattaacacaaaaataatgagatctttaatatgtgcatattctgacagaggcctgccaatggttaagacctgtgcctctgataaagatgatgaactactccaaattatcaaataatttgatactttttacagttaaggaaaactttcaaatgaatgtaaatttcactgtgccacttgacatttgtacaataggaaacctctatgtatttacttttccaactctaagattaatagcttcagttcaagtttcttgattttaggtagtaaaattttaagatatttatagttaatgtaaaagcagtaactatatagctatgctttttattcatgacaaaatacacaaaaacaatctagctaacactataagacaagaaaatgctttatttacctaattattaaaaatttaaacttgaggaaagtgtaattggtggtgcatgtttttttaagccaaagataaatacataaatccacttcattgtcaaaaggcatcttctcagcggggtgcggtggctcacgcctgtaatcctggcactttgggaggctgaggagagtggattacctgaggtcgggggttcaagaccagcctggccaacatggtgaaaccctgtgtctactaaaaatacaaaaaattagctaggtgcgatggcgcacacctgtaatcccagctactctggaggctgaggaaggagaatcgcttgaatacacgaggcagaggttgcggtgagccgagatcataccactgcactacagcctgggctacagagcaagacttcgtccagaaaaaaaaaaaaaaggcatcttctctacttaatgtaactcactaagttaatgaacatctaagtaacattagcaacttaaaatatctctatgagatttagcaaagaagattaattttcatttctcaggtgaattatttgcaatttcacataatttcactggttacaaacctaatttacactggttacacataagtttcactttcagggtctttactgtccaactacagggtcttttctgcatggattcttatacagtatagagatacacaattcaaaaacctctttgctttccaattcatatgttagtttccatttacatgttgctaaaaacaactggagattccattcccttcaaaagacacaatttcaaaaaaaacgctctaaaaagtttagacccgtcaaatttaccagtagactttaatttcctataaagaaagcagtactagttttcaaatctaaaagaaaaagctctctacagacttacatttgttctaaatatttccaaaagttttgatttttcatagttagattatactgttattcagcagaaattttttatcttctccaaaggctgcctatttcttcatgagattcagaattaaaataataaagtggcaataccctaatcgtccagtgcactcaggagctgcactaatacaaatgagctcatttcaaaagtagggtgtgtgcgagtgtgcgcgtgcgtgtgagtgtgcgcgtgtgcgcgtgcacaagcacgcccttacaggagtatggggtgtggggtgtgacaacatagatctaatctttctggagtaagaattcaaatgcaaatttaaaacaatacttgcaaattaatgttcagtaagagatgaagaaatgctttgcaaatagtgaaatgggaggcaatcaaggtaaaaccccaatatggcttgtcctgagttgctttaaaggatgcaaaaaaaagtggcttacatgtctaaaaattacttaaacctccacttccttctacaaatttcagttaatacagaataagggcattttatacttgccactgtattacaacgcaagtggcataataaataagtcctaactttgtatcacgaacaagctaatgtaataatgtacacacatcctgtacttgcttccctcacgattatcatagctaggtaacagctggcaataaaatatggaggcaagttgaaggccctgaatcattttcatagtaaaaggacagcggggcaagaaaagagcacattcaagtcaagagctcaatgggttcccacaacccagctctgctatgcctcagttcacgctactatttttactacaaatcaccaaacaacaatactattactaagtgaatgcacccgaaccaaagaaacagcctatccataaacgtgctggcttccttcacgtcccagcgcacccttccactcccgacagttcaatgagaatatcatctcacgaaatgagtaagcacacacgccattctacaacttcgagagacattcacagttcttccacggcacacgcgagagccacagaagccgagcagttcgctggcactaaaacggtgtcttaatttacaagcaaagccgtcaaataaccgttctgtaagaagacatttctggtcctctaataagctggggtccagccctactgtacgctcaaaggcaggcgaccctattcccaagccccttacagctaagacttacgagggaagcgacatttacatctgcactctctccgaataagtgctcttggtattctgccttacgaggggacgctggctacgtctccaaaacttaggcaggccgttccccgaagctgggggatcccacaggacttgtgctttcggagcccgggagtgcggtgctgggtgttgggggaggggggaggaagaagtcaaatggcttcctaatatatcatcaaaagaagaaaacacaggtttgggaccaggaaaagttccaggagcaagtcgctgacaaacaaaagctgcactcgcccggccgctttcttctcgcccccagcccgcgccccgagaccacctggcccgggcgttttgacagctccgagagtttcccgagcgccgacggctcggcggttcgcccggagtccgtccggggactacctgggcgcgctccgggcttgttttctcaatgatccagctaggccaagacgcggctacgagaaatttctccaaaagaagagtcgcggagaagacccagtgaaaaggcccgactgaaaagtaaagtgtgcggagccgggcgccggcgggagcccgggcgggcggcgcggagcgggggaggccgggcgcgggcggctaccgaggggcgcggggccggggccgggagccgccaccgcccgcgggcccgccccgcccccaccccgccggggggcgccggggcgcggaggccgcggggcgggcgcccggtgacagctccggcccggcgccgccgctggctcccggcctggctccctcgcactcaacttacttctttctggctctctggaaaggggaagcgccatctttgcgaggccggccccgaggtcttttgtctgcggctgcggggctcggggccggggctccaggctcctcggggggtggtggcggcggctgcggctgctccacgctcttgtcctcctccgacgacatcctagtcaccaggaaagacacatggatcccggtcctcctcctggggggctcccgccgccgcggccgccgccgccgccgctgctgctcgggttcctcctccccggctcagcctctcgcatttcccgcagccccgggagcagcagcaggtaccgggagaggcggcaacatggagcgagcaggacacgcactcacacacatcggcgcgggcgcgcgcacctc

SEQ ID NO: 2167 - DNA, 6122 bp, Homo sapiens
gcgcgaggagcaaatgtgcgcccgcacggcgagggcagcccgggcttcgctggttctcgccgaggtctttcctcgtagcgcccacactacggggaggaaaaggaatggagtcaacttcgttcgaatccaacgccagttagtttccttattataacgtcattttttttaatccagaaaaggttcataaggatgtaagacgaaaagaacgatgacagctcgagaaataaaacggttagagacaaaataagccaataaaaacccaaccacttgattttaacgttcagtgtgttgtgatgaagaggcaaaaatcgaagtacttctaagccacctctcataatatgtaaaaatggtaaaaagaaaaatggggctagaatccgcctgaaaaatgcactttctcaagaaggacagttacaaatatgggattctggatttctcaggctaatacctaacacttggacgatgatctattctgtgctttccattcactatcgattagtttatgagagtgaaaaaattctagatttgaatggggggaaatagtaagacctatcaaccatttgtgaaggattggggtaaactatcatttaataagcatctactttgggcctagcgttaagaggcacactctcatgttgatttcttttgatcttcgcagtgtagttttagtgtaaggtaaaaaaaaataggctccttttccagcgatgtttgctttcccttctagtagctaggatgttaactttaaactgtgtcttctacttgggcaaaatacacacactttgattcccagagcctattctaaatgaaagcataattttttgaaatggctgaaatgaggaataacgtcagatagtcatttgaataccttcagggtttaatccctgctggctctttcaaatttactaaatttataaccaaaggaaatttgggattgaggaggaggctggcatggtaaatgcaaactagaaattaaaagtgcctgacgattacacatagaaatacaacatatatgtgactagtgataaacatatgatgtgatctagtgaaagtttactcagtacaaatttgaaagcaccctttcttttttcattttcttcagcacattgtactttaaataaagtgtgctttcaaaactggattattgatccaaatatttagctgtgttccgtactgaaattagaataggcacttccacggtgagtttcacatgtacaaaattatacatcaggataatttacttccatacgcttctccagcacttctgagaacttaagtgtcagtggatacaaattgcaagtcactcctgctggagagttcacaagaaacaaagggtactaagagcagaaaagtgagccgagtgaatggaagggtagaaacagaggtttgtgcagggatgcttctggatagatgatgatgcaggtaagtaaactcagcctgaaatctccattcctttggccactatgagcagggagttgggatctgttttaagagagctgatagcagtctccttggcatgaagttatcatgaacagagcaaatcaaatataacccaggatgctgaggaaggattcaaggaatacttattcaacataaataaaggttttccagaggtttttccgtctcagtcatccaaattacacagctctgagaccacagtagcaaaaatctaggaggcagggagctgaggtccttcaaaattatgaaagcaaaaaggcaggagcatctggaaacagtaccaaatacaacagaaaaatattagaatgtgtactttctaataagtatacatgttaaatatgggattttaaatttaggtagatgtgtactaacctgttaaccaatcatctgcaaaggggtgaattacaagggacttttactgtctaaaatatttgaatatttcaaagcacatgtagtaatcatctaatcatatatatatatatatatatgtagtttttaatggggagggaatgagcattgttatctttgacaaagaaaaaccaacatctcagaaaaatataggcaaggaagattctcaaagcatctagcaaacaagtgacagtgaataaaaattcatagtccaatattcattcttactaattgaaggcctataacatgtgattgtctttatttagaatgcacaggttcactactaaatgttgtctctcttgttttcccataaattcctcagggctttttaggaaccaaactttcactgttatagaaggaccactgaaagcttaaattttagatcttagaatttttgtgttcatattgttattattaaagttgcactgtaggctgggcactgtggctcatgcctgtaatcctagcactttggaaggccaaggcgggtggatcacttgagctcaggagttcgagaccagcctgggcaacatagtgagacctccgtctctacaaaaaaataccaaagaaaattaaccaggcctggctgggcgcggtggctcacacctgtaatcccagcactttgggaggccaaggcaggcggatcatgaggtcaggagatcgagaccattctggctaacaaggtgaaaccctgtctctactaaaaaagcaaaaaattagccgggcgtgctggcaggcacctgtagtcccagctactcgggaggctgaggcaggagaatggcgtgtacccgggagacggagcttgcagtgagctgagatcgcgccactgcactccagcctgggtgacggagtgagactccgtctcaaaaaaaaaaaaaagaaaaaaaaattaaccaggcctggtggcacatgcttgtagtcccagctacttgggaggccgaagtgggagacagtcttgctctgtcacctaggctagagtgcagtgatgcgatctcggctcacagcaacctccacctcaaatttgccgggcacggtggctcatgcctgtagtcccagcactttgggaggccaaggcaggcagatcacttgaggtcaggagttcgagaccagcctggccaacatggtgaatccccatctctactaaaaatacaaaaattagcctggcatggtgacgtgcgcctgtaatccccgctattctggaggctgagacaggagaattgtttgaacccaggaggcggaggttgcagtgagccgagatcgcgccattgcactctagcctgggcaacaagagcgaaactctgcctcaaaaaaaaaaaaattcatattgctatataagttatttcagtaaagtatatcatgtgcctgtttggtggaaaagttaaaggaagaaaccaggaaggaaacaagcagaacagtcatcttcaaaagtaatttgtgtttaagaatgtgaggcttaagtagatgttttgcagtacattttatatagatactaatcttgccctctaggggtctatactttaagcctggcagtagtagttaacaaggataaacacaaaaggacaagtaagcaactagaaaataaacatggaggccgggcatggtggctcacgcctgtaatctcagcactttgggaggccgcggtgggaggatcacgaggtcaggagttcgagaccagcctggccaatatggtgaaaccctgtctctgttaaaaatataaaaactagctaggcgtggtggtgcacacctgtagtcccagctactcaggaggctcaggcagcagaatcccttgaacctaggaggcggagggtgcagtgagctgagattgttccagtgcactccagcctgggcaatagaggcagacaccacccccccccaaaaaaaaagagaaagaaaagaaacatggaaaaacatacaaatagaaagattaaatatttacgtccattgtgtacaagatcatagttttaaaagaaatgcatctgtggattcagggggaagggcagcagtgggagaagtcatagcagacaaccatatctattcagaagagggtgacagaacacattctgctggcaagtatcataaactagaaattttcaggccaggcatggtggtttacatctgtaatcccagcactttgggaggccagggtaggcagatcacttgaggtcaggagttcgagaccagcctgaccaacatggtgaaacctcgcctctactaaaaatacaaaattagccaggcgtggtggcaggcacccgtaatcccagctattctggaggctgaagcaggagaattgcttgaatcagggaggcggaggttgcagtgagccaggatcgtgccactgcactccagcctgggcgacagagtgagatgctgtctcaaaaaaagaaagaaaagaaagaaagaaagaaggaagaaatggaatagacagccctattcatcaccctgcaggctgaagcctaaattccttggcttgactcactaggtcctggagagcccctgctaccctctggcgaacgtgctcatctcttccccagctttccttctcacctgaccaccagttttcagaactccttccagtgggctacaaaccaccaggctgtcccatcgcccttcccctttccacgaggccagttcctactttttcttcggctcttgctttagacctctgccctccgtgagaatggctgtgtccccctaaatgcttctgccaaccttgtgctttccccactcacagctctcattgcctgtaatgaaagtgcccagattaatgtctatattgtccctaaacccagcggagatggcagtagttatctgccttatttcccctattcaacagcagctcagtgaacagttgtagggtaactgaaatgaatatgaaaatataggttaggtgttagaaaaagagctaagaggatcctttataggagtgtttattttattttattttattttttgagacagggtctcactctgtcacccaggctggagtgcaatggcacaatctcagctcactgcaacttccaccttcagggctcaagcaatcctcccacctcagccttccaagtagctgactacaggcacacatcaccacggccggctattgttttgtatttttagtagagacaggggtcttgtcatattgcccaagctagtcttgaatgcctgaactccacctggctgaggcctcccaaagtgctgggattataggcttaagccaccgccactggccagtcgtgtttattttatttatttatttatttatttatattatttatttatttttttttttagactgagtctcgctctgttgcccaggctggagtatagtggtgcaatctcggctcactgcaatgtccacctcccaggttcaagagattctcgtgccttagcctcccgagtagctgggataacaggcacccaccatcacacctgcctaatgtgtttatttttttaaaaaaagaaactgtatctttagagaaaatgtatacatgcatactttgctacatttttgttgattgttacattttacatttgtataacaatacaggcaagtcatctttgcactcataaccacatcttttatggaacatcaagcctactctgaggtacaggctttcagaagcctgaatttggaggaccatgcctgaaccaaatggagtctccagaatcaaaactgctcaaaataatcattcatggttctcagaccaaataagatctacttagaaacatttctcgacagcacgctgccatgccgacgcagaccccactctgcacgccagcccccctgcacccaccatggccacagttcagcagctagaaggaagatggcgcctggtggacaacaaaggctttgatgaatacatgaaggagctaggagtgggaatagctttgtgaaaaatgggcgcaatggccaagccagattgtatcatcacttgtgatagcaaaaacctcaccataaaaactgagagcactttgaaaacaacacagttttctggtaccctgggagagaagtttgaagaaaacacagctgatggcagaagaactcagactgtttgcaactttacagatggtgcattggttcagcatcaggagtgggatgggaaggaaagcacaataacaagaaaactgaaagatgggaaattagtggtggagcgtgtcatgaaccatgtcgcctgtactcggatctatgaaaaagcacaataaagattccatcatcactttggacaggagttaaccaagagaatgaccaagctcagttcaatgaacaa

SEQ ID NO: 2168 - DNA, 1423 bp, Homo sapiens
tcgggcacccccgcccgccaggcacggccgcggctccttcctcttcctgcccgcggtagtgggggtggggcaggcctcgggacacctgcctccgccgccggccgccggccgccgtcctcgcgcggcttcccgggcggctctgccccgaccgtagactcccggcccgctcgccgcggcaggagccgtggttccgcggacctgggcgcgctctctccctggccactgggagaccccccgcggcctcgcggggaaaacctcgggactgccccgcgcccccggccgtctctgcgtcgctccttctcgcccgcgaccgtggactcgtcctcgcgagcctgggttggcggaagctgcgggggccggggtcgcactacttggcgcggaagggccggcggtgggcggagggatccccgtccgcggggtgagccgctgggcggagccgggaggagccgcgaggatccgcagtggggagccgggaggaacctggcgccggcacccacccgccgcgcccacgcgtgccgcggtcgcttgtttcccgcgggagcccggccgcgctcggggggaggcgcgcgcgcagctggggctgcctgggtctaggagctccggagccaccgttttgtgcccgtggagccgcggggaaggcgcacgcgctcgggtcttcccggcgggtcgtcctgcactttctccctctccggtacggaccgcggcgttctgtttccaggcaaaggaaaataagtcaaagactcagaaggcagcctgaatccagggcctgggatgcagggtttgctggaacgccagccggtgcgatcgcgcccctgggattccgcttagcccgcgcgtccatttccctgcatggtggactcagtaaagccggatctgtccaacgcctgcagcgtggatgtggaggcggactaatcaactagtgctctgttattatttctacccatcccttttctccatgctaatttgcttagaactttaacattgaatggacagcaaatgtcatgttctgtttaattatcactccttgaccattatgttaatttctttccctaacaaggtgacgcattgttttaagtaacaatgaccaactcatctactcttcttccaaattgtgtaaattgaagggtaaaatgtgggaaaacgctaaatttgaatgctaaatttgaacatttcacacaacaataatttgaaatgcttctttgcaatattatggcgtttcggaacagataaaaatacttcattttcagacatttggtcaacaaatacttcttggacgtttatatgcaaagcaatgcatgtaacattttcattactttgcaagtgtgcttatcagtaaaagaattttgttttaaattctagccttcgtttaaatgtattttagttaccacattgggaagaaaataaaatattactatgtacggaa

SEQ ID NO: 2169 - DNA, 10642 bp, Homo sapiens
tcattttggagtatttactatccctgaaaattaatataatgggggtgctaatgctaatttttaaaaccaaggttagctcaatgaattctccttttatataaactagtaccattcactcattaggatacctacataactgcaaaataattcaaagtacacagagacaccctttaaagattcatcatatacttagacgatatgattcataccactttcctgtggaaacactcaaattattcacaataaatagaatgcaatcttacaaagttgatggcagcaccaagtgaagatgggtgcttccttcaaaatacttgatttagattctgccatcttattcacatagaacctaagaaactctttccgtaattaagcagtaattcacaatatatacatctctgaggcacttgttgtttcaatagatggtttgttcctctccgtaattacaaagacaatgagccccaaataaaaagtatcctacatttttagtgactcaagatacacacaactcaatataaaattcatattcactagagctacaaatcataatcactatcagaaaattctataataaaatttacattcacttctcctcctactaatcttacatttatcagcatactaactaagcagagtgtggtaattccacatatttggagctcctctaagccagtttctggagatactctaagatatggttggattttctgagaatgaaatgttttatactttatgaggaacccaaccagacaaagaagtttactatgagtctcttcccttattccaaggactttgatttctgatgtttgcctccatattgtgtaactgtagcaccatggaaaacacaatacatgtattattgtagtaacattacagagttttatcaagaatctctggaaaatagataattttgttgtttgtatactgtcagaataattttaataatgtacgattcagtaattttaaacagggaatctggctgaattaaatgcaggtaaaacatagttactcatatcccatagataagccaaataagatatcccataaatgtcttaaaacttataaactataatggttaggttcaacaattgtttataagggactgcagtggaccctttaaattgaacttcagtgatttgtccatatgtacaagagcatcaaaatccagggtctcatttcatgacagcgtgtctagaaactcatcttactaagaatacagaagactctgaaaaggttgtcttgtgatgcttgaaacatattcatagttgatttatgccagaaaaggggacactgaaagtattgtcatcagcagttacgggcttcctcttccagttaagctgtggtacatctctccgacacacactgtacttgacaacacttgtggtacatcagtcttgtttgacaattttgttcatctcccttttttctttatattaagatgatcatccatcttacagaagcacccatagattaatattgttatgaaaacattccttatgtttagctgactccttgtagacaagcagtcattttcatgtttccattgacttatttccaaattacattgcaaaggagattatttttttccaacacgggaaattaacttgatattaatagtatggaggctcttgtgtgctttcataagataaggcctttatttatctgcctcctgaaagtgacctggggcacttcagcctagtcttgaagtacatattcttttgggcctctgcaatcgcatgttcatattttgaatctagtaacagaagacaaaataggaatttatttttatttttatttatttatttatttatttatttatttattttaaagacggagtcttgctctgtctgagcggttcaagcaattttcctgcctcagcctccctagtagctgggattacaggtacacgttgccatgcctggctaattttttgaattttagtagagacggggtttcgccgtgttgtccaggctggtcttgaactcctgagttcaggcaatctgcctgcctcggcctcccaaagtgctaggattacaggcatgagccaaccgcacccagccaggaattctttttgagtgctttaatttttggtctttagaattctagtgctcaagttatgaaatggaggagaatgtctatttttacactgagtaactcacacattccttctcaatgagggaaaaaacatacttgtctaaaaagatatatactaattcattatatgtgttaataatgaaaatagtagaacatgtctgagaatgccttttcaaggcctgcatagggatggaaatctgaattaagctttggaattgcaaacgtcagaattgagactgcattgataagcagaaaagcaaataatgctgacctgagatcttcaaccttctctcctgtggctttcatgagtcttgaaaggagactggtgcttactaagaccactgatttgtactaaggagcgtttgcatctggtgtcttcccttgtgctgaaatagctctgagtaaatgctttgattccctcatgatacttatgggactttttttctaatgtgtcttttcctatgtctaaaaagatttgagctctgactaaaggctttgccacagtcatgacacttgtagggcttctcaccagtatgggttcgtcgatgctgaatcagaattgcgcttcggctgaatgcctttgcacactcgtcacatgcataaggtttctttccactgtggattctctgatgtaaaataagggctgagctctgactaaagattttgccacattcatcacatttctgttgttttttccaagaagggtttccttgtctcttttcaaacctaccatcttgttcataggttcctctatatgtggaactctgggagccattcatatgaaggatattggaaacattgcaatgcagttctatgcctaaagaagtcttttgccttgaagcagatttcacatttgtagttttgatgtcttcatctgaaatggaaaaacaaatgtcaccaggaaagagaaaggatgatccaaatgaaatatacatgattattgctagcatgtttataaaacaacacacaatgtgaaggacggagagtgtaagacaaaatattgagaagtttatataagacatagagaaaggtttacatactgaggaggcagtcaactaaactgtaaagttgcaaagttctatggaaaagacagaatagggaataaggataaaaagatatgtcagagactaaggaaagtctggaaggaaagaaagggcttagaaagaagaaatgattggagacacagagagctagaaggagaggaatccaatgtgccagtgggagtaacaaacaagatttagtactggagtatcaataaataaataaagcttaatattcataaaggaatcagtaactatgcaaagaaatgagctgaagaaagccaaggggccaaaaaggaatgtggaaaataaagtaagaaaatataagttaggccaataaagggaagattatagactaggataactagtacctcaaaagatcaagggtagcagagtacccactgatgaaaaacctctactcctgtatggattttatattactggttgaatcgctgtttgttgtattattttgtattacatttaacatccatgaaaaacgtacatggctgcttatgggctgcggccactcaggcggcacacaaacctggcttgatgcagagggccttatgactcagggtgcctaaagctccagcagaactgctaactcagatgtgaaaatgccagtgtaatgtggttgcattacctgaagaaatcacttcagttatcctcatggtggcattttttttttttttttttttttttttgagacggagtctcgctctgtcgcccaggctggagtgcagtggcgggatctcggctcactgcaagctccgcctcccgggttcacgccattctcctgcctcagtctcccaagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcccatggtggcattttaactgaagctgctgaaagacaggagcttaaaatgagtttataaaagcaaagtacaacagttttggacatgtctggggagatgacttggctggggctgactgtgactactgggggtgcctttatctgaagtaattatataaataagattaaaagcaacccagagaggtactgatgataagtgattccctgggccctctcaaggcctaatgaaaaggttagggtgagaaaggtagtctggggagaagaattagtgatgcaatgtgatactgaataagaaaactgagttgttgttttactctttagaatttacttaaaatggatctacctgctgtctctacaatctccttagaatcacccaacataagctcaaatcttaacataagcccttcccaattccttcttaatgacacaccccatagtttctgtgccgtgttctctttcttgctgcagcaaactaaataaacctaacttgaaaaaatatataaaaatcaaatcaaatgggtctaaatagttattacaaaaggaatttaaaattatttattgtatttattcacaaatatggtgtctcagtccattttctgttgtttagaatagaatacctgaacttgagtaatttatttataaaaagaatttatttcttatagttatggaggttgagaagtccagggtggaggggtgcatctggtgagagccttcttgctggtggagaccctctgaagagtcctgaggcagtggagggcatttcatggtgagggggctgagcatgctaatatgctaactcagccctttcttcctcttcttataaagttaccagttctcctatgatcaccaattaacccattaatccatgaatgagttaatccatttatgagggcaggggtgataattcaattacctctcaaaggcctcacttctcaatactgccacacttgggattaagtttcaacacaagttttggaggagacaaatattcaaaccatagcatatggcatactcatttattattactagtttaagtggaaatcattttataaatggtaaggattctgtctcaaattcatttttgatagtttatattccaaagtgacctcaatgattagtcattactatcaaaatcctggcatcaattagtactttacagtactgagaccaagatcatctcccagaagctttcataagacatgactcagtaccacagaaatcatgttgtggccttaagaaatggttctattattctatcaagtgattctggttctctctgccttgtactgcaagatcctggacctgttgcattctgtttcaaatttctacgaatcttaaaaaaaaatgtaggaaaggcctccatgaggacattcacaggtaggatgtggttcttgccacacctggctttgaggttgatcacttctgtagtcaccaccacaccaagctgctgaggctgggatggtctccctccctttcctgacggaaaatactttttcgtgaaaagactttcacttttctaagtataccaagacaatttctagactggaggtattacgtgtcccagtataagccttcagagagccagtacttgccaagttagggtgaacaatgttttctaaatctctttctaaattactgtatttcctttgtgtagtttcttataaaaattcccttggaaaaactctaaccttgcttagctatcagccactcctgaactatggaagcagtgctggagagaaggaaggagatgctcccaagtaggatttccctcttaatctctggctcctattttatccaggatgatcatctagaaggagggtctctgctcaaatgtcgcttcatcagagaggcctttctaccactctatataataagatcctatccccaccattctgtttaaagtagcatggcccttttatcaaatgaaattttacattgagttccaatatataaaacagacgaaaacacagctactctgtctgaagcaggagcagtcacagcctacaaggcctctaactcagccttatttctacttctcaccttccctctagcccccttattctgttttgtttttattttttccccatagcacttatttgtttagtatctgcaatggaagaatagattgctacacagctattctggagcacttatagaaagcaatgcaaagagcagttgaggccagttgaagatgtgagggagtagagaagtgtattcaaagcacgtatgagagcaaagtcaccttagcagcaatataggcgattctgctacgagatcccaccagtaactgagcagttatataggaaatgatgatgaggatcagtggtctctgggctgtgtaccttggggtcccacagaaaggcctcaagggctgcctgaagataaaagggctactttaaaaaggcatgaaaaccctgatgcagatgtcagggatttaaagtctgaagattttataagaatctctgaaaaagaagcaagaacaaaatactgaagatcttcatttagtaggacaaataacagaagttcccacagtaaggaggagatgagagggggagatttgaggcctcttgcataaatcagctgagatgtgtgtggtgagcagagggcccccacaccttccaacatgaactgaatcctgccccctcaccatgtggtcttaaggactgaagctcccatgatgctccctggagctgcttcttcacgggcatgagctggctacttggcaattcctcagtgatttctgaaggtgctagcttctctgcaatcatgtccttccttcgtccaaaaaagatctaaaaacaggaataattgaggctgaagaacaccatcaggttgggacttgaggataaaataacagagaagaaactatgcaaaaagtatcatggacacaggaaaagggagggaaaaagtagagccaccttctatttgctgggacacccattagtactttcacccctatacatccagttgtgctgagtgggaatacagtttgagagctctactcccaatgatgtgccagtgctcttgactcagcctgggggttcatctccacaggcatccttcttacctgctttggtccatcaagctctctctccacatcctccagcatagtcacagtttcctctccattctctggatgatgcttctgcacccaggcctgaagctcttttgggaggatggccaggaactgctccagcaccagcagctccaggatctgctccttggtgtgcacttccggcctcagccagagatgacaaagttcccagagccggctcagagcctcatggggcccaggtgaatcctggtagccaaactgcctgaattgctggcggaaggtctctgggctgtagctgctgctccagtggaggctagagtctggatcacaggtctgctcttcctcttccatcttctctgtcagaatcccattacactcctctgaagtttgtgttaggagtgatgatgactttcccaattttgcagacattttgacagacaaatagctcagtactgttaggctttaatcctcaaggaggtgaagctgtcctgatggacactccttaaatatgattaaagaaacaagtggaaagaagacaaaagacaaatgcttcttagaacaaaacaactaagattagaaacataagactgtataggaactactgaccttagtcttaacagaaaccatgcttttatttatttatttatttttgagatggagtcttgctctgttgcccaggctggagtgcaatggtgtgatctcggctcactgcaacctctgcctcctgggttcaagtgattctcatgcttcagcgtcctaagtagctgggactacaggtacccgccaccacgcctggctaatttttgtattttcagtagagacagggtttcaccacgttggccaggctagtctcgaactcctgacctcaggtgatccacccgccttggcctcctgaggtgctgggattacaggcttgagccaccacgccaggcccagaaaccatgcttttgaagaatacttctttaagagaaccaaacagctaagactcattaattcatatgcataagtgattcacaattcattctgaaaaccatgcccacaaggctactgaatattacaataagagatcagccaggattgcatagaagctcccagataatggaaataagggaagcctgagaaatgctctaactctggagccagttcaaagagccaatcggtatttagtgtgctgcaaagagctcaaagaaatagtctcatgagggaagcacttttgtgtgacttttttcagcttttactgttaaaacattacttcgacattaaaggaaccattaaaaaaaaaataaaccaatcagctgggcactgtgcttatgcctgaaatcccagcactttgggaagccgaggtgggagatgggaggatcacctgagcccaggagtttgggaccagcctgtgcaacataatgggaccccatctctaccccaccaaaaaaaaaaaaaaaagaaaaaacaacaaaaaaggcaatcacgttccttcatctgaatgtatttctatttttttccatatccatattacttacttaactattttaaaatacttaggttgtttctaatttcactattataattaatgctgggaggcacatctttatgaatatactgtttttctcctttcaaagtatttctttcaagcatgtcccaaggcctctgcttgttgaggatcaaaggagaagagcaaattctgtcttgctatgtattatcaaaatattgcacaaagactgtatcaattcacaataccatcacaatcatagtgacttgtgagggcaacgatttcttcaagtattattagctcgttagcaacaaagttggggggggacggcactttcctttgtatcattttactgttaagtatcaccagtaactaatctcattttgttgttgttgttgttttgttttgtttgagacagagtctggccctgttgcccaggctggagtacaatggcgggatcttggctcactgcaacctctgccttctgggttcaagcgattctcctgcctcagcctcccaagtagctgggattgcagacgtgtaccaccacgcccggctaatttttataattttagtagagacggggtttcaccatgttggccaggctggtctcgaactcctgacctcaggtgatccctctgcctcggcctcccaaaatgctgggagtacaggcgtgaggctctgcacccggtctaatcatattttttaaattgggcaggaggtatatgatagtgtttgtacaacttcagcaaatgatgactactttaaaaatcttacgtgcgcctccgtcttccatcgttatgtatcctgccatttgacttattttctcacttcaccaagtattgttctaggccctgtataaagcctgtgagttcataaagttgttaccaaataaatgatacaactttacacaatgatgtgctatgaaacaaacaatagcagacacacatattaacagaatttactatgtgccaagcactgttttgaacaccttagtaaaaataaacaaaggttaaatcctcataaaagccctagattatttttacccccatgttgtagacggggaagcagtcacagcaaagccaggtactctggccaagggcaaagctggggtctgaacccaggccgtccacatttatccatggtgctgtgtggttagaggccataggcagcaggggcccttgtggtgacccctgcgcgttgtctcagcgcagaggaggaagtggcggcaggcagccgcgctcccagatgaagcggggccagaagagtctggggaacaagacctgagaggtgggaagggttgaggccaccggtttggagccgtcaggtaccctaagggatatatgagggaccccggggctaaagcagcctctggaagagagtggccgccctgtcacttcagcaccaggcgcagaatctgtgctaaacctgaggtgagggtaaggaacccccgacaccgcacgacaaccagaaagaacgtccctggaggggaggcttcgatcaaagcctgggacgcaggggtctttctgcaggggacgccgctctcggctctaccctgctgtggtgggccggctctgggagggctggcttccgaccatctcccgacctcccgcgcccaccgcgccgcgccgcgcgcctcccaggctgggaaccgccggggcgaagcggcaggtggcgcgggttcacctggcagggcaggcgcccggggtccgccggggaaggacgaggggaaggggtgcgcggactcaggggcaggcagcggaggggaggggcctggggatctgggacggtgtaagggtgctgcacttgcgcgcgaagggaggggtggcgacgagtccgcggccgcctctccgcgtcccccttccaccacccggggaccaccgcctctgaccgcagcctgggggccctaaagaggcctcgggtctcacctcccgacgccgtcggggagaaaccggggaactgccagctgcgcaacaacttccggttct

SEQ ID NO: 2170 - DNA, 105296 bp, Homo sapiens
gtaaaggcaaagaaggtttttatttaagtgacaacatttgagagctaaaaaccagctcacatcaaaatcaagacccagttgtaaaaatcttttaactccataatgctgtttttgtcttgttagaaatctgatatcttacattagcgtttctaacggattttgtacaaggcagccataaggaatataataaacctttttcaccacagaaccatctgtcacagataatactgaaagttacacacttaggaacagtcagaccacagacaaggtcagactggctgccaccaccaagtaaacaactagaaaaggacagcggggtccaagggtgggggtccctgtgcacgagtcgccctcctctggcctgccccccctcgggtcacctgtttctcctttgccccaaagagggtggagtcaaatgcagattttcctcccaactgcctgttagtgtctcaacaaggagagcagagcccaggtcaggcctcactgcttggacttaaccctaactatgatttttacgaaggtttcccccaagcccggaaggaaaggaaggagggaatgtttcttttggctgagccaaaagacaataggtttccagggcacttggcacccaaaccccccccccccgcccgccgatgggattcggtgggaaagttggttgtttaaggcggggtcagggcacccctcccggggctgcacctgggctaggggggagagtgaggatgcagaggacccacgtgcctcatgaaagactccagggcacaggtatgggtcccaaaggggtaaaaatacagtttaaaaaccgtgagatccagcctcgcctcttctagacagcccaccgccaggaatctctggaatactgggattcaaacacatttgtttgctgtagcccagcacccagacaagagggccgttcatcccaatgcatgaaaggagtctgcttttttaaaaaagaaatattttatggagcccaagggagccgttgagatctttaggaaaaaacccatgatgctggaagagcaggtcctgggctaaggatgcaccctgaaccccaacagggcaaatgataaaggaaggtggcaggcaggccctcggctacgacagccaccggatcgggaagaacaaacatgccacgcaagaaacaaggagctttggtcaggcaggaagatctgtttccagctgctggagagcaggcataccagaagctagaaggattctctacaaaacagctggattgggggtcacagaactactcaaggagaggcagcagcaccccctccagagaacaacacaacttggttctttctccaacttaaccggacagacaaaactgagcaaaccgctagtgtagaaagagcatatgcattacacagttgccgtgaaagcagtactgaaacataccttgtctcgccactaaacagaaccgcaggtacacactcacacacgccaactacagctccagttgttgcgttcacaatatctcaccgtacaccatcagcatcttgtgtgtgcatcatcagccaaagccccgatcctcctacctgattgctgcttggaaccagagctgtttccaaaaggaaggggtggtggccctcctgctgggtcctgtgtcccagctctgaccccagagccacagaaccctggtcacactgacttcaaattccccagggatcctggctcatgagctctctctctctcttcctctctctctctctcttcctctctctctctctctgtcttcctttctctctctctctctctctctgccttcctgtctttctttctccctctctctctctgccttcctctctctgtcttcctttctttcctctgtcttcctttctttctctctctctttctctctccctctctctctctctctctccctctctctctttctctctccctctccctctctcgcctagcctggggttctcagggaagagggaatgtaactgggagcaaagtaccccatactaattattttatcattttagtgtaaccagtgccttctgcaagaaggagatggtagagttttcaagaatcagactaagtctgcccaagtttaaatcaggatatttgggggaaggattagggttggggtggctatgccatatgagctggtgcctttggaaagccaagaactgtgaaatgttaaaggggggatgggcacctgtgaaccgccaggagacaggaccatagaggaggctgaggctgaggctgaggctgagcctgatccgcactcctccccatagactcgccagcagccctgggcttgagtgcaggatgcagcactggaagtagagcagaagagctggcagactgaagacacatttctagtggggagagcagggatgggggttaggagcccagacccctccagccccaggagggcacccaatttgccaggcaattcacaacggcggtgccagccgcccccaccagcagcgtcactggctgcatgggagccgcgagaggtagacattgagcagaagcgacactgagctgacacaggtgcctgctgtgtatacagacgtctgggccctggggcagcctggctgaaattgctgggaccggccttgatggcagcctatgggggctcagtggccacgtgggcagccccacacagcaggtgtgggcctgggccagggagtcggggttttccaggatgcaggaaagcagtgcccaggccaaggttcagcagcaggagggcctgagcaggctttaggggccccagaagggccaagtcctgccaacctcaggggactacccaggaggaggttatgggcacaaactgagcagcaggggaaagggaagagaatacaacagttggagccaaacttccaggaacccctagaaccctggaatctcagctctatgcctctgggagccaaaaaggataaaagggtcctggcagagctggggttatggggagcccaatcagtaaccttttggcaggagagggaggtgggttgtccctaggacacccagtttgagtgggttgtccctgggacacgcagtgcaaggcaaaccagctgcacctctccgtggagtagggatcccttcccagcccacccagagaggctcctttaagagcccctcctttccagcccacccagaccccctctcccaggctgtgtgaaaggtgtgggtcacaggacactcggagggacccttaggcctgaagagcctcaatgggccaaactgcaggacatcttgggagtcaaagactcacaccaatctcagctagggggacccctccaataacagaaggaagacggagcccagagagggcaagcaaccagctcaggggctcacagccagcccagctgagccagagcccaaggctgcagcctcccaagggagggcatgaggcagggctccgggaagaggaagccctggcctccagggccacagggaaatggtgaggacactgaggacaacgggggttggggacaatggacagctgcaggacagaccgtcagcaccagaccccacccccgagggctgtggacagagacggcgtaacatgagcccggggatgtgctctcactcccagaaagtggccatcttgccataagagcgccaaccccaaaatggtgacccaaaccacaggaagggcgggcacaaatgccactcacacctccacaagacagcccagaggctgtgcctgccagcggcgcttggtgccgaggctggggctgcccccttgagggcctgcctagctcgctgtgaagcctggggacgcaggagggtggtcgactttgcccaaacgcttcagccccgggcaagcctgcccccaggatgacacaaacatgaaccctgacttgggcttgcggtcgcaggcccgtgggaggcagcagtggctgcaccgagatccccggacctcaccccgtcgcagctcagggagccccccgggctcgggcaggatccctccccgctctggtcggacactgctggacagacacgggagggaaaaagcaggaaaacgcctgtgtcggggagagggcagccccctcccgtccccgcaggcagcctgattgggccccccgctccctgctctgagcacagcccacccctcagggcaccgactcgaacttggggggcccacgcgcccagctgagcgccggcagcggccgctcgtggtctttgtccgactcgggctggctctgggcccgctcgggcttggggttggcggcgggcgggtcgggctgctgcactgacatggttctgcgcaggtggttgcgcttccgcaggaactctggctgcgcgtgcagcccgaagctgcccttgcgcaggatcatgcgcgagttgttcttctttgggcgtgagcggtggctggcctccagcgcggccaggtgtgcggcgtagccctcgctcaggaactgcggagggcaggggagggcaggggagggcagggcagggcagcagcgcagggggaagaagggaggggagggggaagaggggaggggaggggaggggagggagaagaagggaagcggaagaagggaagggagaggaggggaggggaagggacaggcatcaggcggaggggtggggcaggccccttatcctgatcctgtccccatcatttcccgggaacactctacggaggcacctccagcttctccaaggaaccctggggaagtcgggagctctttactgttccagggtccccatcctgctttggacaaccatgcatctctacctgtacccatgggtcacaccagagttctctggattttctttcctattttattttaattaattaatttatttatttgagaaagggtctcgctgtgtcgcccaggctggagtgcagtagcccagtctcagctcaccgcagtctcaacttcgccagctcaagcaatactccagcctcagcctcccgagtaactgggaccacgggtacatgccaccatgcccagctcattttttaaattttttgtagaaacagcgtcttgctatgttgccagggctggccttgaaccctgggctcaagcaatcctgcgtatcaaagcaccaggattacaggcatgagccagggtgcttggcctctggattcttgagggtggggaagcgcccatccttgtcacttggctcactagaatcctgcaaagtccctcccgtcacgcagcctcaccatgcctcttgtcatttttctgagccctgcgactgccctccttgccagtccttctggctgtgtccagagccttgctactcaatatgtggtccatggactctggcagcatcaacaccacctggcaccttgtcaggcagaacttccggccctctccccgcccctaggcctatggaatcagaatatgcatgtcaacaagatctccaggtgatgcttgtgcacttcagagtttgagaagcagggcctctgagttcccaactgggagacgccaccatctcctgaccctctacccgcgggtcactctcaggcattgcacacttgacatgccccagagggaggtcaactccttcccttccacctgctgcgcgattccaatagtggcacctcctacgtggtcacccaagccacagaccaagtagctgtcctccaccttccctttctctcatcctgcacatctgatctgggcattaccaaacccaatccatcccctaccaaaaaatgcctctcagaccctccactttctcttcaatgtcctctcggcttttctttccttcctctgaaccacctgccacctgcagcctgagggagcttcctgaatcacacacctgctcatcccacaccctctcagagtccccacacaggccatcttggccgcactgaccgttctagccccgcccccccacctcccagctcacgtcccatgcagccaagctgagtcactggcagttcccagaatatacatgttctgtgtcacctcctgaccttggcttttgctgctgcctctgtcacaaatattcttctcaatctcaggcccttcctggaccattccttcaaattccggaaacccaaccttgccctggagtctgggttagcggtccctctccagggccccacagttccctgtgctcccgtcatacatcatggcacttgttacactccactgtcaccaactgcaaatgtgtccatctcgccactacactgaagttcattgcatctggctccacttgggattctccccctgcacccaacacaggccctggcccaaggcaggcaccccgaagtgtttgttgaataaatgaatgagcaaatgggggaatgaacaaatgaatgaatgaatgaatgaagtgcttactccctctatccctttccctgacctccctcacaactccccgcctccagccccgcctccacccacctggcactgggtttggtacttcttggtgggccggcccacaatgaagatctgggaggcaggcaggcccagcacgctgtagacagagatgtccttcgtggagccataggccgcactgattttgatgaagcactgaaacacagggcaggcatagggggagagtgaggccagcccaccccctggaaagccttcccaggccaaccccagggggcccctgcttggggaccctttatgtgcactctggtagactccaagccatggggccaccctgtgtcaggaatgaaccctcagagtggctgcccctccctgcaccccaggcccaacccaggtctctgcccagtaaacagtcgtgaccacaccatttaccggccccgcctccaacagcagtacactcaggttaagtaataatgaaggcaagcgttcctttgtggataaggaaattgagttccaggtttctggctcacagggccaggactggaggccagttctgcctggctcctgatcctgtgctgtccacaccgctccacactgcagcttgccatgtgcccactgcctctcactggctggtgtgatgaccgcccccctccccaaccccagaatccccaattcaattcagagaactgcacaaggtccgtcttgctccaggggcacttccagaccatcacccttccctcccctccccaggataaacccgatcaaactacctcctcctgtgaggtgctcgccacccagctgcccctcactgtgtgcctcctgtcactgtcatcttctttttctcccactcacactcctctcaagccattggagactttggtcctgggtcacaagctttccttcctgccaagccccaccatcactgggatgacccacggtctgcatgacgtgaaggatctaccacctcccacccggcctggcagcttcgcaccttctttcacgtcagtggccgtcacttccaggaccaaactcagaacctgcccctctaactgtgaacttccacatgtccgctccgctcagggcttctgccccctccccaccacttctccgccagcccccacctggctgctctcagccttactgacacttgtcttttctgcaccagccctgctgcctcgccccttcctcatcctgcctgagtgacccatggcatccctgtgtccttgcctccaccccggattctctcaccccttcatcctcctcccacacctgcccggccaaatctcagccctggaaattttttccactatccaccttgtgtttttgtacatgctgcccaccgagagctgctaaagaaacagagccacgcagctctcaccttccatcttcttcctgtccttccctgagccctaccccatcctgcaggtgactgccttcgatgctggaccaaggagagggcttcctcagcccactgcccctcacctcaatggttggtttattcccaactggcctttggctcagaggatggagcagcccctcttcgtctggcccttccaccttctcattcacctgagctcactcctataacttggatcctccagctctggcgaccctgcctacctgcctcatgaccctcccagctgacacccactttctctgctcctctccctgctacttttgcccccttgtccttccgaactgtcttttcctcacaaggtcatctggtggccagtctttgtctactaggcagttctcagcatcccacaccctcggcaaaaggggcgctatctccttgaagccctctcctcccgatacctggagtctcgtctctctctcctggtcctcctccccctcactctcctcctggttcctcagctgctccttgtgctgctctcagtggcccagcacagcctcttctaacgcctcatctcccgtctcatggctccactgatccgtctcatgcatctgtttcccagtctccacctgcagcccagaactaccctaagccatatcaggtcccgtggctgtatcagccttgacatgtccacagctgagctcatctccctccagcctggtcctcctctcatgtcccctctcattcactcactcattcatttattcattctaccaacatttatggagtccctaccatgtggcatcatcacccccaatgcagaagctatattggtgagcagaacggacaggctctgcctccatggagaccttggtcaggtgtgtagcacctggatccctcctggtcacccagcacgggcatcttagaactcctcgctccctgcatccaaccatccctgagccccgactattccacctcctaatcctgtccatgtttttctctccatcccatacccatcatcgcctggattatggtcttcctgtcttttgcttgggcaacagccccctaactggcctccctgcctccagtttctcctgccaatctgttctccacacagccaccaatgggatctttctataagccaaattagacactgccacttccctgctttaaactcctccatggctccccgtgaccctcagcagagaatttatgatcttggcctggtttccaaggttttcaagatttgccaagtttgggcccctgatgacctctgagggctcagctcccacttgtcctgggtttaaccctgcctgcacttatcccaagcctggaacgtcccaagctctctcctgcctccgtgcctttgcacatgctgtttcactgtctacctgacaaattcatgcttcaagactcagctcaaaagttaccacctcctagcagccttccctgccctccctggacaaactgaagtcctttctcctctgtttgctaaaagggcctttttcaaccacacaccagtagttgtcaattgacatgtccttcctcctctagatcagggatttgcagactttttctttgaaaggccagatagtaaatatatcaggcttcgcactgtgtcaccactactcaattctgctgttgtattgcaaaagcaatcatagacaatacgtagacagatgagcttggctgtgttccaatcaaactttttttatttagagacattgaaattcatgtaatttgcatgtcatgaaatatcattcttttgattattctctccatccatttgaaagtgtaaaaaccattcttagctgaccagtcatatcaaaacaggctgtgggctgggtttggtcattatatgtcaacgcctcttctgctctaggtcagggattcttgattaatctttctgtgcatcagaatcccctggagggcttgtgaaaaggttcctgagcccctccccagagtttctgattgagtaggtctaagagggtggcaggaggaggcagggcagataatttgcacttctcccgagtttccgagtttcctggtgctgctagtgggaaccatagcttcggtcatggaaagcacatctgggtcacagaaagcacatccgggtcacggaaagcacatcctctgcccccctggttctgtttgtctctgtgcagccccaacaagcacagagtaaggaacacaatcggcacttaaatgtctattggatgaatggccagatgtagagacaagagtcaggagataaaggacgaaagtctgactcagatctagggcaagttgccggagcctcacctttctcctctgtcaacgacgagactaataacctacctcacagggctgctagagggcccatccagatccacgggaatgggatttacagactgcacatcacaaggccccacccgggaggagggagatggggagcggtggagaggagggctgcgctctcaagccatggagtccccaccccaggatggccactcacctcctgcatgaggttgcgcaggaagatggccttctgccgcagcgggtcatgcaccagcccatcggagaagaagatcatgccctgtgggaagttgtgctgggacagccacgacaccacccgctgcttctgcatgtccggccgtcccgtgatgtaaaggatcatgtagcccaagtcctgccagtgcctggtgagatggcattagaagggtccagccctgcccagtgcaggccacctgatgcccagaagcctgccctgcccgcagctgccctcctgagacgtcagagggacgagtctgaggcgtgctagggagaacaagggggaccccgaatcccctctctgggctgagccctggacatctcccctggatcaggcctgcagatgccacaggcccatatccaaactcatctcctcacccctgcccctctgctcacagccacttcagagtcagagacaggcgcctttcattcttccctgttccctgtgcctccctccctcctcctcctccaggaagaaagcctttcgctttcaccaggccagactctttaacccctcccccagccctctcacttaagccttgcttctcatccttagctcgggccccatctctctcctgggccactacaaaagcctcctgggcggcctctttccctccacccctactcctacccacatctaacctgagccctgtaaccctgggcagattactcaaccctccccaacctcccacggtttcagtttccccctctgtaaaatgggcataataatatgaactaccccacaaggttgtcctaaagacgaaaggagttaatcccaaacatgcatagcaaggtggtatgcttggtgtggctggctttattattatcctccgcagtgtttccatggtgattcctgtacatcgcaaatctaaccccagcactcctctgtctaacagcatctccagctccccagcgccctgaggtagagcctcaagtcctctctctgcctctgtggccatgtctctgctctgcctttgcatatgggatctctccagcccacccagagctgctttgctgccccctgaacaaacccttggctcttctgctgcacagcactcccctacacagcccctacggcaccatctcctgatattcccatcttccatctttcaagaccccccttcctccaggaagccttccctgcttcccaagcagaatcagcctctttcctctgtgctctcacagtgcagtgggatagctctggttggctgacttcacacagaatcctggctgcaagatgtcaggtaagcccagacctggttgggcacctttatggcacctgccaccagaaccagctaatagagatggggagttctaaaactggatgatgatctgagggatctggggatgctctacacaaactcaggggtgcagggatcacccctagggattctggttagttctgatgtggggcccagtgatgtgtttatgaaaaggggagtttctgatgactgtcgaggtttggggagcaccatgtggagcaccatggggagcaccctggagcccatggaaggcagtgggaggatcatggacccccagagaggaaggaccacagcctccccttccctgcagtgggagggggactgtgacgcaggagggatttgttgtaatggcaacaaatgacctagctctacaagggggaggctggccccctgaaatgggcttcagcctgtctaggcctgttcttacggagctgctgggcatcttgaggccagcagtctcccaggagcccaggagccaggcccgtcttctctccccaaaaccgtcactgttactggggtgaggcagggcagtctccagcccccaggaacttccagtgcctggcatctgtcctactctcgaggttctgatcacttggagtcctgggttacagtttctcatgcctgtgacttattttccccaccagactctgagtgtcctctgacttaagagctcgctctgcatcagtgcccagcacacagcccagccacagggggcctcagaaagcagcggatgcgtgcacgagtgcagggagggaggcagggagggaaggagggaggcagggagggaagaaggaaaaaaggaaggaattgagggagggaggaaggaagtgagggagggagggagagaggaagaaacagacaagctgaggtctagaaagcaggagaaattttcccaaggatactcaataaattactgttggaggtaaagccagggcttctcagctcgcagccccagagaccggtagaattcctacagcaaatcagaaaaacaacatatttcccccagggctgctggctcctgccccccagggagatatagccctcgtggaaggtggcactcaccggacaacatccactgcacccggccggaccttggggtcgcttcccatgatagacacgctggccgcgaaggacccatcaatgctgaacactacacactccatgcccctgggcaacaccgtgaggtagctcatggcacaggtctggtcgcccctgaaagaaacctgcctgtggtcagccgtgaggtcagggtcagacgttagccggaatccagaggtcagcctgtagctgcagtcagagctcagtctgggtcaaggtcagagagcacctgggtggcatctcctgatgccacggctggtgacctctcccatccacctctgtccatgcagacagagatgggggcccacaaagaaccccaaggaccccatcctctagacaggcctggctggaagggccatagaaatgagagaaaccaccctgagaatggcccctgggtcttacctgacgaccatcttcacaggatagacaccaacccccaggcgccggggccgcggcacattgtatgtgatgcgaccactgctgttggtgatctctgtgtccaggtgtacccagcggcctgaggatggctctgccattactaggatgtccacctgcggcagtgaagggggtcagggactccctgaaggctgaggggctacaggcttggcagaggggctgggcgggggaactctgggctgaggtccctgcctgacattccctggctcctgccagcctggctcctcatttgtccttggatactctgagcccatcctttcctccttgctcacccttcccggcccgcccaagcaggtgggtagctcctggccctgtgcttccaccccaggcagctcggccctcttgacaccctcaccccacacgctatgtggctccatgaggcacctggtgcaggtggagtggctgaggaggggaggcccagccccaggtaccttctctccagtcagagccaccatgtcgaggggcccgtacatgaaccgccccaccaggacctgggggccatcttcagcagcaatcacatcattggcccggtgattagccgtgacattctggaaggacagaaagaagctggctcagcccttgcaagggaggctcaaccttgctttatcattgcagtgttcctcagactggctggaggcatatcagcttgctgaatcatgtctctctactaacttctgctagagtttcagagatgtgttcccagggaacgtgtgagaaaaacagaccgtgagtcccccaaacgctgtcttcaaggtgcacagggcttcctgccattgtacgttttctgctttcgtgttttttgtttgattgattgtttgtttgttttgttttttgttttttgtttttgagaaggagttttgctcttgttgcccaggctggagtgcaatggcgcaatctcggctcaccgcaacctcccgggttcaagcaattctcctgcctcagcctcctgcgtagctgggattacaggcatgcgcctccacacctggctaatgtcatatttttagtagagatggggtttctccgtgttgatcaggctggtctcgaactcccgacctcaggtgatctgcctacctcggactcccaaagtgctgggattataggcatgagccaccgtgcctggcccgttctctgttttgactctgctcggccctgaggggacaactggcctcacagcctgtgcttatcttccagatccccgggctggaaactgcctggtcacttttggttctttcttctacatcacagctcacatccaacagtatttactatctgtctttttttttaagataaaatttcaaatgcacaagcatagagagagagaagagtgtaacaaagcctcgtgttcccagcacctgctccaccacttagcaacaaactcgtggccatcctggtttcgttcttcccttgcccaattccccagcctcggccccagccccaccgggattatcctggagcaatcctggacgctgcgtcattttatctgtgactgtctcaacctccctatttttcttcatttatcaatgaactggtttcagttcattctgcagcctgtgttggccctgaccagcccccactcccagcctggcctccaagaccccagtctctccatctagtgaccactcctttaccgcactggccacatcttcatctctcgcacagccacatcgcctggatgctgctaacagctccctaatggagctccttcctcaaaggcagtccctgcaacagatcctctgtctctataaagcacagctctactaacaccctcccgggctccccactgccctctgcgtagagtccggaacctgagcttagctttccaaggcttgcctgaacgacctcttcagtctgtctcctgctgctccccatccacaccttctggtcctttctgccaggctctgcagcagcctccaggcctttgctcacaccgctgtcccgccccccacactggctctaggtgccatccctggccctggccctcttcccccacattccagcccattcgctatgactagactcagcgccatcatcgccaagaaacactcctcggactcctcaaagacaggttctcaacctcctttcaattcccatgcattttaattcaatccaacaaatatctgcagacacctcatctgcatggggtccctgagataaactagtcgtgggccctgccctggagacactcagccaagtagggaacgcaggcccccttacaggtgcactgtcaggggagagggagcagctggttcatgaatataagcacctgaaaagatccggcatcccgagtcattagagaaatgcaatcaaaaccacaatgaaataccccgtcacacccaccgggatgactagaatcaaacagacagataataacaggggttgctgaagatgcggagaaatcagaatcctcatacattgcagtgggaatgtgaaatggtacagtcactgtggaaaacagtctggcagttccctatatgattaaccatagagttaacatttgatacagaaattgcacttctaggcatctacccgagagaaatgaaaacacaggagaaatgaaaaacacaaaaacttatacatggacgttcatagcagcattattcatagtagccgaaaggtgaaaacaccagcctggccaacatggcgaaactccatctctactaaaaatacaaaaaataaaataaaataaaataattagccgggcatggtggtgaacacctgtaatcccagctacttgggaggctgaggtagaagaatcacttgaaccagggaggggaggttacagtgagttgagattgcaccactgcactccagcctgggcgacagaacaagactccgtctcaaaacaaaaaaaaaaaaccaaaaaaaaaaaacaggtgaaaacaacccaaaaaatgtccatcaggtagtgaatggataagcaaaacgtagcatctccatacaacggaatattattcagcctcagaaaggaatttctgacacagcgaccagttggatgaaccttgaagacagtgcgctaagtgcaagaagccagacacaaatggtcacatattacatcatttcatcgaaatgaaatgtccagaataggcaaatctgcaggcacagaaagtcgattactgattgcctggggcaagtgagggagtgtcagctaaagggtacagagcttctttttggaggttatgaaaaagctctaaaactgaccatggtaatggttgcacacatctgtgaatatactaaaatccactgaattgtactatctaaatgggtaaattatagaatatgtggattttatctcaataaatatgtttaccaaaaaagagttggttcatgaaggattgatctccttctaccttttaggactgttcttggggtccatgtctggtcttttcaccagactggagatgcctaccatagcaatggttgtgtctgtacaaccctgtgctccactctctagcagaatgactgagacagagtaggcactgatgatcgtttgttgagtgaataaataaatctatgcacctcaaactcctattcatccttcaataccccacagaggagcctcttcagagaagccctgaatgatttgcccttacaatccttctttccatctttgtcttaatctgtaccttcctctatcaaatatcacaccaggccatactcaatggtaagtgactgagatccaggactctttctgattcaagtccacatctactgtagcctggcatatagcaattgctccataactggtatctcctcaccaaccctagtgtcttggactcctgccctcagggctcctgtggaaccaggccatgggaagcaactcacacacccttgcagctgcagtgcctgggctccatctgagtgtgagccccagcctgtttgggtgctgagctctgaggacaaattgaagcgcttacctcccatgtggatgccccagcccccgggccagccccacctcccggaggacacagtcccagccacatgcgaactgagcatgcacgcaccctcagcttgacctgagtccgcttacgaagccacttctcccgggggttggcaggactcagtgctgcagggtccaggcgggcgctttccttgatgttcacgctctcatagcgcattacctagccaagagccgagcagggccccggtcaggtcttctggcttctctgcttccctcccagggtgtcagtgcccaccagcttgtggccagctgggccctgcccctgcaaccccccaacctcacagcctggaaccgtcaggaggccgcagaccccgggacctgcattcctgtcctgatagctggggccagagcagtctcccagctggctcccttcctgagagaagtctctgccccgctgtgcccaaacctggcagccacctctatctgtccccactctctgccctccctctgttacaacaaggtggccctttcttaaggccggcttgagtcctgatcccagcccctccttgcttcttgaggacgttgctccagccatgctcccctcccaatcccgcagagctgattagactccctccgctagatcactctccttagcattcaaatacgtgtaatactgcccatcttaaaaaatactctctcagattcctcatgcctctccagtgaccgccacatccctgctgtccctcacagcagcactgacagaggacttagcccatatgctgtcaccccttcctcacctgccccctctcctccacccactccagtcagggttcttctccatcactcctctacggaagccattcttgccactgccccggtgactcccaccccgcctatctcaggggtcctctccctacactctctgggtcctccaacctcagggatgtcctcttctctccttcagtggcttctccttctctccctgggggagctccaggactcatccctgaacttccctctctgtaggagcacccttagtctggcactcatcgccagttgtaaatgccgtccaagctctgatgacacccacatttttatctggaatcctgatgtcttctctaagttccagactcctctactccccttccgtcccagcaactaagaggcagctcacacttcacacacccagacagtcgtggatgtgccacgtggggcacaggtttgggctggagcaccctggcctgggtgccaccgggctggggacccacccccagcccagcacactctctcccacccccaagaacctacaaacaaaactcactttcctccgccccctgcccagccctgctcttccgcacgtgcaggacacagaaccaccttagtcactcaagtgggaaacaggacgtactgggctcccgtctttctcctacaacgcagacagccacaagcgctctcaccgtaatgcaaatcttgccactctgtggcacctccaccccctgtcctactccaagcctcctctctaagttgggcccctgcactggcctcacaagaggcctcatggttcctctcctgccgtgaaaacagcagcctcagcctcagggtttccttcaaaaaacacaagccagttgctatttcttccttgctcacagccctgcaatggcttcccgttgaacccaatataaaaccatacccctgaccttggccatcacggctgttcatgaacatcatgacccctaccagctccccagactccctccccaccaggctctccttctggcgccggcctttctgctataccttctgttttgcagacgaggacattgagactcagtggggagtgggaactgactactccagtctccaagttgaaacactgggacactctcctgcgtagtttatatttaattttctagagtgtaccatgccgtcagccacccaggagccaatgtctttatgaagcccattctctggtcatgtcactccccactcacgtaggtgctccaatgccttcctcatgctcttaggatcaaggccaaaagctgaacagtgtctgcaagaatagcctcctctccagctggagaaggggcggtacccccttggggtggctgtgggcaggcccgcgactgcggcagcagtacctgtctcaggatgaaggccaccacgtctgtggactcccagtaactggcgtggaagaggtggggcagggccacggtggggaaggccgtgaggacatcagggcagtacagggcatagtcgatcctcttgcttccccaccacttggctgtgactgtgggtcggagaggaaggtgaggatgcgtggccggcccggggcctcacccgaggggcagcggggtctcccattgcacagactggtggtggatgccccacgtggggcacgggtttgggcgggagcaccctggcctggaggaggcctggggaacgcgctgctcttcctccttccttctcaaaacccaccagccctcccctaagatgtgcgtgccaagcccatgcccaggaaggagggccagacccacagagacgtccacagtctcacccagggccgccgctcagtggcagttcccagtgggctctgcctgaagttggcgctgagtctatgtctggaaggttcagcacttccttaatggtcagaggtcagagccctgtccagggtcaaaggtcagggctctgtttgaggtcaaagctcagaccctgtcagggatcaggggtcactgctctcctcaaggtcagagctctgatttgaggcagggtcagagttcagggctctgtccagggtcagaggtcaaggttcctccaaggtcagagctcagtttggggccagagtgaggatctggaccgatgccaggtctccatcagcagacgcccagctctctaaaggcagaagcaagcccccaggacttccttcaccttctccctatcccagggcctgccctcagcagctctagcagtggcccagcaaacacccagaggaaggttcccctcccccgaatccaggcagggccccaaaaggacctcactcactgcgggaggcacccacgggtgccatgctgtccgaggactccgagctctcgctgtgggagctcccctcgctcatcctccgtcctgggcgctggaacctcgaggcctgagggggcgaggcaggggcatccagaagtggcgggctgtcccgggagctgccctccaggaagagggggctgtgggtgtgtagggcatcagctggagggggaatttcaaggtcaggctgagtcacgtgtctccagcagagctgcccactcagtgccagccccatgctgggagggaggctgggcacttggaggagtcagccccggctctgctcacttgccagcccagcaggcacctgcccctctcactgtgcccaccccaccagtcccctgggcctgaagggaccccgctgccaccgcatattgccgcatttacctccttgcagctgtgagttatgcagacacaagctggagtcccagccatcacccctacctccaataaagctgcagagggagcctctgggacgttgccccaaaagcaccagctgaggtcccaggagtgactcatagccatatcctctcttatccaactcctcccctgcgccacaaagaattgaggctgcctctggaagggaatggggactccagcctgagagctaggatagcctcaggggagggaggggagtcccctgaccaaagagggatccatgggggagggaggtttccagcctagccgacctattgaagctccaggcaggcagggatttggaaataaaggctccattgaattaggggtgaggaagggatggtttttaatcctgaatcggccccatgcacaactcccccatccctgacgcaaacctctgagcaggcttaggctaaatttcctcaagtagggcgtggagccaaggctccgatttccaagctgctgactgtccattacaggtctcccatcgacgatacactcggtccatgcccggttcaccccacttgaccctggaggccactggctcttcgccaaaacacctgccctcgctcctgctgttctccctgcctggaagatctcaaccctcatcctctagctcttctccacctgcccaaatgcacctcccctctctggaccctaatcaaaggccacctcttccatgaagcccaccaggatggcacactctctgccctaccccttcagagtccaggctgggcactcataaaaaaaatagattggagcacggatccctggacccgccatcagctctgaaagctcaagtttacaccagccctggccacaggagtgtgtccgggagcctgttgggggcctctgagccccaagatgcctcagacaagcaggtgcttagcacaggtgggcgactctgaagacagaggagtcggctaaccttctgttctcacagcccctgctcaggtgagtcaccctactcactgagagcttggaggggttgaatgggctggggccccacctccagctcagcacactctctcccacccccaagaacctaccgaggaggagggactgcccatcgcccagtgggaacctctggtagcgaggcacgctgacaggcggcaccaggtggaacttgggctccagcagtggctcgagccgtgaggcagaggggtctgcgcaatggaagaagctgtagacctggctgcaggcaggacgcacctggaagcctggggtgagtgggaagacagagggaagccactttctagtacctgctccctgggccctaggaggctccctggaatgcagcctggagtagcctactcccctctcaagagcctccccgggctccctgctccccacgggaacaaagccattacgttcagtttgtctccccacccaggagcgcagtgacaggcacccagcactgcagccgtgctgcacagctgcccttccccaatcaggcttgcagctttcctttctctgagcctttgctcaaaacatcccttctccttgtgggccctccctcccccatttccacggggcaactcctttagattcttccagttttcactcagttaccacctgacctaggaagccaacccaggttccttcaggcaggtcagctgccccttccacaggcctcaaggctataaacactcagttcccaggcctgctgctagagttccaggtttgccagagctggtggaacacttctctcgctgaccagcaggtgtctccactgaggcatccacctcatcggcgggcctccctgtcctcctagaacagggactggaccgtccagcatccagggagccctagggttcattagcgacactgagggcagccatggggttctgcctcctcgcctccatttctaccacccactttatctgttccatactgtagcttgtcagtaagctttggccaaaagcatggatctgtggatacccaaggtgccctgcagcctcagacggtctgtacttctgtccttaagagtcacagataccctccccacccctcatgcctgctggtgccaatcgcctggtgtgtacattttagaggagcaggaaaaggcattcgaggttgcaggtattagccgggcacggtggttcacgcctgtaatcccagcaatttgggaggccaaggcgggtggatcacttgaggtcaggagttcgagaccagcctggccaacatggtgaaactccatctctaccaaaaatacaaaaattagctgggcgtcatggtgggtgcctgtacttcaagctactcgggaggctgaggcaggaaaattggtttaacccgggaggcagaggttgcagtgagctgagatcgcgccactgcactccagcctgggtgacagagtgagactccatctcaaaaaaaaaaaaaaaaaaaaaggttgcaggtattgcatgagcaaaggcacctgaggtgggcttggggatatgcgggggtgggtggtgagaccaacctggcagtcgtatctgcctcagtacaggagaaggagagggtgggaggcaagaggttgaatattctgtcttctcttccccatagggcgtgaccaccggacaatgaggccacaaagcagccaggggcacttgacatggagagtgaaatccatctgaagctgcctcaccttcgccctgtgtcaggagggaagctgctcctctctccctcctcttccccaccctctctcctctctttccacctatcccaactctgtgaccctccctgcccctgtccccgacttcactctcctcattctgaggccctgacacggtggccctagtgacgcacaggcacctcaggccccagcccacaccatccctaccgtccagcccaggcagcaccgtcctccgcatggccaggaccaggcccagtggcgagccgaagaggaagaagtcggacacatcgaagtcaaagcggcccaggctgacctcagggagctgcggccccccagccgccggggtctcagactcatcctttagcacgctggagtggatgctgcggagggaggaggacgcagggcagggcaggtcagggaaggaccgagaatgcgggagtgttcacacagcagcgcagcctgaattctgagcgtgaagtgcccaaccctccatctctggggcggggctgagagtccaccggctgcacaccacctacagtcagcactggccaccaaggcctggctgatatttggctagaaaaggaatcaacaaactttttctgcaaagggccagagagtcaatatttcagacgacatggaccgtgtggtctccattgcatctagttaactctgccattgcagcataaaagcgcccatggacagtgattaaatatgcatggctgggatccaatcaaatgttacttacaaaaacaggctgagcacctggggcgcctgagcatcctacacactggcaggcctgcctcgtcatgctggctttgtgttggccacactgaggattcctgcactgtgtaccagacaagcccagcctgcccaacactcagctggctaacgtcagttctgttctgctgggatcagggctttcatcgtaattcctgttccaggcaacccgcagacacagatgcaaacagcttggtctccccacccccagccccagcccacagatgaagcagagcttaaggagaaaaatgtgagacacacagaattccaaccatttccaacccaggtgcccactgtcccgggaagaatccaagttacgttcagccacagacccagagtaggacgctgagaatcagaaggaaacctgggcacctccctgaccttccagctagccattagctgcagcttagagtgaatcgattaactgaatgcaaagcaactaaactacttgagtcagaggagaacaaactttagaaagagctattgaaatcatgtggacaagtgccccaccctcaggagtgagcgagtctgcaaagttgaatcctcagtctccgcactccctcctgcctcttgcagtgtgagcatctcacagtgagatgatgactctgatgtttaacaatacatatttcatgtacagcgtggtccctaaacacatgccaactacttaattgccaaagaaaccaccatctgtccctacaccagaggggaaagctggctgtgtcagaccagctcctggaagcctccaacttctcatcactctccaaatttggggctctcctaaaggatttttcaaggatgagccaggactgttgagatttttcaccttgcaagcctcactagaaggtagctgcttttctaaaggatcatctgtcagcggggctttaaacattcagagatttaaatgtgcagagtctttgacctaataattcttcctccaggaatccatccaaatataatcaccctaatatatacattaacgtttatgcacaaagatgttcactgtagggctatttatactgctaaggaattggaaacagccaaaatgcctaattatagggattaagtaaactgatatccattcattcgacattatattgccattaagaatatttatcaagtatttttaattatatcaggaaaagatcacaatataaagggtttttttaaaataaaacgatcttaaaagcatgtagaaggaaacagtctctatgttaacaatgagactgttggctccctctgggtggtgagatgattatcttccaaatgttgtaatgacctcatgatacttatcacttgggtaaggaggaaggagaaaggaaggaagaagagagctgaggagcagaggaaaaagaaagagacattccttccaatttgggtccaagttcaattaacgtgtaagctgaattaatgtgcagataatgtgtttagcccacattgattaacatgtctcttctagaaagttaaagggcaaacagttctgtagaggagcctgcctggcccataaacaaaagtgtgttggattagatacatgaacttgggatagggagaccagaatgatgatcccagctcttccgtcactggctgcatgacctctagaaagttcctgacctacttgaccctctctttccctatgagaaatgataacaacacacacctcgggtgactcacaaaacacagtcacagcaattactccgccaggttcttaaaaccatgcagtgaagtaggctgggcagcattatctttttgcagaagaaaagccgaggctcagaaaaggacgactgttcccagtctctctgcaagtcagagcagggcagggacagggaaccaggttccagagtctcagtacagggctgccgacgagtggctgtggtccctcagtacagggccgatggcgagtggccttggtcccagcatttcagtgcttatctatgggcccccatggaagggcctgggacatctgactggtcacagccctcccagttggctctgagccaaggtcttcttgcttctggacagggaggggctaccttgagaggaaggcatggtgctgggtgatggcctcgcagtcataggtggaggagtcgctctgtttccgcggcaacggcctcttgggctcctcatcctccaacccactggagatgtcaatgttgcttttgctgagacgcttgctgctggccaggctgcaatcttcctccaccgcgactggggtgtcctttgggaccgaacaggggacaggagagaaaaagactgttgtcacgggagactctggggccttgtctcctccccccaagcacaaaccaaccccttcatcctaagatgtgaggggctacccttcttccaaaagacacaggaagccacattgcaatcatggtaggattttaggcacaggctctctcccgcatccaccgggattgacattcccactgggatgctggatggctgtcgaaggggccaaatccagctctccaggcctcagtttccacacctgtcataataatcccctgctactcttgtagaattatgatacacttcttcttcttcttcttcttttttttcctttttgaaacagagtctccctctgtcacacaggctggagtgcagtggtgcgatcttggctcactgcaaactccacctcctgggttcaagtgattctcgtgcctcagcctcccaagtagctgggattacaggcacccaccaccatgcccggctaatttttgtatttttagtagagatgggatttcaccatgttggccaggctagtctcaaactcctgacctcaggtgatctgcccacctcggcctcccaaagtgctgggattacaggcatgagccactgcgcccagctggattatgatacacttctttgtgacctggatgtcatggtgccaacgtgaagaaccagcactctctccccgaggggcaggccctgctcctatgggcatacccctcccgcggtcctgtcccccggctgtacctgggtgctgctgatgctccccttccggctgctgctggcagggctgtcccctgagggccccgcactgtagcagatggcatcgaaggccaggaggccccccacacagtccccgatgagacacacctggaagagatgcagctgggactgcaggcctgcccactgctgacccctcacccccacacccggccagagcagtgctgcctccccacaggagaatgagaaactcgtccttgggaggtgttgagagagcccaactgggaagcagtgtgcaaactggggagggtcagggttggcgttggcccaggccagcccaaggacggggagtaggctactctcaggggtcagacttgggctagagagcagcatgggctcagaatcagaactcagactgttggcctctgtttttctatctgtaaaatgagggctaactcagagatctcaaaagccacctttgggctcagaggctgattcgagaacagcctggccttggccctttcagtagattccagcctctctcccaggccggggccggaacaggggaggggagaggaggagagggcaggctgtcctacctgcccactgaagccaatcccatcagaggacttcaggaactctctgtagacctggttggctcgctcgatgacggtggcgacagcatcctggtactgcggggaggagatggccaacaggggaagggcggccagagggacgtggtcctggctgctgctgaggcagccctcatcgtggctgtaggggttcaggctgcagacagggggcccaaggtgagcccagccaggatcgggcaggttggcaggtttggggctgaggatcaggcagaagagagcacatactggccaggaattgggctccagggacccttcaggaagacccaggcaggagcctggtgacacagagcacaggcagtgtggggaggagaggggaagaggattcaagcctacactgactccctgtgtgtccttcccgtgctggccatgggtgtgggccctggggtccctgtgactgcagtctctattgccctcttctgcatggccccaaagggcaccccaatcatagaggaagaagtcagctgaggacccagctagtgtggaacatgtaggaacatatcatcatggcagacttcctggaggaggtggggcttgaactaggcctcaagaaaggctttggagaagctgggaaaggaggagagaggacatgccaggcttggggttcacatgttggccacagcttggagctgggcacatagctgcagacatgatgttgtgttcattgcatcactgggagaagatcagagctttcatcagctttgcagaaagttctgtgacccccgagggggctgaaagcctgccccacagtgtccagccagcagactgtccagactttgcattggcaccctcaactccctaccttcccactaggaaatcccctcctctctgggcagctcagactcacctgagaccagtgcctccaagtcacctacccctccctctgcccccatctctgcttctgttccctggggcttccgacccagatgcactgttggacctggctggtcaggaaggaccatacagggaggctgggaactctccacccctgcccagagcctgcccttcccccttagctcaagctcaggctgatggagcccagtgcacatcccactgggactcgacagaatctggggcaggtgacagggctggagcactctcagcaggtggcagagtcctcgtggtgtacaaggctggccctgtcagccattcctcatctccaaagaacacaaattagaggaagcaggcctcgattgcagccggagagattttaattagctgagaaagagctccctcccagccgtgattatggggtgatgaatggccctggcaaggagctgcctgggggagaactaagctccctcccgctggccccatgaatgaatggccaggccatccgtcttcctggagataggggtgacccagctctggaggtcagatgtcctggggacaggtagaggggttcctgagacggatgatgaactagcacagtgaagtcctggactatcagagtgacaagggaacatgctgcgccaccagttcagcagtgagcaggtgtcaaagatgcagattccggggcacctccctcctgaatcagccactgctggagggaggcctggacatctcgcagtttaacaagaatcacaccagggatttgggcaattagccaggttgcggaattacagacctaatcttccttccttccaactctgattgagatctgcctgcaattcctgttggtgtccaaggaacgcagataaatcagagtctctgactttcccccaatctagagggggaaaaggaaggcccagggaagggaaggggcttgcccgtgctctctcctgactggctggaagctccagggcaggggactttggccctccccgcactgagccctcctcagagccacaattggctgagaacatcggctcccattctcctggggaattcggagtgcggtgcgccccacacacctggcaccctgctggggacctcttcccacccttcccagctccggagccccggggtatgagggctctgcctgagggctgggctctgcagcagccccaagtctctggcgaggtcctgtgagggggacaggcagaacagaggtgcagaggcctccctcctgcccctgactgaaagttccaaagcttccagctgccagccccagtgatctgccgaatgcctataggatttgggccctgtaggcgtttgggtcatttttgcacatatgactgctgagaacccaggtatccacccggccccaggcacctacctttagctagttcaacaggataggcaggaggggagcactgcagccctcagtgcctggagcagtgggtggagctcccagaggccccataccctggaggtcccctcagtttgtcccccacaggtgccagggcccacagtgggcaaggatgtgccagcgtcagcagtgagcaagctgcccagcgctcaaccagcccttctgtggacacatccttccctcctttctccccaccagctgggttccctgctgcgagttggaagtctctctccccagcccactctccacctgcagagagagcccctcttccagccaggaggaagatgatgtgagtcatggccagcatccccgaagctggcatccccacagttagtatccccaaggctggcatccccatggctagtatctccaagactagtatccccaaggctggcatccctatggctagtatctccaaggttggcatccccatagctagtatccctgaggctagtatccccatggctagatccccacagctggcatccccaaggctggcatccccaaggtcagcatccccaaggctggcattcccaaggctggcatccctatgtgctttctacattctggacactgtgttgagtgcttcacacacattagcacacagactcttcacagccaccctgagaggttatttactatggctaccttcattgtacagattaggaaattgagacaaggagaagttaaacaccttccccagaccacacagccaggactcaaatccaggcggcctgagagcccacacacttagccgtggtatgcaaacccaaaagtcactcctccaggaagtcctctctggcctttctcagagagcccacagtgccctgtgctctgtgatattatgctccatcagagcactgtgatattatgaggtagatagatcagatgatagatagatagatagatagatagatagatagatagatagataatggatggacagatggatggatggatggacggatggatggatgaatagatagataaacagaatagaatgatagagagagagagagagagagagagagagagagagagagagagagagaatacatagataggttttgtccacagttcctggctcccatagccgttgttataatgttggggcacttagccctaggaaaacagaacctctctctctctctctctctctctctctctctctctctctctctctctctgtctgtctctctctctctctctctctctctgtctctctctctctctctctctgacattctcctgccctccttgagctggctgtgaagaaattctctgatctccgttgtctgatttaggtcatgagaccctcatttcagaaggagtcctgccccatacccaggaggaaggaatgctgcagaggccaagaagaatctgagcagacaggccctgttgggtttcccgacttggtctgagtgtcagcccctttctgtccaaccacatatctatgttgtcaatcatgcctagccaatgacacctccattaaagggccaaaaggacaggagagcttccggagagctgaacgcgtggaggttcctagtggctggcacacctagggaagctccgtgccccttcccccatacctcaccttatgcatctcttcatctgtaacctttataataaaccagtaaatgtgattcagcattttcctgagttctgtgagccgatctagcaattaattgaacccagtgacagggttgtgagaaccccagcttgaagctgggctgtcagcagcacagataaaacaaactggggcatggtatcggtgtcagaagtttggggcagtcttgtgggaccaagctctcaccccgtgggatctgatgctatctccaggtagacagaggcagaattgaattggagggcacccagctggtgtccacagcagaactgattgcttggtgtgtatggaaacagcccctcacatgtggcccggaagtcttctgtgttgactgttatggtgtgagagcaaaggaaaaacaccattcgtgtttttcagattcctacttggctgcaatcgtgtggccgagtttgactcctgtctccatgggctgggcgaccctgggggaaactagctaaactctcaacactccgtgtctttttttttttttgagacagagtctcactctgtctcccaggctggagtgcagtggtgcaatctcggtttactgcaagctccgcctcctgggttcatgccattctcctgcctcagcctcccaagaagctgggactgcaggcgcccgccacctcacctggctaattttttatatttgtagtagagacagggtttcaccatattagccaggatggtcttgatcttctgacctcatgatccgcccacctcagcctcccaaagtgctgggattacaggcgtgagccaccgcacccggccaacactcagtgtctttatctgggccaaacagatcaggcttgttgaacactggaagtggatcaagatttcatggggaccccagcacacccaggcccaggcagaggactcttcccacaccttccaccagggatgcttgtgtttcgtcacgatctgacaccccagagagtccttgcaggtacccacctgcccacggggtccatgctgcagggggagcccctccacttagttcccccaccaaccccaaccagttcaaacaagcagaaatggactcactgagagacaagcgagaaagcctcagagcagatggcaggacaggggacgaacttgatgaggatgtggcccagggcagcagggaaatgggctcgtgtgaccttctccagcacggagctgaaggtgtggatgtcggctgccttgcaggacgggtccccggcacccgtgtccaggatgtttcccccatgcaggaccagcaggaggacatgtgtcttgcaggagcgctgcgggcagccttcctgagagccaaggcggttggaatacagagagagaggcggctggggtcgggggaggcacacagggacacacacacacatgtgcgcatacacacacactcacacacacgcacacacggggagactgaggccagagaagcaggcactatgtccagcctgtctcagctgcaatctgaggagcagtctcagctctaatacaccctgctgtgtgatagaacctctggtgcattcagagtgagggaaggacatgggctgccaggagggatgtcagggcaggaagagtcccaagagatgcttcctgttcatatgggaacccaaagcccagagaaggacacagacccacccagggtcacacagcaagtcagacgaagagctggaagaaaacgaggccgcctatgatccgagggctcttgctaaaatcctggcctctgagttgagcccagacaccctccgaagcccagcctacctcgctgtcttcgtggatctcgatgcttccctgggctgggaacctctgtcttctcaaggaaacccggtacagttctcctgcagagggaaagaggggagctcagcatctccaggcttccctacagtgaccagacactccctgggcccagctggccctaaaggtgagaccttggcttacatcacaggtgagctcaagttagagtctggagctagggagagtcaccccatccaggccctgcctctgaaaccaacacaacatgaaaccctttctcctcataaggaaaagggagggtggcagagtgaggccatcgcggatggtgctcctgaaaggaggggcttcctcgaaaggaactagcctgcgtttcttcaccaggacagcagcaagggtgagtaccacctgaggacttccacttccagttatggacagcgatttgagcaaagcctcccgctgagaacaactagaagagctggtgtgatggcaaagcgtacgcacccactcttgactgggctgagaggtgcccagagagctggtaaaacatgttctctgggtctacctgtgaggtgttttgggaagaggttggcatttgaagcagtgaatgaggcgatctgccctcaccaaggcaggtgggcaccgtgcagtccgtgagggtctgagcagaacaaagtgctgcagggagggaggattcactcttctcaagctcagacttccatctcctgcctcacacatcagcactcccgcttctccggccttaggacttgaactgggattcgtgccattttctcccccggttctctggcctttgggcttgggctggaactacaccacaggctttcctgggcctcccgacttccagacagcaggtcagggaacctctcagcctccatcatcacgaaaccatgcacgaaagccagtccctcataataagtctctttttaattttcttttcttttttttttttttttgatggagtttcactcttgttgcccaggctggagtgcaatggtgcaatctcggctcactgcaacctccgcttcccgggttcaagtgattctcctgcctcagcctcccgagtagctgggattacaggtgtgtgccaccacacctggctaattttgtattttttgtagagacggggtttctccatgttgctcaggctggtctcaaactcctgacctcaagtgatccgcccacctcggcctcccaaagtgctgggattacaggagtgagccaccatgcctggccaataagtctctttttatacatctgtgtatatatcctttcggtcggtttctccgcagaaccctaatatggctggatacatacttaaaaaaaaaatatctgtttgaagttaacagagaaataatagaggcttgaattacgggaccactttccagggaaggtagactcccagagagttaaggtcggcatttgaaacattactggcattgcccatgagctttagggtaaagctggcctttgccagaaatctctccttgctcctctcagcagcctgggctcaacgcctcctccttcaagaagtccttcttggctcccagccctccctgagctctcatttacctaacacagaattcagtaaaccacagccatggaccaaatctgccccactgcctgtttttgtaaataaagttttattggaacacactcaggctccttcatttacatattgtctatggcaggcggcttttgtgctacagcagcagagcagttgcagcagacaccttacagctcacaaagctgaaaatatttattatctggccctttccagaaatgtctgtcaacccctgatctaacacctacactcctgaatgtgatgacactggactcctgggtggagagacttcaaaggcatccaacagccacccctgagcccccacccaaatgatacctgcactctgaggcctccttcctgccaccaggctgccttcagctcctctccttcctcccccatgagatggatgctacctcccgtgtgtggctaaaacctacagccaagctgaaccacctgtttgtcttcagggaggaggaactggctcatctcttaaagtcgtaggttctagatgaagatggtccttgccttcttcacaccccacccccaccagagcctgctgctcccctctaggagtcacatctggggagggtccttccaggggctttgcgggcaaccctaggcaccctgtcaacatcccctcaccatgaccagccccaggggagggtacctctacaaagaactgcaaatgagaagcttttctcagcagggaagagcatttctgaaatattctgtcctcacagacacaatcccagtcaaagggtaactgctttatgagctccgagctactgcccacacagacaggaaatcatttcctaaatgatggaggaagagggaaaactcgtcctggggcccggctgtgcccagcacttcctagttcttcccattggctaggctctcctgcctaatttctaacttactaaagaccttgccttgggcttggctagaggagaccctggctctctcttcaggacaggatgataacacaagacaacagtaacagctcagctttgttaagcacttattatgtcctgggcactatgtgctttacatgattcatcctctctagtccccacaattactctctgagtctgaatgatcttgttattagccccattttacagatgagcaaaccaaggctcaatcaacctatgtcacttgccccacgtaccttaaaggttaaagcccaggtctgccgctgccaggcccctttccaccacgtgaactagtaccaggagggagagggtctgagtgtggcttccctgagacaaagcgctcatgcttcatggtgtgtgcggctgtgtgtgcggctctggggcaggctgtgagtcaagaagaaccaggagtgatggcagggctgaggttggctctagggctgggaggagcgtggttaaagccacggaccctggatccagaacgcctgagttcacatcttggctcttatcagctgtgtgacctgtgtctcagtttcttcatctggaatatggggataataaaagcagctaccccatggggtggtggtgaggatagatgagttcatatgcataaagggcttagagcagggtgtggaacacaggaagtgtcacatgggttagcggctattgttattattatcattatccaggggacatccagggcacagagccaggaccacagctgacaagatgggctgatggggacattgccgcctccacacttgcctgccctggtgccaagtccctccctgagccctggcatgctcctcggccttgctgggctgggcgcctgtttgcagtgtgattacaggattaaatgctgtgattgccacaaattactatggcaaggctataaatacattgcagggaagacatgagggtcctgttgtctcctgggcacgatgccctctgttaggtgggggctggactctgcgccctcacccattacaaaggccaaggagcacctccatctttgatctgtctggagccagctccctcgcgacccatgtgatgctctgggcatcaaatcggtggatgactgctgcatcctggccaccaacgatgttgaggccgtgcctggttccgtggggatgggagcctcaggccagagactgggcaggattgtcctcagtatccctcactcctccctagcaggaggaaagagtctcacctcctacgctgtttggggacagagccttgcttcctttccatgcacaaaagccaggaatgctttgctctgggagatggaggaagggagatctagcctgccagattcagattctggccccttgagagttgactaacaggaccagagcttccccacagaaaggcacacctcccgtcttcatcttagcagaggcccctgtagacaagcaggggcagccgtaggctaccttccctgtaccttccccacaggtctctgctcttctaaaagccagacattcctaccatgataattggggccattggctctgactcacccacaagacataactctttcactcgtccttgcctttgctcatgctgagccctctgcctgcaagcccttcctccctttgcagactggcaaactcctacttgtcctgcaaaaccctgctcaatggctatcacctctagaaagccgtctttgatctatctaggcaaagatggctatcccatagtatgcggcactggtcctggcttactcgtctatttccccatcagactgtgggccccttgagaatagagtttaccagttttcagggactaggatggcacttttgtgaaaaccttttggaagatcccaggatgcacacatcctgtgagacatctctgtgccattaaacccccaggagaaatcaggttcagggaagcatcatccactgagaagcacgttgcttcaaagtactcacaggaactggtacctgggaacctctggggattctagaagagtctggcctgggcttcataattccacccctagaggcttcctcagggactctggtgacaagagcagctggcagggggtcctaaggggtggagagccacataaaggggaccccaggacctcatcattaggctgcctgtttcttcccacttcctgttaatttctgtttgcatgtccctattcaggctgggtccctgcagtgcccagatttggggtgggggagcccacagctgtttttgtgacagtgttttttgacaggctttgagacaggccagctaccgcagtgccagctcccagtgccccactagctccacatcaggagaggtggtccacccagctcaccatggctgctcttgatgcctgaagaatggagcctatgtttgcttaatcacagccttggagaggtacaaatcgtgatcatcccctctaattaccaatgcgccacactgctcttgagacgaaagccaaggtcatcacccacacactcagcaccccaagcaaagcatcaccccagctcggctggagagcatagctgtctccctctctcttgctaccaacctctggggtccacaggggtggatgctgagggcccactggctaaagccaaacactcagtctcctcctccatccttggcagtcactcccaccccccgttagtcacccctggcatcaaccaagcagagctgggcccagcttgagaccatgtggcacatcctgagaagtagctacaaaagtatctaatcctctgtaagctagtggaagctcatacatgggtggaaacataaggtttttttttattttttttttgcctaaaccggcccaggtcaccaggccagggctcttcatcatcctgaaggaggggagtaagaaagggatggtctctttgttcttactaatgcctccacccctcagccctgcctcctcagagagactcttggcagggaggaaaaagtgaggagaggctactatgaggagcaggaacttcttagactgttaggccctttcagtcaagctcattccccatttaaaaagacgttacttgccggggaccgtggctcacgcctgtagtcccagcactttgggggaccaaggcaggcagatcacgaggtcaggagttcgagaccagcctggccaacatggtgaaaccccatctctactaaaaatacaaaaattagctgggcatggtggtgcgcacctgtaatcccagctactcgggaggctgaggcagaagaatcgcttgaacccggcaggcagaggttgcagtgagccgagatcacaccactgcactccagcctggcgacagacagagcgagactccatctcaaaaaaaaaaataaaaagacatgttatgctctgaggatcccctgtcaagtccaccctggccctgcctggaagtcaaaggctttgctattttgctgtgatgtgggattcatccatatacctagatgacatctgggaagaactacagcctcattcagtagcacctgggggactcaatccacagcccccattccccaggtgagcccgcatgacacacacatgcagaaagaaggggacacacacagacttacaggggagacaggccctggatagagtcctcggatgggaaactaaccctctactcagagggtgacctcagacacgctctgcaaaccaccgcaaaaggaggggtttgcctacattccccggtaagagtcaggcagtctgagattctatgagtccaagcataagtgccctctgtgagtgctagcctccagacccagcagaatttggcactaggaccttgaaggggacccagagtcacaatgatggagtcactctgagaggctatggagaaaggaagagcaaccaaaaagctgcaggcggcaaatttcactttgcttttcaaagtggttgattccagctaggggcttggcgttgattcctaggcaagtcctggggcaaattaataaacaaacgctttgaggacccttagaaaaggaagcagtggggccgggcgcagtggctcatgcctataatcccagtactttgggaggctgaggtgggcagatcagttgagctcaggagttcgagaccagcccggccaacctggtgaaaccctgtctactaaaaatacaaaaattagacaggcgtggtggtgggcacgtatttagctgtaatcctagctacctgggagactgaggcaggagaatcacttaaacctgggaggcgggggttgcagtgagccgagatggccccactgcactccagcctaggagacagagcaagactctgtcaccaaaaaaaaaaaagaaagaaagggaaggggaggggaggggagggaaggggaggaaaggggaggggaggagaggaaaggggaggggaggagaggaaaggggagggggaggggaggaaaggggaggggaagggaagggaggggaggggaggggaggcgaggggaggggaggggagcagtggctcccagagctctgataggtactcttggaaccagctcgctaaccctgcatcatagcatgtggcatagatagggtcgctggaccagcagctcaagggaatgccaagggcttaggggcatctggggaggggaacacactggcagaataagaaactatctaaggaacccatagctctcaccacttgagctcaaggaatgtgggctcatgaatgggaacctgcggccacacaagatgtggggaccaacagccagtagcagatgcggatggaacagcgtgaagctgttctgaaggttttaaaacttttttaaaaacaggggaaatttttagccaatgaaagttcccttaggagcccaatttgcaaagatgaaagtggatcggctctggctgaagcaggctggggggcccagagcccaccttcctcactccagcacatccctgtccctaggcagctcctgagggcttcaagagactgaaacttaaaagccactgagcttgttcagcagccagactgcaggccaccctcctctgcaggttcccagctcctagcattgcagaaaaggaaaaatgacaatctaaataatggtgggggaggtgggggaagaagcttggggcctcatattagaaggaaacacactaaaatgtttacagtggttttctctagatgctgggacaatggaatatatatatatatatatataataaagaattaattaagaattaagatcctgtgtttgggttaaaaatgaactagaggggctaggcgccatggctcacaactgtaatatatatatatatatattttactttctactttcatctattttccaatttttctctaaggagtccatatttcttttagtttaaaactatttatgaatgtttattggatagataatacaagtatgtgtcatgtttatgcaaggaactttttttttttttttttgagacagagtctcactctgtcaccaggctggagtgcagtggcgcaatctgggctcactgcaacctccacctcccgggttccagcaattctcttgcctcagcctcctcagtagctgggactacaggcgcccccccaccatgcccagctaatttttgtatttttagtaaagacggggcttcaccatgttggccaggatggtctcgatctcttgaccttgtgatctgcccacctcagcctcccaaagtgctgggtttacagacatgagccactgtgcccagcctatgcaagaacattttaaaaccagccacaacctcctattttagtcaatacaaacactacaaagaaaaaagtgtgaaatgttgtcctcccctcaggagctgacaggctaatgagggagtataaaaggataagaaatgcttgtggaaggaaagaataaatgtggaacatgatgagtgaattaagatcctgtgtttgggttaaaaatgaactcgaggctaggcgccatggctcacacctataatcccagcactttgggaggccaaggtgggtggatcagttgaggtcaggagttcaagaccagcctggccaacatggtgaaaccccgtctctactaaaaatacaaaaattagttgggcatggtggcgggtgcctgtaatcccagctacttgggaggctgaggcaggaggattgcttgaactcggcaggtggaggttgcagtgaacagagatcctgctgttgcactccatcctgggcaataagagtgaaaccctatctcaaaaaataaaataataaaataaaataaaaataaagtaagccttccaaggacttaaaaaaaaaaaacaatgaactcaataccacttgcctattcccaccctattggttattgcccaaacttgtgtcaaggctgaaaacaccaagaccaatcagacacagcatctgccttcaaagatctctcaagcccctgggatcacatgaccaagagtaggtcatgtgaccaaggtcgggtcaatgacaaagacctaggtcatgtgcccaagatcagtcacatgaccaaaggctacaaacagcttgagtcagggtagtggggctgccacagttacttctcaacctctaaggctgcacaaaccagagatctcagttcaaaatgagagggagacatccctgccctgcccctgcagctcaggccctgctgagggtatgtctgatgcccaataacagagcaggaaagctatagaaaggggctcaggaggttgagagacccagcctggagaagagcagcagctgcctgcaaatctatgctgagcctcgtgtgggtcaagggagcagagggcaaagccaggacaaataagggttggggtggtttctggagagccattccaagttttagcacaacctaggaaatgtttacaacagttcaagagtgacctgtgctgacctgcaagcaggctgttctccttcactgaggttagacaagcaagttatataagtgaccacgtagcagggtgctggggagggaagtttcatccagagtctgggggagctggtggctgaggtccctccatgactccttaacgctttcagggtcagaatctaatcacgtccacctggattcatctgactaaccaggctaaggtgatgtgttcaaaccttcaacggcccagtgagcctttcacagagacactaccccagaccagggcctggcccttgcgagggcctatgccctaaaccctgccccttgagaacatgttgttagataccccaagtgaacacggggttagttcggaggaacagttctcatgggggatcccagttcagatcagaggtgccatcctgaatcgggcccagtgaaatttccaggtatacaaccatgagaaaactctgccaccacgacacagggatgctagagggacatgaaatcccaaaccctggtgttcccctacagactcctttgcaacaaacacagccctaagactggtcctgagtttctagtcctcatccggtgtctcaggcaatcttcacattcatcctgtgaggtcaggagtactctccccatcttaaagatgagaaaaccaaggattggaaaggtaaagtgatttctctcaagatgtaagtggagggctgggtacttgaacccaggtcaccaggtcagggctcttcatcgtcctgaaggaggggagtaagaaaggaatggtctctttgctcttactaatcccttcacgccacagccctgcctcctcagggagactcttggcagggaagaaagagtgggaagaggctactcatagcaggaacttcttaggctgttagcctgaccccctaatgatcccctgtcaagtccaccctggccctgcctggaacagcacatacacaaaggaatgcagtggcacactccagcccatgcgcacctgcacagtaacccctgccaagtgtgtgcggcatccagcacagggcctaggaatggctctcacacataggaaaaaggtgctcaaccttagaaccctaaactagaggaaggctcattgaaattaccctaagacaacttttttttttccacctgtcagactggcagttgtgacacactatgggccagggtgtggaaaaacgatctcttcattcattgctggtgagagtaaacatcagtatagcctctgtgaagggccatttggcaatgtcattcaacatgcaaaatgcctttgacccagcaattccaagcccatgtgcaaaaggacatatgtacagtgctaaccattgccacattgcttttacaacagcaaaagacaggaagcacctatatgtccaccagtaggggacagattaaataaattggaccacagtgaaattgcacatgcccattgcaaaaaacaactcacctctaagcatactgagctaaggagacaatcatgatctagtatcaacatctgagaaaagcaaggtgcacaaagaaaggaactgtgtgctcccatctgtgtgagggtatagatataaaaatatatataaatgcatatttatggatagactcttgtatgcagagattatctctgaaatggaatctaagaagccagttataatcttttcttctagggagaattgtgtgcgctggaagacaggagagggaggcattttataccatgtatatgtgctacctactcaaaagacagattaaaaataagaatttttctaagtgcatgtagcagggtggtttttttttagataccaatttatatcttctcccagctctggctcctttgcctctgggaaggtttgtggcagagcttcctggcttttgtttccaaaagctcttttgttcccaagaggaaaggatttggagacagagaatgcttcagggtgaaaagagatcctcacaccctggccctgggtggaggagagagtcttctatacgggtcccttcgcaactccaggaagatggagaacaacataagaagacctggccatcccatgctccagagagcgtgaacccttgcagccaggagctgcaagcccaggacaaaagggaccaccaggctgggttctggggtcctcgtgctcaccgctgtggacgaaggaccccttgcacatgtgtgcatgctgcaggcacccttcccccaccagagtgctgggaagacccctggagttttgaggcgatggcaggagagggaggaaagagaagctcctggacacacagaggaggaggagtccttcaccagcacagctgcaagggaatgtacagtcaaaatcaaagtggcttacagaaaaacaaaggaaagggcgattcttccacgtggaagtaagtagactgtgcagtgaggtctctctttgcccctccagagcctcagtgccccatctctgcccgactcagcccgaggccgaggccccctagctacaggttgggtgtagcgatggaaagcaccagtaggagaactggggcaagggagccccctccatgccgggtcatcgtaaggtggtctctgctgaaggctcatgcaggagcctctctgggctcttctccttcaggggtgggaacaaccccagggtattgctgatgccttcttggtttccttaaagcctcactcacctgtgaataaagtctctctgctaagccctcctcccacctgtggtttgtgtgagccttccgtttcctgctagaaccctgactgcatcacgggctggatcctaagtgctctatgcaaatcccatcacctcctcccacaccacccctctccaggcttctcttatcctgaccaagcccccgccttctgctccgctctcccacactcgcccctccctctctgaactcagccagttttcgcacatcccctttccctctcactgcagagtcccagcaaatgttccccgggcctgggctcttctctccactgccccgtgaccagataattcccacaggaacctcagtgttccttccttccgggggccttccactcttcctgtcctctccacaaaagcgccacggtcctctctttcctggggttaatcctcacgcttttcattttatgactatttgattattatcttcccctcctccgtctcccagatgacaagatccttaagggctgggactgggtttgattttgctctattttatccccaaagactatcatgatgttggcatataaaggtgctcattaaatattttttaaacagatgggtgaatgaactaatcatttgttcccattttgcacccctataagtgtcggaagctgcacgtgccccagcaaagcccagatgctatgtagatagacttgtatatgcgcacagagacgcacactcatcctcatgaaagtgaatgcaccaatgcattggcatagaggctaatgcacatcctcatgaaagtgaatgcaccaatgcgttggcatagaggctaatgcacacatacaagtgcaagggcacacacacacaaacgagaaggaacgatgccaagcagagacacacacacacatgcaagaaaagtgctcccaaggcggacgtctgccaccctgagctcattaaagctggctaaatatagcctgtctgcagctgtgctcagcaagctgcccacacaggccaggaaaagacaccagttaccaggcagaggagtggagaggccagccgtgggcaaggggcttcacgcatcctgtctgtggtggggggtcttcctggggaggccaggggctgagggtatgtgggaagggaagcccttcggtggctggtcagggcattcagagctgttcctctggtcactgaccctaggcagtggggtgcgaagtcaaaccacatgcccacgatggggagaggtgagctgagccatctacatctctctgcatctgagccgaggacccaagctcagtccaggaccaggggctggagttaggacccagctggggataaattggggctcagttggtggctaggagagaggctcagtagaggatgaagataaagggtcagactgggactagggttgggactctgtggaccattgccaggtctttttctggggacaagaggaagttcacagccccacagagcatctgctctaatgtgtggacgtggctgtgggaagaccctccccgcacgtgggacagctgcctgcggccctcacccctgcagctgatgccaggcgctggctctggaaaagccatgagacgaccagcatggctttgggtcacatgtgtcaggtggctgttgtcatccacacaggcagggtccaacttcaagggccacaatagacaggtcttcctgctgtagaatctgccccccaacccatcctgcatgggggtggggcagagggaggctcctctcaactcgcactttcccagcctgtgcactgcggagccctgcccctcgtggagctgctgagactggaagggagaggcatggagcgggtgaggcagccgcaggtctcctgggagaatgtcatgcctcctcccaccggacgttcctggatgggggcgtgggcagaggaaggggagttactgcccctttgagacaacagctctaccctttgcctcttctatggtggtggcatattgcagcaggaggggtgagccgggcttgctggattcagcacgtgtgagcccagcagccatgaatggagccacaagggcagaggccaacagtgcggggtccagagggaccctggtccttcccaccatttgctgcagaggaactgcttctgtctcctccgcagagatggatggtatgctcaggcttcccaattagcccacaagaaaactgtgcttagagagtccacgctcctcccagagctagcctggggaaacgggagagctgacaggaagaggggaaagtggtcgggtaaggttgtatggaggcaaggttcacgcttcattcgagaggatccatgggagagaaagcaggggctgtgagaaccagcctttcctcctccaaaggtctctctgacacgctgaagggaggatcagagtgggtgagatgggaagcaggaaggcagggaggccgggaggcagggaggcagggacgccagtgcacaggaggatgcaatggtccaggagagagaagatagggcctcaactagagaagggatggggacagggaggagtgggtgggtctcatagcactgctggaggttgaatgacactagcagaggctgatttgatagtggatggtgacagagacagagaagtctagaaggtttctggcttggattcatggaggatggtgccattcacactggatggaagcacagaaagagtgaggttcaatggaaacatacaagatccctgagtccctacagccagcaccatggcaggtatagtgggagcactccggaaatggtcactgtgctaactaacggagcagcatgaacaaggcagaaacagaaagaggcacagacagaggaagccaggggacagagaggtggcaacagaagaccccgagaatgtcagaaccaggagggactccatgaacagacagatggggccccaggcacgagctgagactgcacagcaactcggcagtaggtcacccaggtctcctcccccaagtccaaggccctctctcttctctggacccccaccaagcccccacacacaatggttcccttggcttcctctagtttggtttcaaatatcaggctcacgccagtgacagcaggctgccaggctgccaggccgcctgcccaactgcacaatgaaggctggggctgcctggcagccacaaaggagaaagtctccaagacacccctccccgcatagccactgcagacaagcccttgcaacctcatacctgcgcatgcctgagaggcccatggagacctccctccccacacttgcaacccaagaggccctgtgctgtctggctggctcatgtcctcctctctggggactccaactcttggggaaacactgctgtgacaatggcaactgaggcagccgcaggaccagtagagcgccagaaagactgagccccacttgataagattcatcatcacatggggaccaggtgttccagcttccaaggcacatccgtccagtaacaagtgacaaccatcagaactttctatccagcctgtgcggatcctagtatctcacagatatcatctctggtgccctcagcaactctaagaagtagatgatatggccatcttttcttttatttatttatttatttatttatttatattttattttatttctgaggcagagtctcactctgttgccaggctggagtgcagtggcacaatctcggctcactgcaacttccacctcctgggttcaagcgattttcctgcctcagcctcccaagtagctgggattacaggcgcatgccaccatgcccagctaattttttgtattttagtagagatgcggcttcaccgtgttccccaggctggtctcgaactcctgagctcaggcaatctgcctgcctcggtctgccaaagtgctgggactacaggcatgagccaccgcacctggcacgacagtatggtcatctttccacaactgagtaaactgaggctgagagacatcaagtaacttgtccaaaatgtcacagctactagacgagagaagctgagtgtcaaacccaggcctttccaaacctgcaaccccagacaccatcacaccagtcccagcatgttctgactcctggttccagggcaacttttaccacctcgcaatttgtttttagtgagttttcaaaaatccagtggaactattaaataaagtatacttgcatgcaaattgtcttatgtggaaaagcgccattataaatgcaagccattgcgattcttcttgttttaattcaggtcacagattttttcttctgccaattttgcattaaaaataaacacattaccatcgatcgtcaccatcatttcataaaagaaaaagcattttaatgccaaaactgggcaggacataattgtagaattatgtgaaaaggagtcctctcaattgaatgcactcaacattatggaaaaatacatcacagtattattgtttttctcactgctgaaaatcttgggttcatttgggcatccccaacctagacaacctccaaggtaccatttcagctccaaaattcatctgcacatacgctgtcattctttgctaaataagaacactctttttttttttttgagatggagtctcactctgttgcccaggctggagtgcaatggcataatcttggctcactgcaacctctgcctcctgggttcaagcaattcttctgcctcagcctccccagtagctgggatttcaagcatgcaccatcacacctggctaatttttgtatttttagtagagacaggttttcactatattggtcaggctggtctggatctcctgacctcaggtgatccacccacctcagcctcccaaagtgctggaattacaggtgtgagccaccacgcccagcccaataagaacattcttaaggagcagaatttgatgacagccttcagcaatagaattctaactacttaaacacacatttttcttcagccaggtccagaggtcactaaacatctcatcaattcaattgtgtctgtggaaaacagagctgtggtttggcatcccggagacaagccccatgtcgggtggctgtttttgcttcggggctgccgctgtctcctctggccaggtgctcagaaggggagatgattggttcttttcctcttctgcattcctggggaatggggtgacacccctatattcatcatgcttgttattttataatgttttgacatctctggggcctcgctggccaggaagagactgcccctcccagagctggctaattcctagaggtaataacaactccctttgagggcacctttcataggcaaatgaaccaggcccaaacccatatccccaaccaccttctctaactctcacccaccaagccaatacttccctggccctaaatcaacccaaggccagctaccaggcaacgggacaccagccctagagcctagagcccagagccctcgacatgcaaatcagccagccctgcatggttctcctgctctgccctgcctttccagagaaaaaaccaacaagggctctgggccttgcagctttggggggctcagtccactctgcccaccacctccctgggctcaggtctgcagccactctgcaagctcttccatacctcagttgctattttctgaggtggaggcgcctgtgacaccagccttcctatggcctggaatccagccttgagttggattcctggcccttctgtctcctgaccaaaccaagtgcttcccccgtggccttgcatggtgtggaatggccccatctctcaaaacctgagctgaaaatgttttgatgacatgagcctctccacatgctcagtcacctctacactaaagacccacaggtaattttaacacattccccttgtgctgagctcagttccttacacccctacgagtgctcaggaaagagaactgccctctctctgccctgccctttccatggcctgatgcccttatggcctgagccttggggtgcccctgacaaaggcattcacacttaccagcccctgaagggctttgtctatgaaattgccattgaatgctagaagcagaaaaaggttctccatgtagggtgtggtggctcacgcctaaaatcccagaattttgggagaccaaggcgggcagatcacctgaggtcaggagttcaagagtagtagcccggccaacatggcaaaaccccatctctaccaaaaacacaaaaattacccgggcatggtggccggcgcctgtaatcccagccactcaggaggctgaggcgggagaatgatttgagcccgggaagctcaagaggttgtagtgagccgagatcgtgccattgcgctccagcctgggtgacagagcaagactctgtctcaagaaaaaaaaaagagaaagattctctggcaggggatgcctgtgcagccactcaaggctgggttccaggccataggaaggctggtgtcataggtccttccacctcagcacagcaactgaaggatggaagagcttgcagagcagccacaggcctgagctcagggaggtggtgggcagagtggactgggtcccccaaagctgcaaccatagatcaaaggagcaggagagagaagtcaggaaagttctgagcacaaccccaccccaaacacacatggagtcctctcctgacccagccacatatggaagtcaatactgccaacagcaaagacatttggcccagacattggccaccgagtcctcccagaacatccaaggaagatgtcctgaggtcactatgtcagcaaatggccacatctcgaccaggtctttcccaggtccaatgctgtgctcatctctctgagaaaacacagggggaaggaaacctggagacgcctgtataacacagaggacagggactcagccacagggccatgggctctgcagagaggtagcctcttcgtggagcaatactgaggatcatcaccccgggcacatccaggaatgaagtgtctctgaacctcattcagtcatgtcagtcaccatggcaccgtcagtggttcctggaagttgtgtcacccaaaagtgatgggcacaggggccatgttccccatccccgtcctcctctctctgtcctcatgccatgatctcagctgctctgctgagctcacactcccaacccaccagcctcccacccctcactctggccctgtggagtccccagagagggggacatgagctggcctgagctgcccagtgataggaactcaggaacccgaggaggctcagttcatgggttagagagggcccaaactcaggctgagtgaccccaggccctccggtactgcctgcaggcaagatggcagggatcctgccatcctttcaggctctgagtggatgagaggggacccaggctcaatgagcttgcacccatccaaggggaagaaatgaccccacagggtcaggcttgactcacgctgcttctcctggaggatgctggatgtgcacggcgcggtcccttctcctgcagaaaaagaaaagaaacatgagcagatccttgacactgttgccaggcactgtgtttcccagggaggctgcttggagctgcctctgaccctcactctagagcttgggatgggcagaagtatctcctaccacttcatgccctgctctgccctgacctgacctagcccttggcccttcatgccacacctgatgccatttctggggagagtacggcctggctcctctgcctcctcaggcgttttcacctctgtcttgtcctccagctcctcctctcctccctcctctataaagcagcggcttcccaggagctgcctgcctctctatactcactctctcctctgagggtccacactgaactccaagcccacaaaccactgccagggctctgcctctggcccaggcctctccccttagctctggatctgcatatcccactgccccccagacgtcttctgtggccactcccaaacactgcacactccccatgaccaaagcttccctagaagtctgcggcccctcccaaaatgtgtctgtggcttcctctagggccccaggtctctgaggaaggtttccaaggcagaaagcgaagtcacctcctggtctccccaagggactcgagaatccttccccatgcaaagctacctcatttcttcccctacagaactgaagggcaactccagtctaagaacctcctccatctccacagcccacactccagggcctggtagatgactcctctcctgaccccatgcctgcctctcacaaccccgtgcctgcctctcacatgaaacttctccaggtgttcatcagaatgaacttctccaggtgttctccagatggattcattagaatccatcaccctgtttctgtagccctctgcctgccagggccatcttcatggcccacgtcccctgaatcctggggtcatggcccccgggctctctcaaaagcaggcaggggtaaacaatgggaagagtgtccagctggaatctggaggctgactccattttaggctccctctggcctgctgtgtgatgtaaggcacagcactctccctctctgggttcattcctacaagatagcacggatccagtgctcgctaagaacctccaggtcctgaaagcccttgagtgacactgcattataattggatacctggattcaaatgccagcttcttcacttacgaaccatgcacccttgggcaagttacacaacctgtatatgcctcaatcttccaatctataaaatggggatagtactggtacttgcctcggagggttactgtggatattaaatgattaatatatgtaaagccggctaggcacggtggctcatgcctgtaatcccagcactttgggagacagaggtgggcggatcacctgaggtcaggggtttgagaccagcctggccaacatggtggaaccctgtctctactaaaatacaaaaactagccaggcgtggtggcgcatatctataatcccgaagctactcgggaggctgaggcaggagaattgcttgaacccaggaggtggaggttgcagtgagccgagatcacgccactgcactccagcctgggtgacagaatgagactccgtctccaaaaaagaagacaaataaaatatatatatatatatatatgtaaagccttcagaacacagtcaggcacaaaacaggtgttcaataagtgaggatggctctgattcttgttttatttacttgtttacttctaaccattgattcaagaccttgtcccttttgtcttcatcatgatcccaggtgcagccagatagagacaatcaatggttaatgctagatgccagctcacagcactccctagacctaggggccgtgacaaagcctaggcccaagaggggcccagatagagaacagagacctggacaccgtcatagagcagtccccacacagcacaataggatggacgcagactgtttcccaggtgcaacagcagcacagatgtggacagaaacaaggaatgacccagtatccaatacacaggtcagggagcgaagaccagcaccatgtctgagcaccagctaaggcccatgaaactctggcgtccctaagaagtcaactttgaccacccagcagagctggggcctagcagagaaattaagacataagacatgcattcaaaaaacgccttctatgggccaagccccatgctaggggccatggaggatacagagatgaggaagtcagagtgagtgaggagcaagaacacctctgtgcagagaagcacacggctaactgcaatgagaggcgagaccggcggggagagacggggagggaaagattcattctgactgaggactccaaggaagcttgtgccagagcagagatttcagttttgacagtagaggaaagggcatggcattccaagcagccagcaagatcatgtttatggaatgccaagttcaaggcaaagcgggggtgtgagagagcatggtcccatttacagataagaaggaaggaaggcaggaagcccatttacagataagaaaaccaaggcctgaagaggtgaaggagcttgcagactcttccaaatccaaacctcctgctttttctatcatactccaccaaaaccagctgcataatgaggaaggcctcatgcaaaaaggaaatgccgggtcccttgttcaaacagaaaaaaaaaatgttgctaaaggtactaaaatataacatttttccttttccctgaggatgctctaaaacctgttatggtgttttctttctttctctccttccttccttcctttctattcttttcttttcctttctctctttttttttttttgacagagtctcattctgtcaccaggctggagtgcaatggtgcgatttcggctcactgtaacctccgcctcccaggttcaagcgattctcctgcctcagcctcccaagtagctgggactacaggcacccgccaccacacccggctaatttttgtatttttagtaaagatggggttttaccatgttggccaagatggtctcagtctcttgacctggtgatctgcccacctcggcctcccaaagggctgggattacaggcgtgagccaccgcgcccggccagtgttttctatttgctactgtatttcctcatgcccagggagacttgagggatgagtgcaggccctcccaggccccagggtccctgctccttagcttggcacgtacacacaggctccaccagcacccaggatccccctcctgccagccactgggccaaacaaaccatgctgtgagtgacagttggaaagttgagccaagcatgcacccctcccacaggcctgctggccccatccagggtagacaagagtattgcaacctccatgctgaaacgcactagttgagtgagaggttttttccctctgaatcacccttggaatgctctatggcactgccagcccagggtggggacagctgcctcgccccaagacatggtggagtataagcacctaacctcagccctgcctgctcccaggctctggcttggagggaggccagcggctgtccatgggcaggggaaggagaagaaagctgggtgggggtggggctgagaagccagagggcaggagagcagcaggccaagatcccaggaggcttcaaggcggcaggaggcaggaccatgtgagagccgcccaccaagtacccccacacatatgcactgtcccgtcagacttcactcacaaaacacaaacttggccgggcatggtggctcacgcctgtaaacttagcactttgggaggccaaggtgggtggaccacctgaggtcaggagtttgagaccagcctggccaacatggtgaaaccccgtctctactaaaaatacaaaaattagctgggcgtggtggcgcatgcctgtaatcccagctactagggaggctgaggcaggagaatcacttgaacccaggaggcaggggtagcagtgagccgagatagtgccactgcactccagcctgggcaacggagtgagactccatttaaaaaaaaaaacaaaacacaaaaacacagacttgaagataacaccattcggacttcagaacagcaaacccaatacctgcagccctctggagcactggccctgagccctgactataacacagacacttctggcatttctcgggcatctactatgtgtcaggccctggaggaggggaggactccagcgcagggaggagccgggtctgagtcattacctccacattctcatgccaagtccatagtcggtactcacggagacagtttatgagttctccagaccatccaatactttcattaccagggtgtaaatatgacttagcctgggcaggatgtccagaggtggggaggtgggaaagttggggaggtgggcaaggatgagagctggggttgctgggaatgctggggatgcagctggggttgctgggaatgctggggatgcagctggggttgctgggaatgctggggttgctggggttgctggggatgcagctggggttgctgggaatgcagagttcagaggccggaagaagctcggggacccaggtgccaagaggccaggaggtgagtgtcctggaaacgccagtgcgcaagcttcacgtgggtaagaagagggaaaatgtcagaaaggaggtcgggaccaagctctgggactcctcaaagccagccctgagtgcggcctcagctgcataagccttgaaggctgcacctgggcacgcaggtgctttctggcttgcctagtgctttcccgcacatgaaatcgttggcttccatgcctatgcaataaggctgctgagcctcagcgaggtaaagtcacttccccaacgttgagatctggtcccttggacaccccaatactgggaagggctcttcccacaatttcaccccgcctcctattggtcgggggcttcctagagcagtggcttcccaggacggctcaggcagcctgggtagtgcttcctggaggaggaaggcatgggacagcgaaaggctgccacagtcaggggctgaggggtgaggaggacgggagcagagaaggggacatttgcaaggggtgcagagaggatgcgtccagaggcttggggactggctggtgtttgcctcgggcttcgtctctcctgcagcgcagcctgagccaggcatcccagggttcccagggctggtgaggccaccgacggggtcaggaataagcctgctgtttgatgaggtaagtgtggcgcccggacagtaggaagccgggcttgcctgcccagtccaagccagctccatcttccctggaaaccgccagcgagggaggagccggcttgaacctggcttcctgatttagcaggctcccaggacgagggtgattaaccaactgtgcagctggctcagctgccacctaaatgagaccccacttagcctagagctttgcaaggctcatgggcctgacagctttgcctctgctggagcttgtttcaagtggaggagctgccagaaactcctgcagacaggatgggctacaaggaactgggaaggcagagttttgtcatgcaccccaggctctgggccccaccaatcttgcctgtcctgaactcacacagccctggaaggctgagccacatcatcttttctgagaagatgcttctgagtcccgctaacggtttcctgagtgattttataactcttcttccaatcccctcccaacaaatcatgagttccccaagtgcaagagaagcaaagtgtgtggccaagaacagcaaagtgtgtggcaaacttctgaaacaggagagccttcctgcatcacactggagagttggtggctgcggagagagtgattcagacagacggggccttggagaataaagaattgggaattctcctgataaaccagaaagtgtcaggaacagcccctctggagcagagacaggagccgctgaagccggaatttgccctgggctctccccttactgggcattgggagccctggccaggctccgggccagactggtggctttgctcatgaagcctggctgaggagcgaagacctgcatgctccctccctgctcaggccactcccaacatggagcctcccctgcatgctcctccctgctcaggccactcccagcatggagcctcccctgagctgcaggttgagactcacgctcattacccttcacctggcccagcgtaagcccctgcactcattccccggcccctcctgttctcctccacattggcttctagaataatctttctaaaaagtggctctccgctcccctgcttaaaccattcagtggatccacaggggcactcccaagaaggcccctaactcctcagcctggcattcaaggccttcatctccagcttttccacccctgcctcttttccaagacctcccacccctttttaccaccccctagctccacacctcacccccagcccaatgctccacaccccaacctcagacaggacaaactccccaaatctccattcttcccataccttttattctacgtctttcccatgtcttttatttcatccgtatggtatgttacatcgattgattttcacatactgaataactttgccttcctgggctaaattccgcttagtccttgacaaatcttgtcatctcactattcttttatgcttggggtttttatatctcttccaggacaatttatactaacaatctatgagctgtcatttaaggaatgacaacctcatagattgtccaacctcagtcaagacaaactctccaaatctccctgcttcccacacctccctccgtacctttgtccctgcagctccctctgccctcactggtctgtcccaaccccagcaaagcctccttacctcctcatgtggcagctccagcgctacctcctctttcagccctctgtgccttgttccccatcttgttagagcaattagctcactggactgtcactgccccacccccgtctgggagccggtcaattctgagtccacttctgagtcatctgtgtgtcccctgcagtgaccagcacagggtctgacacagagtaagtgtccattcctgtgcattgcatgcataagtgagggaaggaatgtatgagtgcacagtgagcccctcaccactttgggctcagacagggaggaaagggacacacccagaaaagcacagctgtcagcagagtggtccgtgctacagacaagagaccaactcagctgtgctgggcatgaggacagtggtctgggagaggctggagtatcaaggaggcttcccagaggcagcgcatgggattgtgggagctagagatgaagtcaggggaagagccggggcaaaggcaggaagctgacgagctccgcatgagcccagggatctctctgcaagcagccccctggccatttgactaggagacagtgggggtggaagaggaggggagggatggccaggaagccatgaatatcagaatcagagataaccttggtattactgggtttagcaacaatttgacagcccctttatgtccctcatggtagctctcccagggctgtttgattcctgtagtgataggaaacttactaactctggaaatttatgattgctagaaggaaggctggaaccacattgtggatggccttcggtgccaggttgggggatctatacttcatactgcagtcaacaaagacctacttgccaatttcgtggcagaatgataggactggatttctattttagaagtgtcgtggtaggattggataaagatggtaaactgactacacgatctagtctttttctcctcctccagatccctagaaaatgacatcaagcatttttatgtgaattaatctttagtagcactgtaaaataagaagtgtccttagcagaccagaaactgtgtggcatccccaaaagttagaaggcagagagatctaaggagggaggcaggactggttacataattttcagggcccagtgtaaaatgaaaatgtgggtccctttgttcaaactaattaaaaatttcaagatggcgacagtagagtagaaaatcaagtgtgtggagccttgtgtgactgcaaaggacaaatgctcacaaggctagcccaggagaaagaaaaccataacctcaagcctgcaaagaaaggtctgtggcttggccaggcacagtggctcacgcctgtagtcccagcacttagggaggccgaggtgggtggatcatgaggtcaggagtttgagaccaacctggccaacatagtgaaaccccatctctactaaaaatatttaaaaaattagccatggggggcaggagaatcacttgaacccaggaggtggaggtttcaaggaactgagatcacaccactgcactccagcctgggcgacagagcgagactccatctcaaaaaagaaaggtctgtggccagtgatggaggcagcacagaaggaacagcaggcttatgggtgaaaaatacagaagcaaagaaagctcttgtgatcgattgtctgggcttccatagcagaggagccaggtgtcttggtcctcccccaacccctgcttatgccaagcaaagcatctgtcccaaagtgtgagaaaggatgagtgtttgaaggacaggacaccatggaaagctgaaaatacccaagaggaataaaacagaagcaactggctcaactcacaccagtgacattttctaccttctccaataattcgatgacagcaggtttcagtaaacagacatattcctatcactcagagatagataggctgacagggaactgcaaacacaaactggcatgtgcacaaatattagtaaatattagataaaagccaacaatgtggaaggaagatgtccaactcagtgactgaagggaagagggaattggacctgtggagtccttaaaccaacttagtgtcatggtcattagtggctctcaaattttagtgcatcggaatcacaggactagttaaaatgtggattctgagccccgctcccagagtttggctgattcagtaggtctaggggtctagaaatgtgacccccaaagtcacatttctaaccagttcccaagagatgttaatgctgttagtccagggaccactctttgagaagcgtgtattgagatacaaggtcataaaccagagtcagggggtgaatggtaggaaaaaatagctctctggaatgctagaggcagagaaattaatcagggatacccaggcagtgactgcttccttcctgtcaacaagaacgtggccttgctgacactgtttgttttaagaacaagaagaacctagattgtaaatcattccttaaatgatagctcatagattgttagtatacattatcctagaagagatatataaaccccaagcataaaagaatagtgagataacaagttttgtcaaggactgagtggaatttatcccaggaatgcaaagttattcagtatgtgaaaatcaatcgatgtaacgtaccatattgatagaataaaagacaaaaaccacatgaacatctcaatacatgtctgcaaaaaaaaaaaaaatcctgcaaaatccaacacccttttatggtaaaaaatacattcaacaaactagaaataggagggaacttcatcaactagatgaaggacaacaacaaaagattcatagttaacatcatatttaatggtaaaagactgaaaaccttccccctaagatcaggaataaaacaagatgtctgctctcatcacttctattcaatattatgttggagactctagttaaggaaattagataagaaaaggaaataaaagctatccagattggaaagggaaaagtaaaactacctattcaaagacgatgtaatcctatgcatagaaagtactaaagaatccccccaaaaataaaactaaaaaatgagttcagcaaggttgcaatatagaggatcaatatacaaaactcaattatatttcaacacacttgcaataaacagtctgaaaatgaaattaagaaaacaatttcagttacattagcatcaaaaagactaaaatacttaggaataaagttaacaaaacaggtgcaagacttgtacactgaaaactttaaaacatcattgaaagaaagaagacttacataaatgtaaagacatctcacgttcatggattggaactaatattgttaagatgacaatactcctcaaattgatctacagagtcaacacaatccctatcaaaatccccactggcatttttgcagaaatcgacctaaaattcatatggaagtgcaagaagcacagaatagctaaacaatcttgcaaaagaagaacaaagctagtggacccccacttcctgatttcaaacttactgcaggtgtacagtaatcaagactgtgtggcatattaacatatacacctgagtggaatagaactaggagtccagaaataaacccatatgtctatgatctattgatttttgacaaacctgcctaaacaattcaatggatgagagatagtcttttcaataaatggtgccgggaaaactagttaatcacactcaaaagaactcctagctcacaccatacacaaaaattaattcaaagtgaataaaagacctaaatataagagttaaaactataaaactttacaaagaaaacatgggggtaaatcttcatgaccttggattgggcaatggtttcttacatatggcaccaaaaggacagacaataaaagaaaaaatagataaaccaaacttcaacaaaattttaagatttagtactccaaaagacattatcaaaaaaaaaaagtataaagacaacccacaaaatgggagaaagcatatctgataagggtctggtgtccagaattcattaaagaactcttacaactcaacaataaaaagacaacccaaattttaaatgggcaaaggatttcagtagacatttccccaaaggagataaacaaacgatgaataagcacacgaaaagatgctcaacatcattagtcattagagaaatgaagatcaaaaccgcaatgagacatcacttcacacctgctaggatggctatatccaaaaaggcagccagtaacaagtgttggcaaggatgcagagaaattggaacctttttacattactggtggaaatgtaaagtggggcagctactttggaaatgaatttggcagctcttcaaaaagttaaacagaattaccatatgatatagcaattccactcctatgtatatcagcaagataattgaaaacatatccacacaaaaacttgcatatgaatacttatagcagcattattcataatagccaaaaagtagaaacaactcacatgtccatcaactgggataaatgagacatggcatatccatacaatggagtaatattcagccataaaacaaaatgaagcactgacttatgctacaacgtggatgaatcccaaaaacattatgttaagggaaagtagtcacacacaaaaggctatatattgtttgattccatttatatgaaataccaggggctgggagaaggggaatggggagtgactgctaatgggtatggggtttcttttttcagaaatgaaaatgttcttgggccgggcatggtggctcatgcctgtaatcccagcactttgggagaccgaggtgggcggatcacttgaggtcaggagttcaagaccagcctggccaacatagtgaaaccctgtctctactaaaaaaatacaaaaattagccagacctggtggcgggcacctgtaatcccagctacttgggaggctgaggtcagagaatcgcttgaacccgggtggcagaggttgcagtgagccgaggttgcaccattgcactccagcccgggcaacagagtgagactccatctcaaaaaaaaaaaaaaaaaaagaaagaaagaaaagaaaaaatattattgagctagataatggtgatagttgcatcccttcatgaatatactaaaaccacactgaattgtacattttacaaaaaggtgggttttatggtatgggaattatatctcaacttctaaaaaagaatttggcaagacctgcttcacttgaatagtgttaatggcagctgtgtgcctccttagatcattcaaatcaagatgtctcctgctctgtgttgtaatctcacctatgatctttggctgaataatccaatcttaagtgtgtagttattcccacccatatctaacctacagaaaactctgaaatgttctaaaacaagcagaaggagactttaaaaaatgtagcatgagcccatgcttccatgaattaagatcagattgctaatcaaaagaatcaatcagagcacatgaaaatgaaaagatgattttaaaaaacaaacaaacaaaaaaacaaaccccaggcctggcacagtgacatacgcatgtaatcctagcactttgagaggctgaggccggaggatcgcttgagcctaggagtccaagaccaaccaagacaacacagcgagaccctgtctctacaaaaaattaggcaggtgtggtagtgcaggcctgtggtcccaactactcagaaggctgaggcaggagaatgagacccaatctctaaaaacaaaacaaaatacagaagagctgacctgcagaatggagactgatgaagagaaaatgggtgagctgttggttagagtcaaagcatattctcagaacccaccaaggaccaagaaataagaataagaagaacaaggtaacgtgtggttagaaaagtctctggaagagaaagaaatacttggccgggcgccgtggctcatgcctgtaatcccagcactttgggaggccatggcgggcggatcatgaggtcaggagattgagaccatcctggctaacatggcgaaaccccgtctctactaaaaatacaaaaaaattagccaggcgtggtggcgggcacctgtagtcccagctactcgggaggctgaggcaggagaatggcgtgaacccaggaggcggagcttgcagtgagccgagatggtgccactgcactccagcgtgggcgacagagacagactccgcctcaaaaaaaaaaaaaaaacaaagaaagaaagaaatacttgaagaaatcatgaaaagaaggcttcacagtagtgaaagagcacagccaggtatggcatgaccaacaaacacctccacaacaaaaacctactcagaaacgtcgcttgaaatttcagaatacaaggactaaagatgtaaaaaacctaaaggctgggcatggtggcaaatgcctgtaatcccagcactttgggaggccgaggtgggctgatcacttgaggccaggagttcgagaccagcctgggcaacatgttgaaaccctgtctctattaaaaaaagaaagaaagaaaaaaaaatttaaaaacgtaaatcttcaggaagagtaaaaaccatattactcacaaaggaatgagaatcaaatttatctcagacttctcaccaacatcactaaattcaagaggccatggaggaatagctgcagagatagttgggaacgtgataatggaggcagataagctcacattcaaatgagcaagcaaaataaagacatgtttagcaatgcaaggacctagaaaattgctatccacagttcctacctgaaagaattactagcagagacattctagtgaaaagagaaagtaaatccaagaagaagtcaggaaattgaggaagtagcagtgagacctatatgctacaaagggcaaattttactgaatataaatcatagctcaaaatacttaacccaaatagaatgagaaggagggggaggtggcggaggagttgtcactgccaaagccaccatgatgagaaaacaaaaccctccccaaaagtaaaacagcaaaactaatcattaagttgaaatgagaattggcaacatgaaaccaaatggccaggggccatgggagctggggagttaggaagagaaggaagaaaaaaggtacaaacatccttccctgttcagggatagcatagatagagctactgacttaatccaaaccctggtagaaaatgccagtttttatttttaatttttttttttttgagacaggggctcattctgtcacccaggctgggttgcagtggagcaagcatggctcactgcagccttaacctcctgggttcaagcaaccctctcacctcagcctccagaataactgggaacacaggcacatgccatcacacccagctagttgtttaattttttgtagaggtaggagtcactctctttacccaggctggtcccaaattcctgggctcaagcgatcctcccacctcggcctcccaaagtattgggattacaggcatgagccactgtacctggccaaaaataccagttttcaaatgtatgttaaaactgtacgtttctagaactacaaaaaaaggaggtatataagaaatttgatggtgtcaataaaaaacaagaaaaggggaaggagaaaactgtattgataatatctttaattttatagagaatttataacccaacatatacagtatatagataatgtatatattttttaactcataaggaacattcacacacccacactagaccagggtttagacaagaaagaatttcaaaaagatatcacgttagggtcacattgtccgatcatagtggaatcaaattgctaattaacaagaaaaaaatctatttgtcaggattcttgtacatggctctcaacagctctttgggtaaagaggagaacgtggaggttttgaactatgtagacatgatggacagtgagggggctacttatccaaaccctgtggaatgtgtccaacatggctggatgcaggttttctggggactgaggttatacaagtttggggtccccttttaaggaaaagattatccccccaaaaaagcttacttttataaattttaccaaaaaaaggtaatgggtaaaaaagcaaaaaaaaaaaaaggtaaccttgctaggaccctcccttggaagggaacagtgcgtgtgtcatttaaaaaataagattaaaaagctcttatctctagaaatagaaaagcacaaatcacataaattccaaggaagtagaaggaaataattaatgaaataaaagcaatgttaatttacaaaaactaagtagagaaaacggtagacaatagaactgattaataaaagtaagagctatttctttgaaaagaccatcgaaataggtaagcctttggcaaaacttactaagaatgagagagaaagagaaagatggagggatggggaaaaacacaaatgaacaatgaggggaatgagaaagaagtcataactttcggaagttaattgttttcaacttgatgaagggcatttctggaatcctagggcgagggccatgtttgttggtaaaacattggaacgtttccatcacagcactacagtcaggatccaaccagaaagcccgctaccgcttgtcactctgcattgacctggagatcccatgcaatgcagtttaaaaggaaaaataagaaaggagagtaaatgctggcaaaaatataactgttaagatttgtaggccgggcatggtggctcatgcctgtaatcccagcactttgggaggccatggcgggcggatcacgaggtcaggagatcgagaccgtcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaaaattagctgagcgtggtggcgggcagctgtagtcccagctactgggggactgaggcaggagaatgacgtgaacctgggaggcggggcttgcagtgagccgagatagcgccactgcactccagcctgggcgacagagtgagactccgtctcagaaaaaaaaaaaaaagatttgtaaacaaggctggatgcagtggctcacacctgtaatcctagcactttgggaggccaagtcgggcagatcacttgaggtcaggagttcgacaccagcctggccaacatggtgaaaccccatctctactaaaaatataaaaagtagccaggcatggtggcgggcgcctgtaatcctggctattcgggaggctgaggtaggagaatcacttgaacccaggaggcagaggttgcagtgagccaagatcacaccactgtactccagcctgggtgacagagcaagactctgtctccaaaaaaaaaagaaagaaagaaaagatttgtaaatgatgtgatgctgtaactagaaaaaacccaagagaatcaactgacaaactattagaaccaacaggaaatgtcaccaaagtagcaatatttcaaatatatagcagactaataatttacttccagaatatatatgaagatctcctaaaatccaataaaaaggataaacaatccaatagcatattggcaaaaattatgtttaagaaattcagaggaaagaaaatatgatcagtcaacacatttatgaaaagatgttcaatctcactagaaactgggtaaagacaaagcaaaacaagaaaacgtttttacccgaccattacataaaatgttgaagtttgataatatcaaatctggtaacacattgtggggaaatggctaacttaatccatggttggtgtgcaaatataaatttgcactgttttttggaaaaccatttgacagtatctattgcaattttcagtgcttatactttaaacccataaagcattcttataacaatgaaagattccaatgtctatcactgcagaatggttaaataaattatggtacaactatagtagagaatattatagtacaggtaaagagaacagagtgaatctatatatacccatatgaaaagctctccaagatcttctgttaaatgtgagggaagaggtaagttgcagcactaatgtctaataccatcgacctctagagagatacgttgatcaactccacaaggaggtctgtaattgaaggaataactaaaggagactttggttttatttgttgtgtttgattttttccaatgagaatacatttaagaaatcaggtggatatttataatgtttgtagcagcattattcatggtagctaaaacgtggaagcaacccaaacgtccatcatcagatgaatggataaacaaaatgtggtatatccatacaagggaaagttactcagcccccaaaatggaataaagtactgattcatgttgcaagatgaacgaacctcgaaagcattatgctaagtcaaacaggccagacacaaaaggacaaatactgaatgatcccacatatgtagggtacctagagaagtcaaattcatggagacagaaagtagaatgatgtttaccaagggctggggaaaggaaaatggggagttggtgtttgacgggcacagtttcagttgcagagagtgaccaagttctggagatggttggtggtgatggttgcagagcgatgtgaatggacttaatgccactgacctgtatacttaagaaccgttaaaatgggccgggtgtgatggctcacacctgtaatcccagcactttgggaggccgaggcaggtggatcacttgaggtcaggagttcaagactagcctggccaagatggcaaaaccctgtctctactaaaaatacaaaaattagctgggggtggtggcggacgcctgtaatcccagctacttgggaggctgaggcaggagaatcacttgaacctgggaggcagaggttgcagtgagccaagatcacacaactgtactccagcctgggtgacaaagcgagactccgtctcaaaaacaaaaaaaattgttaaaatggtaaattttatgttatgcatattttaccacaataagaaatgttacacaaaaataacaagacaaacaattgcaaaaataataatagtataataaataataatatttgaacaattgtaaaataatagtaataacaacacgcttctgggtgttcagctggtgctgaaggatccctttccattaaaaaaaaatatatatatatactgggcaatatgttgccaaaaaagataaatatataaccaagcttaaaataaaaaatgtataatacacagtgccagaaacaaaaaaggaatccagagacgaaagcagaagctgagatagaggagatccgtgaatcccatgagtcagacgaataaagaaagaggctccagggccagagcctaaaaaccacactgtgaactccaccaacctgacctcagcctgtggatggcaaggagctgatgtggcacccactttatagcagggacacttgaagggccattccatccttacaggaacttacaaaaagaaccttctttgcggaagcggcaaagaaaccattcacagacagtgagagagaaaattcacacatgagtaattaaaaccctaagcctgtgccacttctgggtgtagggtctaaatttacaccacccatgtagaatggaaactctaaactataaatttagcctataaaatattcaagattagtgaaacactcaggcccagcaggaaacaaggccggtctttatgaggacattttcccaacctagggcacaaaagacttcccccaaaaagaaaagagaggtatgtgtgaccaagatgagttcacaatcacaaatgagaaagaagacccatgaggtatatttagtgtgcgcacacacacacacacacacacacacacagagcagaattaacacccttgagaactggagggatgagagcagtctgaaagtgctgatgaaatatatgacttaaatggttagggagagaaaaggtaaaatacaaaacagaattcaggcttaaagggaagaaggttggctccatttggaatttgtggagcataaggagtctttaggacatccaggtagaggttagcaggaggttaccaaaaatgcgagtgtggagcccagaagaaaggtcctggctggagatagagcaaggagttgtcatcgaggtggctggagcacccatggaggcagtgtgactggccagagcgtccagcatgaggcaggggaggggggcctggaatgagtcctgtgtctaagggcaggcaacttgaagaagacaagaggatctgctctgtctatgccaccaatttccattgcattcctttccaggaagagttcacggatcttcctttccccaagatacttcccagagcctctcagagccttgtcccagcctgccttactgcatagtaacccctggctctgatctgtcgcttccactctgctgcaagcttctcaggaatgacaaggccatcctgcttgtctttattccccctacattgagcacagggttgagcccctgtgatggctccataaatgattattgaaatgaatgtgtgtgttctgtcatgttgtgggaattcacattatgaattcacacgagaatgggacttggaaggagctggaaatccagctggtttcctcttcctcttaccctctctcctctcttcttcccgctccccattctgtactgggaggaaatagtaccaaccctcggactcaggtaagcactgcccttcattcatgagcatcaggaagcatttgtgagggctgccacttgtgcaacattggtcatgcttctcccccttccatcattataagaatgacctgctatcgaatgcactttgcaaatatcatctcatttaatcatcacagcttttttactagtcctccactctgcagatgaagaaacagaagaccagggaggtgatgtgacttttcctgaccacacagccatggagtggcatggctgaagttcaaacccaggcctctctgactccagcactgcagcttctgcctctgtcctggacctcccgctgtgcttcctcgtcccctgccctccagtgccctcccagctcactctgcctcttgctcacctgaccgactgcccttagctctcactgggtctgagtcatacattctttagcagacaagtggggatgggggatgggaaggggatggccaaatggatggtacaaatccatatttgtcttttcaaggctacaagcactattgtggggcaggacctagaatccatgaccccttctaggccccctctggggttcttgggatgaaggaaagagcagcaaaggacccactggcagatacatggctatgacgactggtaagttgtctctggattgcccttgggggccagagtcagagcccccccttctcgtggatgggacagtggtacagggtgcctttcctttcagactcatggttccttgagcctgactttgttggggcccagaactgtgccaagccttagtccagtccgggaggtgaagccctggactgggaatcagaagaccaggaatctgagcctgatgttgccaccagcttgggggactttgggcaagacgtggctcctctgagcctgggttctttgttggttagatgggatgaccacaccaggcctgcccatttctcaggatgagtgctttggcaaaaggagagctctgaaccaaggaggcaaggatggggatgagaaaaggaacaggaacagggcaagatggtcactaccaaggcagccgttcccgtgggctgggccaggaccatctcactgaatgcctcctgagagcatggccttgcccactcggcaactctgggccagagcacgactgcgaatgacaggagcaatagaggaaggagaagagaagatgaagaagaaataaagtaggaggagtggtatgtggggtggggaaggagggatggaagaaaccaacttgagggtaacaggtacagaggttagcaccctgcatcccagatgtgggtctagccctggctctgcttctcactccattgtaacattaatcaaatacagccctcagctgaagatctctgagctcagtttcccatatgtgagctcagattttacgacatcttcagccacgttgtccgtttgaattttaaagccttgccccattgcttcactgtcaggagcccttcctggatcccctctcctgcctcctgaaagtcatgcctctcccttctgagctaacaccctcagcttaagcctgatccacatatcttgacttatacgtgtcacacatcacaagacagaggcctcagatgaatcacctttggttgctcctgccaagcacttatacacagtaggtgctcaatgagcctgttagtgatgaacaatagccaaacagatggatagatggatgccaaaaagaatcagcctgctttgtaggctgatcaaactcctggtcaaaactcttctccatagaaagcctcctggattaatccccagccatatactccttcttcaacaactccaccaaaggaaatcctgattctcactgctgtccttctctctccccttagacctcagctcctgtcctgctcaaaggctcctccaactgtcaccctccttattcagcagattccaataccaaagacctggcagtccaaggagcttggacccaggcacctgccattaaccacccgtgccactggggtagtcattctgtggacaaaggaagctctgttgaagtaggctggagcttttatgccacagaaaaccccacagaagtccccatgagagttcctgtaagtggcaaaattcagggatgctatgaaggaggaaccaaggcagatagactcttcacagaaggcccaagccccagccccagtcaccagccctacagccccccctgcaacacacctatgtgcacatcctggtcatgagagaagcagagtctcaccttgatgctcgtccagtttccccatggtctcgatctgctccacgaggtcattggagttccactggctcatcccaatgaggatggcattcttcccttcagccatctcctctgtgggaagaagcagcggtgagcagaagcaggtgcagctagggataggtagccctatcaggagcttatgtctgagggacattttctcttgtcctatttcttccttgagttgaggtacacctcaactcttgaaggtgtctgtagctagacagttacaagacttgcagagatttatcattgaaagaaggtactgttgtaccctactgggcctccacgtgcaacagcaaaagaaagtaacaaaaagcctgaaaccccatagaaagtaccattcctagcactgatggcagtatctcttgaaagtcagtgtgtttgggaagaaagagcaaaaccttgtcatttgcaagcagtttttctttaaattactgacttctctgaccctcgattttcccatcactaaaatggatctggccacagaggtgttgtgaggattaaatgagataatggatgtaaaggtcttagtgcagaggaggtgctcatagatgagagcaatcatgatgatgtcatcacatgagaagtaactcaccaccaggagttgagtggatgaggatttgtgtgctgcagaagcagctctggagtaactggaggagaagaaaccttccggttctaaggaagctttgacttgtatggaacctttagcccccatctgaactttatgaccctcttaattcctccattctctcccactcctcccctcaaccctgtctctatccttgttctttccttgtctgagcatagtgagtcttctgggagaaatcagtggggctatattccataaccacgctgaatacaaggccctgggtcccacacatcagatacacacatctggtaccatccctcatcctacaaagggacatttcttcaaagacaaacccttaggcatgtgtgctctcctccccatactttgccgaaaaacagatgtgcctttctggtgaagagctttgtgccctccctcgcagaacagacatcaaagggtgttgaggacaatctccaagcttatgataattaagaataaagggttgagatccatttcactgccaaagaactttacctagcagaaggaatcaatatggtgcatctgaagctttgggagctgtccagagttctgattcactcaagagctcagttgaccagacccccaattctggttaggacatctcctcctgtcttattttatgtatctatttgattgacttaacaacacttatctaaccgttaccatacactgagattattataagtgctttacaaatattaactcgattctcaaaacaatacaaaaaaggtaaaattgttattatctccattttatagacaaggaaactgaggcacagagtagctgagtaattcttgcccaaggtcactggctagagccaggatttaaaaccaggtatactatttcaagagtcctgaaatcctgccatcctgatagcctgccctggacatcctgtattggctgcccacactccagccaggcaccacacacattcggacaatttcctgagcccagtgtgttccatctgggaactggtttattctgtgctgggcagggccctgaccaggttccagtgcagatcctgctgcatgtgagctttgtgcttttccacaccctccaccactgtgtctgctttcctatcttttaaacaacaataacgactcagggtctatagctctgtctagcaagctgctgtggggacaaataatatagcaaatttgaaaatacgacgcaagtcaaggtgctgtaaacaaatatgaggtgatattattcttcgggaagcagaattatgaagaggttaagagctcaattctcatgttagattgatttttttcaatcctggacccaccatctgctagcaatacaactgcagtttcctcatctaaaagtgatatcatcgtagggcctctgtcattggattgttgtgagcattaagtgagaagatgcaggtaaaggtgtttgtaagagtgccccacacacagtaaaagcacaggctgagatgccattgcatgatggtatcatcatcaccagcaccaccaccaccagtaggagcatgggtgttatgccccacactcactcttggttccactcctgctgttgttggcccctatgacattctaccccagctgtagagtgaggtaatcaggatcagcccaattaccaccttgagttctttgtctcctggttcagttactcaagcatggagctatccatttgttcattctagcattcaatctacggtgaatagattcctgagcacctactgtgtgcagggtgagacacaacctccctcctgctggaatccagttttgtgaaaaacatgatagaaatacctctgacataagctaagagagccaggtatgcagcaggcactcagcacatcctagctttcttctacagtgccataagtcctgtcccagtggtttatgcaaggctactggaaccctgtggggtctcccagggctctggaggtctgagcatgcctactcctgcatggcccaggccactttcctctttttcctaatcaccagtataaccctgctccatctttggcttttgggcttttgtctgtttccgatcaaatatgtccttctctaccagagtctcaccgtgcttctctcacgctttacatctggccctgactcactcagatctgagctctctggacccctttctatgggtctgtgtctctcttggtccttgtagttctctttgcctctcccaagctctcccatgctgcctgccacatccgtatctctctctgggtggaacacgtatgcattgccttgctctcttctcaccccagcatctctctctttcctttctctgggtctcatcttatcaggctgggtatgtctctttcttgatctctctcattctctatggatttctcttttgtctctctgggtccctgtcctcaggatctctccagccccctgctccctaagggtgttctccctcccctccctgttctctcttgctatgtgtgtgtgcacgtgtgcacgtgcatgtgtgtgtgcatgcatgtgtgtgcatgcatgtgtgagtgcatacatgcattgtgtgcatgtgtgtacatgcaagtgagtgtgtacatgcatgtgtgagtatgtgcatatgtgcatgtgtgtgcatatgtgtgtggccctctctccctcctgctccctctcactctctgctttatcttaccttctctggcattctcacactccctgcccctccgcccatccctgtctctctgctgctctgtgcaccctcccaactccccaacatgctttctctcccacactcagcctttacgtcttcactctggcaacaattggcttgtcccctgagaagcaacaagaacacacacacacacacacacatacacacggaagcagcagcagcaatatctccttttggagccattcaggcaaagaggggagctgcagggctcagcttgaagtctttgctctgcttcccacattgtaggacatgcctccaacaggacctgtggaggccacagcgtgctcatttgtataaacgccctggttgattttgcttttcaccttctgatgactgtctcctgcatgctaattctcatcctggtgacctctgcttcggacatggttttagcatgtacttcaccctactgagacctgacccagctctgattaagctccaagctgagcctcacccactgtcacaatagccctggccttgaccacagattgactctgaccctgaccaaaacctggttatactctactcctgtaagcacaacctacaatgccataaggaaagcctttcttcctatcctggagcttctgtttctactgttgacaggactccagagtaaagaatctctttgtcttggccaggcgcagtgactcacacctgtaatcccagcactttgtgaggctgaggcgggcaaatcacaagggcaggagttcgagaccaacctgaccaacatggtgaaacaccatctctactaaaaatacaaaaaattagctgggcgtgggggcgggtgtctgtaatcccagcaactcaggaggctgaggtggaagaatcgcttgaacccgggtggcagaggttgcagtgagctgagatcgtgctactgcattccagcctggtgacagagtgagactccatctcaaaaaaaaaaaaaaatctccttgtctcatgccaggaaagcttcacctccagctcatggagccgagggcttggtcacattctgcagatggcccatccagtaccactcatcatcaggcccacaacatggatttctccaaggacctagatatgcattgcttggggctctggaccacaagattgctcacattcaccttgcactgcctaccacatgcccccatggcccccctatagccaataccatgactccctcttccttgtgaggggcagtccccacacagcccatccccagacatgttggggctggttccatggcgttctcttttccacttcccctcccccaatgggggaaaaggtagagggagagtgggggcctgtggcacacctgtgctttgcttctgtgatggctccttggcccaggaataatcacgcagcttcccacggtgacatccttccactccctccaggagacaaacagttctacccttgccattctacagatgaggaacctgaggctcagagacccaagacttgcctgagatcagagggcagacagtcagtgacaactatcatggaaacctggtcctctatgcccagaggacacatatcattttcttctgttcccccttctctcacccttggggttggaaactgccgggaggctgagtgatcacagggaaagctcagatcaaaatgagaaggcttggcatgtgccccccattctctgtgagacctgaccctgactttgaaatttcgtctgtaaaatgggatgatttagccgtgcactaccttcctctcccaattgctatgggaaaccaggagttagaggcacaagcagattccgcaacacagaacccagctcctcaggccccagcctcccaccttggggagtgggggaggggaggaccagccaggctggccactgagagagcaagaaaccaaggacacaaaagacatgggggtaaatgcagaaaggaggactcctccagcttctagctcagagagttcccttagccctgctgaaggagacaagtcttgtgctttgctcttgatccagctacccagtgccagacgtgccctgagagtaaatcctagatccaccaccaccaccaccatacccagcccattcctggccctgatggcatttttgtctctgcaactgtcagggcctggcctgcttatgcatattcatggagggagggctatttagatgctggagggggttgggaaaccgaaagaaaagtatttcccattcaagtgagggaatggacctggacaccacagccaacagagccttgcaaggccatggggagcctcattgacagatccttccaggtgaagcccagcatcctcattttacaggtacagagctgtgccactggcccacggccatgcagaacctcaggggaagggctgggccaagaatcgagatcctgccaattaaaggcactcccagtaacactatctcctggcagttaatttcatgaaaccacctctgtttgtacctagatgtttgctggtacaaataattggatattgttccaattatttccaatatccaaataattggattattctttccatctaaggttaaagtgaaggatgcagctgatattttctaaatgaagacatacattttgctataaaaacagaacacaaagtgagctagtcttggcatatccagccaaatcccaaataaactcaaccaataccacagtgactgcactagccccaaccttgcatcctttcagggatgaagacttcaaaagaccgtttcatttttctctctagaacttagcgtttcatagccaggaaccctgggaaacctgggctgctctaacatgtcaacccatcctccttggtccactaagcttttcttacccatggcttctggccagactacctgtcacccagcaatcttcatccctcacaataaggagctcactcaaggtccaggcatggttccattttgaggatccatcctgcactacggactctgagttctgcatctctggccttctctgggacagggacggggtacccagggccaaccctgagcctggccaggaaagcgtgtccagaggacacccactgccttccacaatatgggctactgggtctagtctgccccctctctccttgctggggctgtgaacccacagcactgagccagtgcctccctggctcactctggccacaccagccttcctgctgttgctcaaagatgccgagcttgggtgcagtggctcacgcctgtcatcccagcactctggaaggctgaggcggacggatcacctggggtcaggagttcaagaccagcctggccagcatggtgaaaccccatctctactaaaaatacaaaaaaaatcagctgggcctggtggtacatgcctgtaatcccagctacttgggaggttgaggcaggagaatcacttgaacctgggaggcagaggttgcagtgagccgagactgtgccactgcagtccagcctgggtgacaagagtgaaactccgtctaaaaaaaaaaaaaaagatgccaagctcattccaccaatcaacactttgcgctggctgttcccactgtctagaacactcttccccctggattcgcaggtggctcatttctcattactcagctctcagctcagggccacaccccagggaccctctagcagccatccactctatcatgtccttttatgttatatggtggggacagtctccattttttaaacagcattactgaggcataattgacattccatcaactacacacctttaaagcgcacagctgggtaagttttgacatatgtacatacctgtaaaaccattaccccaatcaagctagtgaacaaggctccatcccttctagaagttctctcctgcccctatttatccctcctcccccaactccccatccccaggcgaccgctgatctgctcctggcaccacagattggttttcatgtcctagacttgtgtataaatagaatcatacaggatgtactctgcttcagtctgacttctttcacttggcatgattattctgagatttatccatattgttgcatatatccgtggtccgttccttcttaactgtaccacaatttgttcactcactgatgctcatttgggcgttttcagtgtggggctataatccatcaagctgctgggaacattcatgagcaagttctcaggtggacaaatgctttctttttcttggggaaatgccaacaagcagaagggttgggtcacatggtagtgaagtatgatttgcttcttaagcagctgcaatcaattttccaaaatgattgtatcatcatacattcccgccagccgagtttgaaagtcccagtgcctccacatcttggtaagttattattattattattgagacggcgtttccctcttgttgcgcaggctggagtacaatggcgcgatctcagctcatcgccacctctgcctcccaggttcaaattattctcctgcctcagcctcccgagtagctgggattacaggaatgctccaccatgcccagctaattttctattttcagtagagacagggtttctccatgttgatcaggctggtctcgaactcctgacctcaggtgatccacccgcctcagcctcccaaagtgctgggattacaggcatgagcgaccatgcctggcccctggtaagttattttaatcagccattctaataagtaggtattggtatctcattgcagttttgatttacagtaatgacgtcattccctaatgatgaatgacgtggagcatcttttcacatgcttacttgccatgtatatatctgctttggtgcagcatttattcctttgtgttattttgtttatggtgttttgttgttgttgtttttcttccaggcagagtctcgccctgtcacccaggctggagtgtaatgtcatgatctcggctcactgcaacctctgcctcctgggttcaagcgattctcctgcctcagtctcctgagtagctgggattacaggtgtgtgtcaccatgcccagctaatttttttgtatctttagtagagacgggctttcaccatgttggccaggctggtctcacactcctgaactcgtgatccgcctgcctctgcctcccaaagtgctgagattacagccactgtgcccagcctatggtaattcttaatagaatgtatttgcttgtgtattgtcttcctatttgtcacctaccaccaccactaggctatgagctccattggctggggcaggactcgcttgctcctgtatcccccacacccagaagagcacctggcacttgatggacggacgcaccattaatactgtggacagagtaaatgaatgaggctgaattctagctcccgctctgcctctttgtgtggccctaaacaaggttccccagcctccgtttcccagcttgtaaagtgagtcagaggtgttagattcaaaaaccttgaggagcctcccagctctggcttgttctgggttggaggccacatccccttctggccactctgggttttcccttaccctgcatcttccaacctcggcactgctgggctgtggccccccagatatcctgtcttgacaggggagggagtgacacttcttttgaatctgggagcctggaccccatagcccaccctgcagcatctaatcactcctgagccccagacctgccaccttagccagaggagctggcaccctgccgaggagttgttatggttccagagagctcaatactcctgcctgactgttccctaatccctcccatgccttccatacagaaccagagacccccagaacccagaactcctctctgctcccagaccatgagctccaagggcctctccaggtgaaccccattgccaggccaaagggttggggctgatggctgcaagggagggaggacggtcctaatcggtaacacatcaaagggaaagggctgacctggacactaaactcccgggttccagcccctgcacttccaccttgatgtgtgatctggtggtggtggggggcagggggtccctttggtgctgtggcctcagtttccctattagtgcactgaggaggaaggagatacactgttcccaggtccagtcagtgctggtacctagctacgcagtttcttccagtgtagacgccgcttggtttctcattcctctggtcatttttgtatcagttgaggtgggcaggggtgggggatcacgacggcggttatgggcagaggagggagtacagatgcaggagctctcagggacagaaggctgcccaggcagcaatgagactgccatacccagggcagcacgaagcccaggagttggctgcaagtacccagctggtctctgcagggagacacagagaaggtcacctgtgaagacctccacacgtgcaggaactgttgaaatagacatccatggcagccaaggagtcttttgaggggctcatgggggaaacccagggagctctggaggctctggtgcaggatgtctgagtggggctggatttaatggtgttggccccaccacaactagagttggaactgttgaggccacaggatgccaggccatgctcaagcggaagacagagaccacacccagggtcagggtcagggtcagggttcagcctgggctggagagcagagggcagggaagcagaccctcaagggatactcagaagcccatggcctggtcccagacacagagcactggctgggctgggctgggctggaccagagccctgggagagagagaaagcatggcttcacctctcactgccttgagccaaggaaacacacaaaggccttggtcagggaggaatggaaaggaggttagcagttggcaaatcagaactaaacagggtcccagcagcctgtgaggtggatcctgtggcttaggaatgcagatgctctggaagagggcagatgggagggaggctgcagagatatacgaggtcctgtagggtgtgtggagaggcagaagatggggaaagacgggagagtctgggatcccgaaaaaagggagaagaaaaaaaggaagtggccgggtgcggtggctcacacctgtaatcccagcactttgggaggccaaggcaggcagatcacttgaggtaaggagttcaagaccagcctggccaacatggtgaaaccctgtctctactaaaaataaaaaaaaaaattagccaggtatggtggtgcctgcctgtaatcccagcactttgggaggccaagacgggcagatcacttgaggtcaggagtttgagaccagcctggccagcatagtgaaaccctgtctctactaaaactacaaaaaaaaaaattggtcagacgtggtggcacatgcctgtaatcccagctacttgggaggctgaggcaggagaattgcttgaacccaggaggcagaggttgtagtgagccaagatcgctccgttgcaccgccacctgggctacaaagcgagactccatctcaaaaaaaaaaggaaaaaaaaagaaaaaaaaaaaaggagatgatgagaaagaaaacacagggccaccaacatgggaggagtgagaagtggggccgatttcacggcagaacaagccgtgagatgggagggagaggacagagacaatggaggggccagggagacagccgtcagcatgagaagcactgcagctgctctcagggacggcaggtgagcagggcccgaagggatagagctgaccctcgcgccacccacagatgcctctgtcgtcagctgggaacgcagagccctgatgaactgcagaaatgttttaaatgaaagtcttccaagcatcaaaatattgaagctgttgttgtctcactgtgggttagttgctatggagaaattcagccccagcagccactctaattagacgcccatgggagacaggccccaaatgggctggtttagggctggcctcagggaaggggttccccgcccagagccaagaatgggggacagctccccacctcccagccacatgtcctaaaaatcacccaaactgagtcttctccactgttggaggcatagagctggtagggaaactgaggcccagagaaagtgaaagccccgccaaggtcacagaactagtcgatggcatggctgagaccacatcccaagtgtcccgctctgggtattgacgtcttcccagcacgtagtctgtttctcttccaagaccccgtttgccaagcatttcaaagccagctccgtctcaggagtaagtcaacaccctaaatatggtgacttcccagagtggggccacgcaggccaagcaagagccagggactgtcctgggctgtggatcaggaccctggtgcttctccccaactcctctgcagcccagcagagcatggctagggagggtcttctctgctcaattccagaccgattctaccttcccatgcctgtacacctgcctgggtactcgtgcctctgagccttcaaggctgatctctgcctgaaatgtccacccctttggatgcccctttctttcaatcccaacgtcaacaatgctccttcctatgtctcatgggttggccgggaagagatgcagaggtcatttccccaccctccttgtccctcacctgaacactggcaacagtctttctaacactctggcactccctgcatctatgaggctcatttattttttctttcttttttttttttttttttctgagacagagtatcgctctgtctgcagtgccatctcggctcactgcaacctctgcctcccgggtccaagcgattctcccgcctcagcttccccagtagctgggattacaggcacccgccaccacacccggctaatgttttgtatttttagtagagatggggtttcacaggaccacctgttaaagggaacacatctgttaagggaatacacatgttggccaggctggtctcaaactcctgacctcaggtgatccacccaccttggcctcccaaagtgctgggattacaggtgtgagccaccacgcctggcctgactgttctctcttacaacagctggcacttttacttagcagcggcacttttacttagtggcgatggtccccattcgtcattgtattttcttggatgtctgcctctcctgcaaggctataagtatgatgagagcagcaatgtgacgactgattgccacaggatccctggcacctagcagagttcccggcacatgtgaggggttcagcaaatatttcaaacagtgaacagacgaaggctgagcccctgctcttggcacatccacaggatgggtaagtatggagtgtggagctgcagataccacgtctgagtggggagggatgcggacccccaaatgggatcttcttcttgaggcttctaggaaggtcacccagccagtgatatgagactggggttcactcacctctggcatcaaagaattcatcatctgagctctccacagagtcactgaggacatttcgaaggtgccagggggcaccgccgcccgggggaggaccacctgttaaagggaacacatctgttaaccaagcctgagatgttgtcccagtatgagggaggtgacccaagacccccctggactaaaggccagttagcatcctgcacatctgtgccctctccctccgaggcctcagacctcacagagccctccctctcctgtgctgtcattgaagctcaaaaacctctctgagtaagtgcagcagagcaggaatgcgtgtgcccattttccatgtcctaacactgaggctggtggtagttatgagcctttgccaaggtgactttgccaagcagcgtctcagtcagcacaggggaagctctgctgtattaacaaatgagctcagacgtttaaacatcaatggttcatttctcactcacatacaggttggaagggagctctgctcattgctgtcactcataagtgccaccaccttacgatgtcaccagcccaaaaggagacatcaagttctggccaagcaggggagaagagctcagaaaatctcacctagtcttaaatgcttctgcccagaaatcacacacttctgctcgcatttcactggccctgactaccaggcacacacgtcctgtccctcagagacctgcattcttgtatcagcaatgcccctgcctcagtttttccatctgtacaatgagaatcctggcagagactgtcctttgaaactcttctactctgactgatattggaggagcccacctggcccacagtaactgacaataaacaagcatggggcggggggtggacatcctccctagccactgccaggtgagcctgatggtgcagtccttcgagatacctgctacagtcccagttcaccacaccccctaccctgcaggatgctggcactgttccctgccctgagtccagatcccagagcataaactgttcctgaagggagacggtcagcccaggccatccagggacacagccctcctgcctgtcgttcctgcctggcccaccacaaactcccaaacacacacccagtttgtgcttcatggcttggagcccagtaagaagcacattctgagacatcaaaaggacagagggtacagtgaacaccaactcggtagtcacctctaggtacaaggctgattccctaagcttctgatcccctgtctctaccagtgtgagctgacgttccaccctcgggccctggatttactgcaaggggggtctgagagttcagatgcaccataactgtgtgttcctaacacagatatgggacgattttccaaatgtatgtggaggacattctagctattgcaataagacaagaaaaaagaaatgattggaaaggaagaaataaaattgtcttcattcccagatgacataattgtctatgcagaaaacaaaaagtctacaaaatctatattaaaaaaactaccagaactaacaactgagtatagcaggattgcaggatacaagatcgacatgcaaaagtcaattgcattcctagatacaagaaatgaactgaaatttgaaaatgataacgccctttaaaatagcgcacacaaaatacttaggcataaagcaaatgtatataaaaatttctgtgattcaaaaactacaatcacttaaaattattcctgaattatatcaactgtatgttttctcaatcaacagatactaaaggtataaaatctatcatatctactacatttgcatactatgtgaatacgctagattaatatacagacatcccttgctatcccagtcttttccgttcctaagaagtaagaatttggatagtcagcaaagtcctattatccccatctgttcagctcctgagttttagatagtaagaagcaagagtttaagtagcaacaaagtcagctgaggatttatctggatccatttggctcctgagtttgaacagcaagagcccagtgagaggctcctctatgcggtggcctcatacatgcacggtttagatccatccgagaacaaaggcagaggcattctctctgatgacctgtgcaggggtcccagcaggaggtctggggcagagggaaaggctgcagggaggccagtcagctccatttgagggagcaagttctcccagctacaggtgagcagaaaaggaaggggctggtaggcatcaaaggggcctctcattccacagacactgtgttgggaactgggaacactgtggggaatggacaggattgggtgctcgcaaagcttacattctgcaggcggggaaggaaaagccagcctcagtcaaataaacaacccagataatttcagcccaaaacctctcccttcctacactatgtcctccttcctcaagtgtctcttatgtgataattacagcctaaagaacagacagacttgaatgtgtggatctgtacttccgtggggagaaaatggttggggaaactcagcctcagacatcaaaagaactttgtcacctattgtagttataaatgctgaactaacatgatgtctcccttttattattgcggctctcttttgtggttaaaatatatattcttttcaaatgcatattttatcttgtttactattattctacttgctttcaaaatgtatacctgccttggtgttttgttttgtttttgaaacagagttttgctcttgtcgcccaggctggagtgcaatggtgcgatcttggctcactgcaaccttcacctcccgggttcaagagattctcctgcctcagcctcccaagtagctgggattacaggtgcctgccaccatgcccggctaatttttgtatttttagtagagacggggtttcaccatgttggctaggctagtctcgaactcctgacctcaggtgatctgcccgcctcagcttcccaaagtgctgggattacaggcgtgagccactgcatctggccccgccttggtttttaaatgtatactggataccaggtcttccctcccctccagcaggggctgcccaacaaacttctggaaaggtgttggggtgcagggaacctcagttatatacctgcaaaaacagatatgttaagatggaacatgggaactcttccctgcatctcttcctccagcatgcagattttttggcaaacaacaaaggtcgtatttccaacaaggagaaaagcaatgggcagtgtctcaggaggggttagaggggaagacctttgtggaaaggtgtcaggcaagcagaggcctgaataataagaaaacccagatatgctaagagtgtgtgtgtgtgtgtgtgtgtgtgtgtgtatgcacatctgcttgtgcacatacatgtgtgggatggaccgggcaaaatccatggataagagccttcctggatgaaagaactgcaagggtaaattcccgtatgagcttggtgtgtccaaggggcagaaagaaatccatgtggctggggccaatgattgaagggggacaggaataggggaaatggagcctgaccaggtagggtaggacctgtcatggacggaagcttggaacaggtgagttttaaggctcctcccactgccaagcctctatcacctgcaaacttcaagaggaggggaatacagatgctgaagagtgtcagaaagtctcctgggggaggggaccacaagtcagatgtgctagaggccacctaggttcctgagagtcacagcaggtgggcatgacgaccccagaacagcaagggaaaggctcagaagcagtgtccttgaggtgggtccttgccctacacttccctgcattttctgggtccaacacaaagtcccacacagaagagggccaggaagtgtttgacaaacaagtaaatgaataaaaatgatttgcttggtgagtgcggcatgccaggcagtctgctagctgcttttcagacattagctaaagtcatcctaaccaagcctagcaaagtagacatactgaatccccaccttacagctaagaaaacagagcctcagggatgtttcaggaaggcgtttgctctgcggaagagatcagggcgggggacctcagtctcctcctctctccattgcccgctctcttggaaatagcaacccttctacctgtttctggccagctgggcaaggggccagaggcctgcccctggctcctcatgggggccctagccctggggggctcagctgtcccagttctagaaccatctgcccatcaggtctacaaatcagtgtctgggtatccttgtgtctgtgggaaaaatctaaatggatgtctacattcctgcgtagaggtgtctagtgttacacgagcatctgtccctgtgtctgcttggctgttgtgtgtgtgtctacattccttggggagtgtgagcttacccacttgccagcccccttcctaatattgttcctaagaatcatgcatgcatgcacactcccataattctctccctctctccctcacacacaaagtaaatcagctccagccatgggtgaaaatttagcagaggttagaacacgggctttggaacaacacaaatctgggtgcagtgttaccagtggctaatctaggacctgaagcaagttaacttcactgagcctcacttttctcatccggaaaatgagcatcataatacttaccccactgttaggagatttaaatgacatcagcccccagagcgtctagcccactgcctggcacttggaaatggtggccttgtcagcgacaggaccaaggattgaggcagggtaagcccacctgaggggcttccaggcagctgccaggggccctccccaaggcctcagagctctatctgtgtcctccaaggcccagcccacctcctcctgaagaccctccttccatccaccttcactaccacatttatttatttttattttttgttttttaattgagacagggtcttgccatgttgcccaggctggtctcagactcctgagctcaagcgatctgctcacctcagtctcccaaagtgctgggattacaggcgtgagccaccacacccagacctacatttatttaaaatgttaagtcaggatgaaagagaaggggaatatcccaactcttcttctagcaatttagagagaaacaaatgacccttcaccccagcaatgccagcacagctccgagctgggccgctcagtgggaggggctgctggaagccatccccactccctctcctggccccgatacccaccacctcaggtccagggtggtctcctggaccttgtcatgggcctgggtctccctagcatgggtgcagccaaagactctgctcagatcgtcagctcctcctggccatctttcccactcagggacataggactaggtggacagagagacagacaggcagacagatggacaggcgtctcctatgtgtgttctgctctatatcagggaccccaaggcagccccagccccaggggcagagtcctcaggcgaagggagatgcctcccccatgctcaggagccctgtctgaggggaagacatttcacagtgaggaacgccctgaccgtaagatgcagaacaaaggtattggccgatgcttactgggccagaccttgggccagatggtgccaggaaggaaggagtagggggcagagctgaactggaacagtccctgccctcagaaatgccagccctgggggcacagccctacactgcttcctgcacagagcacaggaggaacagaggagcagacgtcctggcccgtgtgaaattccacacccaccatgtctgtcccgcggcaagtggaaatggtcctcccagaagcagggactggctagggtacccagagggtttccgggggaggggaagccaagatgagcctccaaggaaggggtgggcagggttggccaggctggggcaggtgggaggaagggagagacacaggccaaaacaatcgagccctttccaaggaaagctggatctagaactttctcctcaagggtaaggagcatcggggcaaaggagggcacatgggtgtctgctggcagctgtgactccagggacattcagataacacgtgcaatttccagacctccagggaggaacaggtgcccctgagcgaggccctggtgggtgcacagcattgggctggcacctgcacctactggcctgtggccacagcttctaggcccagccctgcctacggctatatcagaaactgcagcctgccaatgctggatggacttaagcaatctgtgcctcagaagaagaaagggaggccaggcatggtgccgcacacttgtaatcccagcactttgggaggccaaggtaggaggattgcttgagcccaggagtttgagaccagccacgtcaacaaagtgagaccccatctgtacaaaaaagtcaaagtaaaaaaacaagcctggcagggtagcatgtgcctatagtcccaggtactcaggaggctgaggtgggaggatcacttgagcccagcaggttgaggctgcattgagccatgatcatgccactgccctccagcctggggaacagagtgagcctctgtctcaaaaaaaataaaaataaaataaaaaacagaaaaggagaggagccaagagtgagagcagtgcctggctgcagggctgaggctcatttgaatggtgtctctctctctctctctctctctctctctcacacacacacacacacacacacaaatacacacatacacatacacgagaacagcaggttctacaagcacaagcatcagggtctaactcctggcggctgatgcagctgaaaataatcaggccttgggatgtcccatgggcagtgggagccccgtagacacatagagcccagagcacacatgtggctcatgcagccacacacacacacacactcacacacacacacacgcacacatgcacttagaatcacacttcagtgctctcagctctgccttggggtccctggggtccaaacgcagaatgtggagtgcagtgcttcctacagcctggccgaggctcctgcggacaggcaggtgactgtcaagccccgcctcctccgtgcctcctcctccctcgaggaaaccaccatcccgctcccacctgactgcttccagccccagttctgccacttaccaattcgtgatcttactaaatgacaggaaacccttctgtgcctcagtctcctgctctgtaaaacggggaggataatcatgcttacatagtgtcgcagtgaggattacatgaacaaacatttcaaaacggtttagcagagtgcctgagactccatcagtgctataaaagggcgtgttaaataaaataataaattgtgattctccaagagcttttctttggttctttcatccgtggcaacttccaagggcagacccctctccttcttctcgggcccctggaatgggagcctcgccactccccaaaggctggaaatgcttgcccctgcccacgctcgtgaggccaatccccctctcctccctcccatcgcaggtccctggggcttgccttgtctgctccctaaacttgaactactgcaggccaggacctgctctcccatcccagcctctccttccagcagcctgggcttcagcagcacattgccaccagtagagccttcacaccacgctcctcttcctctccaggcctttcctcctgcaggtcctgatgcctgaaacgtcttctatctccccatcccacccccaattcctattgatgcttgaagcatcagctggaagtctttcttggcccctgaggccagcccgggtgcctgtctccttgtgggtccttcatgtgcagcacctgtgtccctcagagtccctatttacagactgggtccaggcctgcctgccccattgggctgtgggttccccctgagcagacacctggtaggaatcctctccaggctcctatcctgtgccaggtcagggctgggcacacagaaggctcttgtcaggctcagtgtggcccagcagaggggagatcttagcaaggccccctctcaggggagcatccccgagggaatgtcctcaggcttcctctctggatcagggtgaatttggagaccagaccagtccagggccagccagcctatcctcagccttgaaggggggctgtccagggagagatgagaggccaggagaagctgcttccagaaaaaggcattattgaaggaaaccagtactggttgggggttggttgctatagaaacatgtcctaactatctcccaaactgctatatgtgccaccgatgagctcatgtgctcgtctgtttcaggggacacgccaggagccctggaagggcctatctgcccgagtacgctgcatctgaagccaacatcctggagaaccccggaagaaatccagcttccagggcaaccagaggggatcatccatccatcggtaatgcacttaaagactgaggctgacttcagattgcagaactgtcctgagaacagctcaggtctgagactagccgtggcccaaacctcaacctcaaccatggcctcaactttcagtttggccatagaccgagttacaaccatggccacaggccaggccacaactcctgtctcaaaccacaccacgaacctgaccacagacccagcttgactcagtcacagagcaacaacactgctagccaaagactaagccctgaccctggccacacaatggcacccagcacaatcaagggcttgtatcaaataacttgaaggatatgttcactctaaagtctgtacagggcagctgtggtggctcacgcccgtaatcccagcactttgggaggcggaggcaggtggatcacctgaaatcaggagttgcagaccaagctggccaacagggcgaaaccccatctctactaaaaaatacaaaaattagccaggcatggtggcacatgcctgtaatcccagctactcgggaggctgaggcagggagaactgcttgaacccgggaggtggatgttgcagtgagctgagatcgtgccattgcactccagcctgggtgacagagcaagactccgtctcaaaaaaaaaaaagaaaaaagtctgtacagcattgcatccggttgcctgggatttccacagcctctgctgcctgtcgtcttcacgatagcccagggaggtcagtaagaaaggactcacgattcttgttgacagatgagaaaactgaagctcagaggagaaaactgatgtgcctcctgtcatgccgcctgtttctaggggtaaggggagtctccaagcagggcacagttggccaaaccagttgctttggggaaaatgtgctttttgaagacctgctggtatgtcataaatatgccatttaaatacccattaattaccttatttaggagataattagtgattaatagctttggctatctattgtactttcatttgctctgccaattaggctcccaacagttctgaattatttggaacaattctcccaaggcccagctgtcccccctatgtcccgccagactcttgttccataaggaggaggctctctcctccctctaaaacgagttccccgtagcacctgccactgtgccacaacaggctctgccacctgcaggctccccaggagggcagcccgaaagacaggacagcaggaggcattccttctgctcatggcaggacccccttgcagagagctgagaataggggctcaaggtccaggcacctacccaggcaacgggaggccaggttggaatcagactcctcaaaggacgctggggtctcttttcttttcttttcttttctttttttttttgacagagtttcactcttgttgcctaggctggagtgcaatgccacgatctcggctcactgcaacctccgcctcccaggttctctcctgcctcagcctcccaagtagctgggattacaggcatgcaccaccatgcctggctaattttgtatttttagtagagacggggtttctccatgttggtcaggctggtctcaaactcccaacctcaggtgatccacctgcctcggcctcccaaagtgctgggattacaggcgtgagccaccacgcctggctggggtctctttcaaagaccaccacctcaatgaaacgaccagctttttgggaagtgcatcaaaggctgccattagcctggagcaaacagtaggagggtagcagctccccaccccactccatgccagcaagagccaatgtgaccccctgcaggtgatccgactcataccacctgccactgctggactgcaactgagcaaagatgggacccaaggttgcctctgcccccaggcccctccatttggtgccaaagcacagtgccaggaattgccagccaaagccccagaggcggagctctcatcactgctccagattatactatataagaaggaaacacagaggctgcgaggggtaaacacacacacacacccgaactgggcagtaatgggaaagctgaaaatagctctttttaccacaagggatgactctagagttgctcggctgggactagcctcacggggggcaggaagtaggagcaaggggaagagaaggaacccacaggggcgacatcagggccaaaaggagttctgttgagggtagtaatctggatcaacccagaacaatcagaaaaggtcaatggtgcatgagtgacgggcagccacagacactcagactctctgaaagacagactctagaacaagtgaaagccttccagctgtcagccccgagagctcacagtcccacatcctgcacacctaggtctctccccaaggagggcaggagtgcaggacgtgacgtgctctgcaaatacccagagccaggcaaacacggtgtcagcagcagacagctcagaagaggcctctcagatccaccagaactcaacgcccctcccagacagagcccaacgcgtttctatttttgctttcaacccttgtttggcatccctgctaccagctaacagacggttacttcccctccttccagaagaatgggtcatctgggaagaggaacacctcctctctggcctcccatgtcccaggtcttgtaataaacaggctgaccctcccaaagagagatgaggctcccaacacccccaggaaccttcccctggtaggtggttcactccaagctgtcctgctcaccagccctggagaagagcttctccaggacacctagagagagcagcttcacaaaacctgagactcctgctttccagaggcagatgcaaccccccgcagccccttgccagccctggccacacggactacaccccatggagccccaaattcactcacactgtgccaactccagccacagactgaaccccaacatgccacactctgcaccccatctctagcctcaaatcaagcactgacagtgaccacacaggcttccagcctggcccaatctgagctgtggccccatgaacgtgtgagcctcacaaatccagccctaggagagcctggaggaagcaggttggctgtgtggggccccagtgctgggacccagctcccaccccagagtcatggacagaggaggcttctgccccctgtctacccttgccacacacgcaccctgtgggggctggtggccacacagctgtgcaggcctccacaggcacacgtgggaccctggaggtggcatttacctccggagtgactcactaagcctcctattccatttgcaaaagggggtgcaatttagcattttctttctctttagaaaacaggaattttaaaagagagagagtggagagagatttgagggagtgggtggggagctcagatctcatttgatttccaaactcatttgttatgcattctctcctcccccctcccacaccgagcccttcccctggggaccctggccacccccttccgggctcctggctgcagacctggtgatggcctgccaggaggcacgtgctctccacgtccacgtcctcagctccccatggaatgactgaccctcaagtctgggaggatcaatgcaaggtcagagttgagagggggcaaggcctcttcaggacacagtaaaacccacagccagggaggctctctccaaaaaggagagagcagtgttggagctggaaagagcctgaagctcatcctgaccctcaaactcttccctttcacttttacagataaggaaactgaggcccaaagagggcagttcaaggtcaaccagtgccaaagccagggctctccttcgttagacaagttagctcccaggaatattgactccaacagtagaagagacataagctctaatcccagctttgcctctaactttatgtgtgattctagccctagatatttaaccctactgggcctcagtgtctcattcataaaatgggaataacattggctctacctcagagatgctgttgagccattggacagaaaagcatgctgagagctgctataggatctgagccaaatgggtcccagcatgcgaactcccgatcctaggatctcagaattcctggaaggcagctgggtcctaccaggaagtccccagtccctaaagcctccatggtctctgaaagttcacactctgtccttgaaaggggaaaggatgccggatctcaaagagggacccttgactgaaagggtctggtctctgtctcccaacctgcttaacaggtagaacaggagaaccaggccacctccagccatgaagtctcataacatatgaagatgtatgtgagaaaacatcacagcttctggccaatctgacccagacatggcccaggcaagtggctggggcagggacactgtccagccatgtcctcgtattctgtgtcctgccacactggacttccaaacacaggtcaagtcacagaggcctcaaatgggggataaggggttccaggcccagggtcacaggcttgaggtggaacctctctgtttgagctgcaccatccttggctcaaacaaggacaccacagccagaactgagcggcaacaaacgtctcaggctgggacctgccaggtctgctgctgggataggtgatttcacagaggtcggcgtatttgcataggaacgtgaggccatccaagttccagcacaccccagactgcgggaaagcttttgaaaagcctggagtctggccaggcacggtggctcacacctgtaatcccagcactttgggaggccaaggcaggcggatcacgaggtcaggagattgagaccatcctggctaacacggtgaaaccccgtgtctactaaaaatacaaaaaattagccgggcatggtggcagtcacctgtagtcccagctactcaggaggctgaggcgggagaatggcgtgaacccgggaggtggagcttgccgtgagctgagctgagatcgcgccactgcactccagcttcggcgacagagcgagactccatctcaaaaaaaaaaaagaaaagcctggagtctggacactggtgtctgatttgaccatatttgaccataaccttcccattggggaccaaagaaagtgagtttaccatctccttgcaggatgcaatgcccgtcccaagatacacagtagagtaatcggtgccctagggctgggagtttctcagagtcatgcctcaaatcctctggcacctccccaaagatttaagaatcccagcgttgtccaggtatgatggctcatgcctgtaattccagtactttgggaagccaaagcaggaaggattacttgaggcccagagtttgagaccagcctgggcaacgtaatgagacccccatcgttatgaaaaaaaaagtattaaaaaaatttttttttttttaatctgcgctagtcccctttccaagcttccagatgtttcctcctctgagtgatccagccactagtcactgcccctgggagccacagagtaaggggcccaggagaagtctcgctttgggaggatgtgagagcacacgccccactccaggaggaccccaaaggaggctgactcagcagagcaaggtccaaactctggaaacccaggctctgccgtcaccttcttctgtgacgttggccaaatacctacctctcacgggccctcagcgacccattgttaacgaggacttggaacatgagtatcgaaatgttccctcccatcctaacaccgtaggatcagtactttactgactcaaattactaggtttgccacatggaagcctgccagctacacccctcagagcagaggctaacacctgagaggagaataaactggttcctccagcctgggaggcccaaccctgtggcctcggctctgtctctgcagatattcctgccccagcctgagaggtgccaagaccctctaggctgttcactctgctcctgcctaacctggggacctggcccccaccccctaccctcattctctcagtgggagagaggggcagcctgttggggtgcagagggaggggcacagggaggtagacaggaagggaggggcagtgtggctggcaggagtcagaatcaacccttcccaacaaaggcagctccaccaggctggcctctctccagcttcccaggagccctggcgtcccagccagagggatctgtcgaaacacagtgccaagtcttaccccggcactcctgtcttcatgctctttggagttccttttagccctctgcattcttccgctccagccaggtttctttacttttgggcacttcctacccaccttccacccctacccatagcagtcctcccacacttacacatgtgcctcttcctttccatcctcctagcctttgttcaagccactacccccacctggaagccggcccctggccacctttctttttcttttttttttttttttttttttgagacggagtctcgctctgtagcccaggctggagtgcaacggcacgatctcggctcactgcaagctctgactcctgggttcatgccattctctcgcctcagcctctcaagaagctgggactacaggcgcccaccatcacgcctggctaattttgtttttgtatttttagtagagacggggtttcaccgtgttagccaggatggtctcgatctcctgacctcgtgatctgcccgcctcggcgtcccaaagtgctgggattacaggcacgaaccaccgcaccgagcccctggccacctttctatacaaactgtgccagcctttagggcccatctcccagagaaacccagccttcactgtctgtctcaagccactcactggcctctctgctccgtggggagctctgtactgtaaattgtccctcctactcagagcttctgaatcctccccacccctgcccccacctccctgttgctggttagactggggccaccataaatgatgcctttctgtgtaactgaaatctcccctagagattgagaactggtaataacccatctggattcaccttctgaagatctatctcatcctctctgggccccgataacaatttctcttgtacctggattctcctggcagtgtaagagtcctttcactgcctccttttagctcttgtccgacacaagccatgccacaaatctggcacagccatgacctgctgctcaggctgtgcactgcacaactccaggggtattattcactagaccacacgtgatgacctaaagtcaggtaccatggcagccctggggcccaaagctctgccttttctctccgtgggtgatctactggccagattttaaagggaacatctcacaggtcatggtgcagacccctcattcacaggccgggtgccacagcctccactcctggccttcagcagccctttgttcctgtgtcaccccccgccgccccaccccgccagagtgaaggcctgatcattcctgcccatcagtctgcccatccgaggcaggtggtactgaacagccaccccgctctctatgttctccttgggcctcagtttccccagctgtgaagaaagagatgggttcctgatctccaagggctccctctgttctgaagctcaccaatctattcttcacagatgttgccaatgaggaatatgtgattctcatacacacattactgtgtgttgtttttgattcagtaggcttatgagcatcaagaagagaagggagaccaggcgcagtgcctcacacctgtaatcccatcactttgggaggctgaggcaggcagatcatttgaggtcaggagttcaaaaccagcctggccaacatgatgaaaccttcgtctctactaaaaatacaaaaattagctggatgtggtggtatgtatctgtagtcccagttacttgggaggctgaggcaggagaatcgcctcagcccaggaggcggaggttgcagtgagccgagatcaagccatgccctccagcctgggagacagaccgagactccatctcaaaaaaaaaaaaaaaaaaaaaggagagaagggacatttacaaaatgcagaggagcctgggagagctgagctgagaagggagaggtaaccagactccttgggatgactgctgagtgtggggggcaggagcccaggcactggatctacagacacggggaatctgtgttgcctcgagggaaagggccaagcgtgaaattgcagcagaaaaaaaccaaaatgttagaacagcacaaggcattgatgctcagagcagggcagtttttccacctgtcactggaacaaattcccacagactctcagcccagggaccaaaggacccacaggctaaggcagagggactgagactggcacccccatttggtaagggggtgacctatcagggcagtgacagagagagtccttcgagtccaatagacctggctgtgagtccaggctctgcccagaccctctaagccaccttgaggctgctatttctctgagtatctgtttctagatgttttaaaagtgggagagtcgcatttcctccctcccaggatcacggtacagtaaagagcttagcactctgcctaatacatagaacaagcagcaaatgttcactgccgttgcgatgacagtgccctggcaggtgacctgtgctcaaggcgtcccagtgcacacacacactcacacacacacagggtagggcagcagatgggacacacgccctgccacaggccattttaaggagtcggggtgggtgaggacccaggcacggtggaggaaagagggaggcaagaagcctttttcagcttccttggtgtcatctcacagtgcctccctcaggaggggaaaagggaggggagtgagaaggctgtttagctgtgttccatactggctgtgcctcacacaaccggccccaccccgacaggactccttggggacagaacgggagtgcattctcaggcacctaaatcttacaggctcagtgcctgcacagggagacgggtccgcagcccagggtcccgggcagctttcgggcttgggggtggattgacacacagcccgatggtattcacacccattccttcactgtcgcgcccggtcctgggggacggcatggcaccagccaacgtcacgggttgggtgtgagttcatggtagattctcacacgccagcctcacaagaggcactgccgagaccaggcttgctgccgcctactgtatggccggccctgtgggcacagctgtcctccacccgcctcccaaggcaccatcgggcccagaatgtgcccgatgagtcacgggcctgggtctccccagcatgggcgcagcaggggggctgagtccgcctgagccccggtgcccagctcagggtctggcacagagcagatgctagtgaatgaacgtcgggctggatgaatgaacgaatgactaatgcccgctccctcaaaccacaggctacaccgtctgagcctgggggagggcagagcccacgggaccccagaagaggcctccgcagctgaggctttgcgtcccagggtcgatgggggagggggcggggcggccagcagccggcgcggcacggggctcccctccttcccgagaaggaatctgggtctctggactgagctggtgacgggggctggggcggggggttgtggcgtcctggatggagagagctgcaggagcagggggcgcgtcccggtttgcgttggggtgtgggacgaagcggcggccgcgggacatccccttcggtggcgaagcccgggtctgcccggggcctccgcggggtgcagagggctcccaacggcgggactggcccggggcgccgcagacctggccctttccggcggggccgtggagaaggggacgcggtgtcccccgaggtgaccgggggcgcaggaaggacggggggcgcgcggagccccctctccacgcgcgggaggtccagccccgctaccgccccctacgccctcccgggacctccgcccacctgcgcgaggggttcacctgggccggcggcccctcctctagacgcgcgagtccctcccccgggccccggccctgccctccccgcgcccgccctcacctgcacggcccgccttggccatgtcccgggcggcgggctccggcggcgctacgcgcgctcctcgcgcttcccgggcccggccccgaccgcctccggccccgaacggactccgagcgccgcgcccgcgcccccgccccgctcgcctcggctgccgccaccgcagccgccgccgc

SEQ ID NO: 2171 - DNA, 105296 bp, Homo sapiens; identical to SEQ ID NO: 2170

SEQ ID NO: 2172 - DNA, 319984 bp, Homo sapiens
tcccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgaggtaagcgccgcgcccggcccggcctcgcccgctccgggacccccgccgctaccgccgcctcctggccggcgagccccgggcgagcggcaggaaacccaggtggacgttaccccgcaaacccgaagcctggaggagaggagggaggggatttgcggcttccacttgtcaccccagcgggggagggcggcgctgggtggggcggcggactccgggtgggcttttcgggggcgcccagaatccagactgttggggatcactatgagccaaagggagtgggtgcgccccctccctccaaataagaaaatgaataaaccaaacccaagagcccccggcgcgcgctgtagctggggtttggggggcatcccgtcctggccgtgggcccagcctcccctccccgccctctgcggtcaggtaggggtgcgaggaggagccctgcgccctcgggatctgcacgccccgagccccgcgggaggaacctctgagcccttaggggaggtccctgcggggcccgacttctcgccgtcgccgcgggcttgggcgcagctcccggcacgtccgcccttcgaggctcgggacccggctgtgtcctttcgcaaaccgcctggctcggaaactttctgcgtctcttgtttcttccgccgcggggagcggcgcgcgagccgggagcggcgggggctgcgacgcggccacaggagggcgctccagcacgtggtgccggggccgcggctgccggctgggggcgccgggcgcggggcgggggctcgtcctccaagcgcggctctgctgtccttctcccgatcctgcgaagccgcgagctccagtattcaggaagtggtgactcagataggattattccggccccggcttccctttcttccccttcttcctccccacctttgtggtgattccacgactgctgagcgtctctgtccagggacagcgagggagcccaaagccaagcaaggcaacgtgaaactcactagtgtggtttggtgtggcaacacacatgaaatcagccacccagaccgtctttatatttaaatctggtgcctcgaaactatcagatatgtttttgagccactacttggtgagaggggcgatgtgctttgggagagaaaaagatgcataactgagaacatggctgagctcacaggggctgtccgtatttgccatctggaccaagggttaaggtaagacccaagtacaatccaagacaagatcaaagtagctgcaagtttacaaaacgcatcacggggacacaggctgccaaggagggagagatcagcttccaccagaatgaacaaccgagttttggagttcgttggcatttgaggaggtagcatttaagcagggtctggaagggtggatgccaggtgggtagacagagattcgagttgcatatgaccttgtaagtggagaagcaggacatagctttgtggagaaagagaagggcaaatgaatgggactggttaataggagtctttccagaaaaggtggagattgtcccaccttgtgggcagttgagctagagtaattcagctgggaggcatggatccctctactccatatcctaatgaccttgttttttgatatgagtttggattctaggagcaatgttgggactgcatgaaatacacagaaaattgcaggtgataatcaagaaaagaaccagttctagaatcttctctactaactacaaaatctctttatcctagttggttcccttttcaggctttctgaaacactcaggcagatgcttttcccacttttgtttttgtaccgaaatacccacaggtataccgtggggtaattacatttgaatgatataggtggaggcccttccttccttccttccttttttttgtcttttcttttcttttttttttttttgagatggagccttgttatgttgcccagggtggggcgcaatggcgagatctcggctcactgcaacctccgccacctggattcaagcaattctcctgcctcagcctcctgagtagctgagattacaggtgcctgccaccacgtctggctaatttttgtatttttagtagagacggggtttcaccatgttggccaggctggtcttgaatgcctgacctcaggcaatccgcctgcctcagcctcccaaagtgctgggattacaggcatgagccactgcgcccagccagcccttcctttcttaattggccaacaaaatcagactcatcagactccacctgtaatataattataaattctttaatgtataattcattttggccaaagtatgattcagtttctgtaaggttcatattctgaagtcattttcggctttgtcagagaagcaggagggcaatttagattaatagatgtttccaattagtaggattcagattagctaaatctgatgatggatgaagaaatgaggcctagtttgccagatgttaaacccctagagtcagaactgatagtaaattccacagtctccaccatccccttttccactgaccctttttccacattgaaaatgaggaagcaacttgagtttctttaaataagatgtttaggtaaactttggaagcctaactttttttttttctttttgagacacggtctcgctctgtcatccaggctggagtgcagtggcgtgatcctagttcactgcagcctccatctcctgggctcaagtgatcctcccatctcagcctcctgagtagctgggacaataggtgtgtgctgccaacccggctaatttttttactttttgtagagacagggactcgctgtgttgcccaggctggtcttgaactcctgagcttgagtgatcctcctgcctcagccttttaaagtgctgggattgccgggtgcggtggctcacgcctgtaatcccagcacttggggaggctgaggtgggcagatcacgaggtcaggagatcgagaccatcctggctaacacagtgaaaccccgtctctactaaaaatacaaaaaaattaagcaggcctggtggcgggcgcctgtagtcctagctacttgggacgctgaggcagtagaatggcgtgaacctgggaggcggagcttgcagtgagctgagatcacgccactgcactccagcctgggcgacagaacaagactccactcaaaaaaaaaaaaaaaaaaaagggctgggattacaggcatgagccactgcgcccggcctgggagcctaacttttgcttccactcttggttggctctgggcctgattcaacctacatggaacttctggaacttgtttctctctcttttttttttttttttgagacggaatctccctctgtctcccaggctggagcgcagtggtgcaatctcagctcactgcaaggtccacctcccgggttcacgcgagtctcctgcctcagcctcccgagtagctgggactacaggcgccagccaccgcaccctgctaattttttgtatttttagtagagacggggtttcaccgtgttagccaggatggtctcaatctcctgacctcgcgatccgcccgccttggcctcccaaaggcgtgagccaccgcgcccggcctacttgtttctctttaatcaccagagttcattggtagcagtgtccatacttttgaaaatgaagcaaatgctcatgctttgaagaatcagtgagagaacccacactttgcctgcttcttgtgcctggccttatcccttctccctcatttaacactctggtggtggcgggcggtggagcattagtggcactggtgtgttattatctatattttgcagatgaatacattgagattcagaagggttaggtaatgtgctccaggccacacaactagttaatagccaagccagaaggagagcatggtgaaacccattatttgtttttccttactctgctttttgcctgtcactagtgtttaatccagcaaaaggaaaaacatttcttgaaaacagataaagtcagcactatcaagtaaatgaaaaatcagaggccttttgacttgctatagacggtactggcctctactatttctctagctttattttaacacataaaatgttctctagttccaggaaaaaagaacagctctgggcgatcaagaaaataaagctgaactactgtctagattagagtgttggtggggttttttggtgtgtgtgtgtgtgtgtgtgtgtgtgtgtgtgttttagacattaatttcagagtaaagaattaataaaagtaacattccatagattaattttaattaaaacatttcattggaatagtccctcgtttgtgttaaatgtggtggtctctgaactcaatataagcctgttggaaaggtatgaacaggaaaagttcctgagagctgagagttgctatagagagaaagttgtcattatcttcatttgaaacatttggtagacgtagatgtagattctagagtttttgtttgtttgtttctttttctgagccacactctctcgctctgtcgcccaggctggagtgcagtgggatgatttcggctcactgcgacctccaccgcccggtttcaagcaagtctcctgcctcagcctcccgagtagctgggattacaggcgcccaccatcacgccaggctaattttttgtatttttagtagagaaggggtttcaccatgttggtcaggcttgtctcgaactcctgacctcaggcgatccgcccactttgggctcccaaagtgctgggattacaggcatgagccactgcccccggatgattctagagttttagacttagaaggcgtattggagatgatttataattgagccatttatttatttatttatttgtttgtttatttttgagatggagtcttgctctttcacccaggctggagtgcagtggcgcaatcttggctcactgaaacctctgcctcccgagttcaagagattctcctgcctcagcctccagaatagctgggatttacaggcttgtaccaccccagccagctaatttttgtgtttttagtagagatggggtttcaccatgttggtcaggctggtctcgaactcctgagagttcatgcccggtgagccatttcattttataatgaagtctagacctgtagtaggtgcagttaagttgtctacctcattgacaaactctaggctagaaccaggtctgatttaaggctcaaggctgttctactatatggaattctccctcctctgagattccttggtggaagaaaatattctcctgaggacccatgtgtaaagcaggtacactggctctactctctagttgaaggtggctggggactccaaccttgtgtctgcttagcgggacacatagggtagccccattggaacctattggaagggtggcccacctcctcccgcagccactcggtcccagtgagcgacctgctcaccaaggaggctccttggagcacagtctgaagatcaccctgcacctgccaccctcgccacagaggtacttgttagtaaaatgagcgtctctcaagagacgctaagcacatcctaatattatctaaggcaggaatccttttgttttcattgctttctttactgtttaaccgttctggccaggcgcggtggctcatgcctgtaatcccagcactttgggaggctgaggcgggtggatcacctgaggtcgggagtttgagaccagcctgactaacatgagaaaccccgtctctactaaaaatacaaaattagccaggcgtggtggcgcatgcctgtaatcccaggtacttgggagggtgaggcaggagaattacttgaaccagggaggtggaggttgtggtgagctgagatcgcaccatcgcactccagcctgggcaacaagagcaaaactctgtctcaaaaaaacaaaaacaaacgaacaaacaaaccaaaaaccagttcttgtttaacagttcctgttctgactgcattcacataaatgtgtatacttttagggattgatttgtggtctctagggatatggtgcacaatgcagaaaaatagaaacactcccctcccctccgagaaaagagaaggaaaggaaagaaaagaaaaacaactttttcatacagaatattattttcttttttgccctggcagggagccagtgcacttcatccaggcacccccagggtccccagagagttttcttgcgcacatttctgagaacggatttgggatcagggtggtgctgcctctggaatgacatgaatggaaatgccaaaatgcccaacagtgttccttgttctctttttttttttttttgagacggagtctcgctctttcgcccaggccagagtgcagtggcgcgatctcggctcactgcaagctccgcctcccgggttcacgccattctcctgcctcagcttcccgagtatctgggattacaggcgcccgccactgcgcccagctgattttttgtatttttagtagagacggggtttcacccttttaaccaggatggtctcgatctcctgacctcgtgatctgcccgcctcggcctcccaaagtgctgggattacaggcatgagccactgcgccgggccttgttctcagttttaaaccattttcctgaaatgcatctgcaaacatatcaaggcagaaattattgaaaggaagagattttaagtttgctgctggcgtcaatacctctgaatataaaggataaagactccttggattaatctcacagactttccccaaggtttcttgtaaatgtaatttggaaaatgttttccttgtctggtataaaaattttattctgaataagataattctataaaaagttttctcaagaacgagcacaattttgagaggttgttttattttattttaaattttctgttgagaagggaccaaggtcagggtcatgcgtgtgatttctgtgtgatccaggtggtttccttggtggcttgttctgggaggtgaagccagttggacttcttggtccggtggggacttggagaacttttctgtcttacaagaggattgtaaaatgcaccaatcagcgctctgtagctagctagagatttctaaaatacgctaatcagcaggctgcaaaaacgcaccaatcaggtctctgtggctagctagcggtttctaaaatgcgctaatcagcactctgcaaaaacgcaccaatcagctctctgtggctagctagaggtttgtaaaatggaccaatcagtgctcagtaaaatgcaccaatcagtgctctgtaaaatggagcaatcagcactctgtaaaatggaccaatcagcaggacatgggcggggacaaataagggaataatggctgaccacccctcccccctcccctccccccaggcaccttccaggctgtggaagctttgctcttttgctgttcactcttttgctgttcacactaaatcttcctgctgtccgctctttggtccgcaccacctttaagagctgtaacactcaccgtgaaggtccgcggcttcattcttgaagtgagcgagaccaagaacccaccggaaggaaccatctccggacacagttccacagccaggggacagtggaggtttggctagctgtctggcaaagctccggtttttttttttgtcataacgggcacagggaaaggagggcgggtaaatagatttgtgcaaacctttcaacactaatggaacagacaaggagcagatgctgtcctcctggctggtcagtgaaattgactctgtccatgaaggaagctgcattttcccagtgacttgggtggaagtacctggcgcaggagatagatacagggatcagggaagcaaactgttgttaacaaaaccctggttaaaagtaggtagtaattaacttttgctttttcttattgtgatatggaggaagttcctaaggctcttgaaagtcaatttagaaaccttgtgtctgattgcgtgagtgtgactgatactccaaagcaaagcgagtaatattcatttcagtaaggctgtcgtttcaggcgaatggagaatattatttattgtaggcattaaaagaaattaatatactttatttattttgagacggagttttgctcttgtcgcccaggctggagtgcagtggcgctatcgcggctcactgcaacctccgcctcccaggtttcaaggggttctcctgcctcagcctcccgactagctgggattacaggcgcctgccagcatgtccagctaatttttgtatttttagtagagtcggggtttcaccatgttgtccaggctggtctcgaactcctgacctcaggtgatccacccgcctcggcctctcagagtgctgggattacaggtgtgagccactgcgccccgcctaaactaaattaatatagtttaaacattcaacctctttaagagcttcccctctcctagggatgtgtaggtatgagatggggagtggggaatcacaacgttttgggtttttaaaaatgtgaaagtgtatgcacaaaggcagtaaatgtgtttttcagaagcagtaattactggaaaagtacatctaggttcattgctttagcggcctgagtgagatcgcagcaccctggctggcttgtgtgggctttggcctgttttctgttgcctggaggtctgtagtgttaggcaagtctgaaaactaggtaacacttttgccctgtatcagagaaacagactgagttctagaaatcagctaacttgtactgagaaggttttatgtatctttaacaaattcagcccaccgggagaggaaaaggagaatttcagactagaaatcaggaattttgtatattcccaagtgaagatttttcttgtaggttacaaggaggatgaggcgcaaatatattacaaatattaaaacggacaaaccaatcgtatctggaaaatgtagagttgtctggaaaaataatcttggaaactttactttttgtactatgcaacctctaatttacaaataacatccaaatcattcaaacgaacagcgtcgcagggctgcacaccgccagggggcgccatttacatgggacccagtgggagtagagcagtgtgatggcctgcaactgaccaacctgccttttactgccctttcatgctcccagcccctgctgctctcctgggttagaaattgaaagtttataccaaactcatgggtttacaagtggaaacatcacacccttagcatcgtctttcctgaacactccatctacaatagctttttcctcatctaaatctctggccaggcacagcggctcacgcctgtaatcccagcactttggggtgccgaggcagacgggtcacttgaggtcgggagtttaagatcagcctggccaacgtgatgaaaccccatctctactaaaaacacaaaaattagctgggcatggtggtgggcgcctgtaatcccagctactcgggaggccaacgcaggagaattgcttgaacccgggaggtggaagttgcagtgagctgagatcgaggctgcactccagcctggctgacagagcgaaactctgtctcaaaataaaatataaaataaaataatcttttccttaatattctcgctatttatatcctctattatctgcctctccacgcctgtttattccttcagagcatttatcgcaatttgtacttattttgtttaattgtttgttgtctatcgccatcattatcttttcaacatgtaatccacatgagaaaatactgatacaatcttttcacttatttttttcacactaagtctttgaaatcaggtgtgtattttccgtggacacgcatctcagtttcactggccgctctgcagtgctcaaggaccatgtgtggcttgtggctgccatactggacagtgcaggtctggtgcttaaacttagggtccacacatagtaaatacttgctgaatgaatggataggaagaagctgaggaaaacaggaactttttaaggaaccctgatcctctatgtcctcctgtaaaaggtttaaaattttttcacttgtatactgcctgaaattttaccaattagagattcttttgtatttaatacatcctcattaaaaaatttcttagtgatacccctgagaagtttgaaatcagtcacatatatttaggagttattgccgtcagactgctttcctcccaattcccggaggagtatgtatattagttttcgtttctttttttcgtgtttttttttttttttcccttggagtcttgctcttgttgcccaggctggagtgcagttctttcagctcactgcaacctctgcctcctggtttcaagtgattctcctgcctcagcctcccgagtagctgggattacaggtgcccaccaccacgcccggctaatttttgtatttttagtagagacgaggtttctccatgttggccaggctggccttgaactcctgacctagtgatccacctgtcttggcctctcaaagtgttgggattacaggcatgagccactgcacccggcctcttttgttttttactctgagacatagtcttgctctgtcacccaggctggagtgcagtgtgcatgatctcgactcactgcaacctccacctctcgggttcaagcaatcctcccgcctcagctttcttagtagctgagactacagactagcaccaccacacctggctggtcttgtatttttagtagagacagggtttcaccatgtaggccaggctggtctcgaactcctgacctccggtgatccacccgcctcggcctcccaaagtgagccaccgcgcctggcagtatattagttttctattgctgtgttacaaatgatcacaaactcagtggcttacaataacacccatttattagcacacaaattctgtgggtcagaagtctaggtgcagcatggctggattctctgctcagggtctcataaagctgacatcaaggcgtcagtcaggctgcctttctttctggagcttggagttgtcttcagggttcacatggttgttggcagaatgcagttccttactgcatccatcagttagaggctcgatcccagaggccacctgccgtgtcctgccatgtggccctctccacaacatggcagtttgctcttgcaaggctagcaggagcttctactgcaacttcagatctctccgacttgctgtctctgacttcttgattcttttccaaaagggctcaccaatcagtgggaatcttgggggccattctgcctctcctagggagattagctgaattagagaagtagttatttcttgaatctggaaaacagggctatggaagttccaggctggcatcatgaaaacatccattcacagatactttattgaactcctgctctgtgccgggtgctaggcctgcagcggctgacagggcaggtagatccctgccctcctgaagctcctaggccagaggacactggagaggttttattgccatttaaaaatagatgatggccatagttgcacaagtctgtaagtgtattaagaaccattgaattggtatgtaaagtacatctcagtaaagctgttttttgttttgttgttgttgttgttgttgttgtttttgagatggagtctcactctgttgcccaggctagagtgctatggcgcaatctcggctcactgcaccctccgcttcctgggttcaagcaattctcctgcctcagtctcccgagtagctgggactacaggcacgtgccaccacgcccggctaattgtttgtatttttagtagagacggggtttcactgtggtagccaggatggtctcgaactcctgacctcgtgatccacccacctcggcctcccaaagtgctgggattacagacgcgagccaccgtgcccggccaaagctgtttttttagaaatagaagtgcttacagatttgtttgagcagaatagatacccatgttcagagagagagagagagagccattgagaggcagagagtgccgaatgtgaattctgtgtaaattgaaaagttacggtccccgtccataaggagatggctctggttgtcttgaatttagacagctttccagaggaggaggttctctcctgcagcagtgtgggaaaaaaatctaccagatttggaccagaatgactgcaatttaggtcagaacatgatacttagagggaaaaaagtaatcatggcttgaatagctgccctaaggccagctacagggctgcaggggtctgtggaacctttcttgtcagaactcaggatccttaggagtccccacaagggcatggaggctgtggccatcatgagtggaagaaccagcttccaaaggaacctaggattgttctggccctggctccaggtgcatatctctgctttccgtgagcattgaatgggaaatcacgtgttagcagaataaatcccagaatacacattcaggaggagatggttccacatggcacgtaagtcctttgccttattgatgtttgtctggcagatgtccttaagccttcccatcaagggctttattctaagggtggctaactggctatttaaacctcatctcaatagtgtctgtctaggatggcaaaatcacaccaggttctgctgggcaaatctcccaggtggcgtattgctagaggagagcgccactgcagaggacacactgtcttggccactggctttgcaaaccatagtggaggagggagtctggggtcaccaaccacttcctggctgactgcctgagccacattatacaagactgtttgttgacttagtaatactgaagccagagctcaccaagattctgacatcaagcatgaaagtgactaattctttcatttcccagcactttgacaaaggggactctcttaaaactcctcatcggacgttagtggaagtcgactcatgtatctaaacatgtagccagcgtaagttcttggtcagattgatctaatgacttttttagcgtgtgtgtgtgtgtgtgtgtgtgtgtttaatctttttaagtttgggtgaagtttgaccttctagaattcctgtttattcctgagcaaagaaaaaaaaatcaaccctttttaattcctttagcatcatatctgaccatctttagggtgttgtttctttcctagactgaatcactcagagaaataagattggccaacaaatgtaatttgatgataccctataataatgttgtttaagtacctaatctaagccgctaatctccaaagactgttcccccgccccatgtcatcttacacacacacacaggcacaaaaacacacacattctgttctgattatatttgctgtattaaggccaaatccaggtgtttctgagcactagtttgtgtgtttttatgttgaaaataactagtttatgtatttatttatttatttatttttgagatggagtctcacattgtcatccaggctggagtgcagtggtgtgatcttggctcactgcaacctccgcctcctgggttcaagtgattctcctgcctcagcatcccaagtagctgggattgcaggtacccaccgccacgcccggctaatttttatatttttagtagagatggggtttcaccaggttggccaggctggtctcgaactcctgacctcaggtgatctgctcacctcggcctctcaaagtgttgggattacaggagtgagccaccgcaccgggccaaaaaatccaatttcttagagattaaataacccttcaggattatcaaaggaaataattagggaaaggtagatgttctgtcccagtaagagaagaaagtggtccagaaattttatctcccatcaaatgatccattttacttaagtattaaaccaagtgacattcttcagtttaactctgataaatgaatcatattcctcttcgaaaataacttttgtatttcgtgctctaaaaagagaaccacccctacactcttggaaattattccttttaatggcagtaaaaacctttggctttcataggcatcatcagcagagatgttagttcatgagcacctgtgagtttctcaaaattagtatctgaaaatgatgggaacacacaagcgataccatcatgtctttggcacatttagttgaaaacttaaaattcttccggtggaggtaagcaaattggaaggtattaaaaatgatcagagtgtactattcagagttatagatttacccttccatccaagatggctgcgccttggaaacccccagctcacttttactagcagtgcctccagatccagtttctaaatcacacagggagattaacattattcttttatagtcacactgcatgtggactaaaataattttttttaaagagaccggggtctcgccatgttgcccaggctggtctcaaactcccgagctcaagtgatctaccagccttggcctcccaaagtgctgggattataggtgtgagccgctgcgcttggctaaaataaatattttaaaatttaacacgattattattttgaaattggaactctaaaagacttttcaaaattcaaaatgatcaggaatgttaaaaacaatgaaaaaaagcacccctaaacctgccctagattccccaggggagagtcaaagatgttttgctttgtatcagcactattgaaataaacatattgtcacctaaaaggaactatttgaagaggactgcacttcactggatgtgtatatcctggtgagttttttattaatgtttattgttttttaaaaaatgtgttaaaatggctgggtgcagtggcttacacctgtaatcctagcacttcgggaggccaaggcaggcggattacttgaggtcaggagttggaaaccatggtcaggagttggccaacatggtgaaaccccatctctactaaaaatacagaaaagttagccgggcatggtggtgcacgcctgtgaccccagctactcaggaggctgaggcaggagaatcgcttgaacctgggaggcagaggttgtggtgagtcaagatcgcaccactgcactccagcctgggctacagagcaagactccacctcaaaaaaaaaaaaaaagcagaaaaatgtgttaaaaatatacacataacatttgccatcttaaaacttttcgagtgtacagtttcagtagaattgggtacacttacattgttgtccagccatcaccaccgcccatcttcagaacagttttcatcttgcagaattgaaactctgtatccatttaaccctaaatccctatttctccctaccccaaagcccctggcaaccaccatcctactttctgtctctgtgaatttgactactctaggtatctgatcaggtttttttttttaattggttattacttatcattaaactcattcatcgtttcttgaaataaacccaataaactttaatggaagctcataagaatttttttctgaattctgccctctgtcaaaggaagaaaatgacaacatggacgcatatctgtatttgggtggcattaatgactcagtgaccttcacttttgcagccagcgaaatacttggcaattttaatttagaaatattactgtatcatcatttaacagaaatacttactaaagcagaaatatactgactttagaagcatttcaaagaagcagggttggcactgaccagtgttctcttaaggtagaagacagaatatttgactaaagacagtgctgtagcaggtagaaatagacattatttagaccccttttctgagtaaggaagaccagttaaaatgttagcttattttttgggattttagaaatgtttaactcaagagaaaaatataacttaagtcagtgtaatggcgtatgaataagttaaccgtgtaacattttcttttttcttctgcctcagcctcgcgagtagctgaaactgaacaggcacccgccaccacacccgcctaatttttgtatttttcacagagatggggcctcaccacattgaccaggctgttctcaaactcctgacctcatgatccacccatctcagcttcccaaagtgctgagattacaagcgtgagccaccatgcccgacccatcttattttttaaagagggagtttagtactgattcttagatcaaaagcagccaaatccccagtatcacagaagagatgagggtctggttatgtggcccaggctggtctcaaactcctaggctcaagtgatcctcccgccttaacctcctaaagtgctgggattacaggcatgagccaccaagcctggccttctttaacctttgtgttgtaaatgtgtaatgttttggtaacagtaagggttaaataaacaccttttctccctagtaggaaaatgcttctcagattggattgaaactctgaagaccaacatttttctagatactttcttggatagtgttcatgacaaactgctacttgaaagtggcaggaccattgtactataaaatctaataaagcccaggtcattggctatagggagttgaaagctctatttgtagacatcactaggagaactgacaagaatgaaaatgttacacagttaaggccgggcacggtggctcacgcctgtaatcccagcactttgggaggccgaggcgggtggatcatgaggtcaggagatcgagaccatcctggctaaaccccgtctcgactaaaaatacaaaatattagccaggcgtggtggcgggcgcctgtagtcccagctacttggggaggctgagatagaagaatggtgtgaacccgggaggcggagcttgcagtgagccgagattgtgccactgcactctagcctgggcaacagagtgagaccccgtctcgaggaaaaaaaaaaaaggttgccaggagcagtggctcatacctataatctcaacactttgggaggatgaggtaggaggatcactgagcctagaagttcaagaacagcctggccaacatagtgagaccccatatctatttatgtatatattttaaaagttatagaaaacaacgctcttattaaactggtaattagcaactaaagtagaaaaacatcactggatagatggctgagaaaagggatctgtaatcacctgcttatctggacaggttttttcttttttttttttttagagatagggtcccactctgttgcccaggcaccatcatgactcattgtagcctcacacttctgggctcatgctatcctcctgagtagctaggacaacgggtctgcaccaccatgtctggctaatttttttctttttgtagagatgggcggggaggtgtcttgttacattgcccaggctggtctcgaactcttagcctcaagcaatcctcctgtcttggcctcccaaaatgctgggattacaggtgagagccaccacacctggcctggacaggtagttttgaaaacaggggttatcactagagaagtctgtgcttgagctgaggagcatgtcttctgaaatgtgtaaatttcctatagttagttccctggtggcgtggccctccatcaagaacattttgctgagttttccctgacttaaaataataacagtgatgctggtgctgatgaaaagactgatgtggcccttacatcccacatgaatcatcattcgggattattgtagcctccataaaagtgacgcagtggatgaaagtggtttttctcaatacttaaaaacactgtgaaaatgagataggtttaaagatataaatgtgattttttaaatcctgcccccccacccaagtgccaggagtttggtaactagaattgcatttagtcatcggggtacagattgtactgtgcgggctggagactcaaaccctgggctattgaaggccatgacaaatgctcattttttaatattatgtttttgctgctcatgaagaagcatcatgttcaaaatgaaaaatctttagattcaggacttaatagttcacctcttttggattgcgtttgacggaaacttggacacagctgagtgtaattatgcttttcagcagcatgacttatagtactgcagatatgggcatactttgagatttttctttttgccaaaatttgtctgaaaaggagcttggtggtggttgtgtgtgcttgtgtgtttttaaggtaattaggctattagaggtccaaatggaataatccccttaagccttttcaggaaaaacactttggaaaggttaagtaaatttaaaattagccattatttacgtaggtgctcagccttttgaccatgttctctaggagttgtttcttttacatttaggttatgtttgtcagaaaccatcttattttttatttttatttttctttctttctttatttttgagatggagtctcattctgttgcccaggctggagtgcagtggcgtgatctcagctcactgcaacctctgccctcaggttcaagcaattctcctgccttagcctcccaagtagctgggattacaggcaccggccaccacacctggctaatttttgtattttagtagggacggggtttcatcatgttggccaggctggtcttgaactcctgacctcaggtgatccaccagcctcggcctcccaaagtgctgtgattacaggcgtgagccaccacacctggccttatttttattttttgagatggggtctctctgttgcccagactggagtgcagtggtgcaatcactgctcgctgcagccttcacctccctgagctcaagcctcagcctcctgaatagctgggaccacaggtgtgtgccactacactgggctaattaaaaaaaaaagtttagagacagggtcttgctatgttgcccaggctgtttttcaactcctgggctcaaggaatcctcctgcctcatcctcccaaagtgctgggattacaggtataagccatttcacctggcaaccatcttatttttttaaatttatttttatttatttattttttgagacgaagtctcactcttatcccctaggctggagtgcgatggtgtgatctcagctcactgcaacctctgcctcccaggttcaagcgattctcctgcctcagcctcccaagtagctgggattacaggcgcctgccaccacgcccggctaatttttgtatttttagtatagacggggtttctccatgttggccaggctggtctcgaactcctgacctcaggtaatccacccgcctcggcctctcaaagtgctgagattgcaggcgtcagccaccacgcctggccgtgaccatcttatttttttaaagagagagttcagtactggttctgagatcaaaagcagccagatccctggtatcacagaagcttcatcacggattcatctatttttcatctccagaatggccacctcagtgctgtcctggccaaaaatctgttctctagacctggagaaggaactgccctgagggtcttccacacctctctttttgagaaaagttaagaacaaagtaaaaagatgcagtggagaaatgacgtcgggggttaatggattgggattttagggctggagtccaggcttatgttgctctctgctgagctcaggatctgcactgaacatctctctaaatcatgggctggggtaaaacctgcttacactggctcagaccggaggactttgcagccacctcaagacacacgtttgggtgtgtcccatctccaatcaggatgttcaacttgctttcttggatctttttgaattgcgaatttggccatagctgaccacttgtttttgcatcaatacttcaaagggttcaaggccaggtgcggtggctcacgcctgtaatcccagcactttgggaggccgaggcgggccgatcacgaggtcaggaaatcgagactatcctggctcacatggtgaaaccctgtctcgactaaaaatacaaacaattagccgggcgtggtggcgggcacctgtagtcccaactactcgagaggctggggcaggagaatggtgtgaacccgggaggcggagcttgcagtgagccgagatcgcgccactgcactccagcctgggcgacagagcgagactccgtctccaaaaaaaaaaaaaaaaaagtgttcaaattttaagtcctggtaatttatcccctcccatagcaagtattggcgcaaaagtaattgtggtttcagaccatgaattttaaatcattgtaactaggcccaaatacatctttattaatcaaaataatcaacacatttttgccaatgagaaataagtttgttttttcctttaatgtaaaaatctgtgcttcgggattcagcgaactcttggaaagcatttttttcttcatcctgctggttgtggaagcgtttttctgtataaaaagttgtcgagatgcttgaagaagtggtaatcggttggcaagaggtcaggtgaatatggcggaggaggcaaaactctgtagcccaattggttcaactttctaggcattggttgtgcgacgtgcagttgggtgttgtggagaagaattgggcccttcctgttgaccagtgccggctgcaggagttgcagtttttggtgcatctcatcgatttgctgagcatacttctcagctgtaatggtttccccaggattcagaaagccgtaatggatcagaccagcagcagcgaccaccagtgaccgggatctttttttggtgcaagtttggcttttgggaagtgctttggattttcttctcaatccaaccactgagctgatcatcaccagttgtcgtataaaatctatttttcattgcacgtcacaatccgatcgagaaatggttcattgttgtggcatagagtaagggaagacaacacttcaaaacgacaatgtttttgattttcgctcagctcatgaggcatgcacttatgaagctttctcacctttccaatttgcttcaaaggccgagtaaccatagagtggttgacgcagagttcttcggcaacttctcgtgtagttgtaagaggatcagcttttttttttttttttttttttttgagacgcagtcgcgctctgtttcccaggctggagtgcagtggtgcgatctcggctcactgcaacttccgcctcctgggttcaagcgattctcctgcctcagcctcccgagtagctgggattacaggcacatgccaccacgcccggctaatttttgtatttttagtagagacggggtttcactgtgttagccaggctggtctcgaactcctgaccttgtgatctgctcacctcggcctcccaaagtgctgggattacaggcgtgagccactgtgcctgtcagagggtaaactttgatggttgttctcagttggtcgttgtcaactttcaatggctgggcactagcttcatcttcaaggctctcgtctcctttgaaaaacttcttgaaccactactgcactgtgcattctttagccattcctgggggcaaatgcgttgttgatgttgagagttgtctccgctgctttaccacacattttgaactcgaataagaaaatcgcttgaatttgctttttgtctaacatcatttccatagtctaaaataaaataaacagcaagtaataagtcattagcaaaaaaagtgaaagaatgtgcattaaaatgatgtataacataaccacatttatttaagaatgtattccaatatcaaatggcaaattccaacagtgcaaaaacttacccctgaaaacaggcatagtcactttcaaacttgatttttctttcattttactctaccttttcatttgatgaaacacctttgcattttatctccctgagccaaagtacctgtaagttgcccggagttggggttggtgcaatactgtggaagagtgtggacacggaagacctagtcagtccttgctgtgtgatatcaatgatttgattgagaaagactcattttcctgggcctcacctgtcaattttctcaactgtcaaatgccctcttttggcctgtattaggggctgatctcatgcaatacggagcctactctgcaaatacaaggggtcatggtcattgtccatttgtggggagtgtgaaaacacctggtgatcatgatgggctaggtactgtttcacactttaaaatgcctttattttagggggaccctctagtgccataggtattttggagtctctgctttccaaatggcctatgggaaatcctgagatgtccgtgggatctaactttgcccagtgggaatgttgtgtcatagtcataaaggcttaaggattagtttatttccagccctgcaggggctataaattgctactttaaatttcattccagcaccctgatgtttatgttgctatggtggtgtgtctcttgctcgggtgacaagattgccattggaaataggccaaaataacagcctaacaggtggctgtgctttgggaagtcatttgcaaaactattttgcgaagaagtctggtgcaaataagtcacatgactgtgcccttaactgtagtttatagtttagcatttttttaaaacgcattcctccccctttccgttttatatatagacttttttcctctttcaagtagtgccgtgctgatttcctgtagtaacacaaggaaagatttcagctcattttatttagcagtggatgtcctttccttattttttgtaaccagagccctctttctaaaaataacccttcttttcctaatgtgattcttcttatagctgatgtactctatttaaatgaaaggcctctttttaacatgcccattttaatcgatatatatttattacatataactatatataataaaatacatatataaatatataataaaagtagatttccctgtagggtctaatccttcgtgaatgtggtagcagaaattgttcgttacgctttcacctgccaattatgattgttttctttctttctgtttttttttggagatggtgtctcactctgtcatgtcacccaggctggggtgcggtggtgccaactcggctcactgcatcactgcaacctccacctcccgggttcaggcaattctcctgcctcagcctcccgagtagctgggattacaagcatgcaccaccacacccagctaatttttgtatttttagtagagacggggtttcaccatattggccaggctggtctcaaactcctgacctcaagtgatccgcccgccctggtctcccaaaatgctgggattacaggcgtgagccaccgcgcctggccagttttctttcttttgagataaaatcacggaaagaacctgagtattaaaccagttaaacttcctacccacttaagagtcctttctatgataatcttggatggcaatcatcttgcctttgggcttaataccagccatcgcttgggtgtgggctctttttggtaatacaacctctatgattttccactttgatttgttggaagatgctttctcatgtttagttggtatctgactccttagagctttcaggatcgtttctaccactatagtgacaaacacaagccctttccacatgctgactctttaaacatttaaagaaatctataatgttggctgggtgcggtggctcatgcctgtaatcccagcattttgggaggccgaggcaggtggatcatgaggtcaggagttcaagaccagcctggccaagatggtgaaaccccatctccactaaaaatacaaaaattagccgggcctggtggtgggcgcctgtaatcccagatactcaggaggctgaggcagagaattgtttgaacccaggaggcggaggttgcagttagccgggattgcgccactgcactcaagcctagaagacagagtgagactctacctcaaagaaaaaaaaaaaagaaaagaaaagaaatctagattgttctcctttgatcttctcttccactggcttgctactctcaattccttcagattgaatttatgaaatgcttttgtctccctcaccattcctgtggttcctctttcttattgccctttagaaaatattgaacgcaatgcgttacagcagaggtcaactaactttttctgcaaaccgccagatagcaatattttagacttgcaagccgtaaggtctctgttgcaactactcaactctgacctcgtaacatgaaagcaggcatagggcaacatgtaaatgaataggcgtggctgtgttccagtaacattttatttgtggacactgaaatttgaatttcataaaattttcacatgccacgaaatattatgtgccttttgctttttcttttccaaccatttaaaaatgcaaaacccatttgtagttggagaggcgtacaaaaacaggctatgggctgcatttggcccatgggccgttatttactgatcttagatattggaggaccagtgctgaaaccactggaacttcagctttaacactagcactgtcattttcagaagccgcatcaaactgctggctgcttctgacaaggtggtcagttacacttggtcttctccaccccccatcccccgcccctccgccatttcctgacaaagctgtctctctaacctgtgggtatgtgttctgccgaaaacaagcagccataccacagcagccgtaaccataggactttgaaacaaatgcaatgaatggcatccactagtttcaagtttgaccacatgtttttattgtttgtttgtttgttttttgagttggagtctcgctttgtcgcccaggctggagtgcagtggcgcaatcgctgttcactgcaatcttcccctccctggatcaagtgattctcctgcctcagcctcccaagtagctgggattacaggtgcccaccaccatgcccggctaatttttgtgtttttagtagagacagagtttcaccatgttggccagactagtccggaacgcctgacctcaagtgatctgcccaccttggcctcccaaagtgctgggattacaggcgtgagccaccgcgcctagcctgaccacgtttttgattcttgcttctgttatatctgtattaaccgttcttcttagcttcgtggcagatgtgataagcatgcctttgtgtctttctctaagtcactgacttttcagtaacatctaaatcataaaacataggtctggccaggtgaagtgcttgtgcctgtaatcccaaggggccaaggcgggaggattgctttagtccaggagttggagactagcctgggcaacacagtggacctcatctctacaaaaaaaaaaaaaaaaaaaaaaagtcatgactgctttcctttgttgcagaaaccagtaggtatttgggtgtagaaatgaaaccctcaattatattcataaggctaaaaatgaactattccctacttcctcatttgttttgatttttaaaataaggttctcgttagatattttgagaaacagtttaagattataattttgtatgcagaggagaaaatttagaaaatggtgaagccaacttttttagtgtataaacatttaatcataattatatatgtgtccgtgtggacatttatttaccaaggctttgctttaaggggaagggagaacacagagggccaacatttatggaacattctagtgggccaggcccaatgtgttaatcatctcatttcaattttgcagttatcctccaaggtggatcctattatcttcatttaacagacgtggaaattgaggcttagaggatttgacaaaattacccccatcattaatggcagagctgggtgtaaaccctgggcttggactggcgttatgtctcacggctgtaatcctagcattttgggaggctgaggtgggtggatcacctgaggtcaggagtttgagaccaggctggccaacatcctgaaaccctgtctccactaaaaatacgaaaattagccgtgtgtggtggcaggtgcctgtaatcccagctacttgggaggctgaggcaggagaatcccttgaacctgggaggtggaggttgcagtgagccgagattgcgccgctgctctccagcctgggcgactgagccaggctccatctcaaaacaaacaaacaaaatccctgggctttttggctacaaattccattccaacaacacctttgttttgcataaccaaagagaagttgatgttaattcattgtcaagttatttgtaccgatatactaaatatcctaaaatggggatatgttcctcaattatttactggaatggtaacatttctggagcatatatcttcaaaactgtaatgtaaattaagaatatgaacattctcagtggaaaatgactgttcaagttaacattatttgcatttgccattcttttgtaaagccagaaacgtagatacaattttagattaccttcaagctattataaatcttgagggaaaccttgattgttttttagaaaaatatgtctatctagactgtgtcttgcaaacaggcactttaagatgtcattatatgaatattcagaaactcagatgtaatagaacctagatgagaatgtgtgataatctaaagatatcatttaagtcagggctttaaaaatacatgacttcaagtgaaaaactgagccttgtaaagaagttctttacaattcaccaagcatgctctaaacctgcatccatcctgagttctttaaaagcagacttataaaagggagatgaaagatattttcaaaatatatttttgaagcacaaagtaaaacatatttaatattttaattgtttgaaatgagttgcttaaactagtagctgctgctgggaatgacaaaagcttggctaagattattctatggggaagctggtttatggctttctggagctggtggccaggcatggtgtagattatgggttgcttgtaggattatgtttgttattgcctctttttttaactccctataggagcttttatagtgctttgcacatggtggttgcttcgttgaggatgactaccagtttatggtcatttaaattcagatttagggccaggcaccgtcactcacgcctatgatcccagcactttgggaggccgaggcaggcagatcacctgaggtcaggagttcgaggctagcctggccaacatggtgaaaccctgtgtctactaaaaatacaaaaattagccaggcatgatggcgcacacctgtaatcccagctacttgggaggctgaggcatgagaatcacttgaacccaggagttggaggttgtagtgagccaagatcgtgccactgcattccagcctgggcaacagagtaagactccgtttaaaaaaaaaaaaattcagatttagggacaggcgcagtggctcatgactgtaatcccatctactggggaggctgaggtgggaggatcatttgagcctgggagttcagggctgcagtgagctgtgattgtgccactgtactccagtctgggtgatagagcaagaccctgtctcaaaaaaaaaaaaatcaaatttaattttgtgttgattgtggcttaaaaaacaagaaaaatatattgctgttcaaaaatttttattttttattggatattgcacgggtatgaatcaatttacccataaatctatcgtccgtttaataagtagaatgttacgagtttactcaacattttctttctttctttctttcttttttttttttttgagacagggtctcgctctgtcgcccaggctggagtgtagtgtcgtgatctcagcttactgcaacttctgcctcctgggttcaagcgattctcctgcctcagcctcccgagtagctgggattacaggcatgcaccaccacgctcagctaattttttgtatttttagtagagatggggtttcgccatgttgcccaggctggtcttgaactcctgagctcaggtgatcctcccgccttggcctcccaaagtgctgggattacaagtgtgagccaccatgcctggcccctgttcaacattttctatatgtctcttcctgatcccagaccttctgtacatatgacattatagatgatttagtcttcaataacttgctattttttcctagtaacttttcaaagagatatcattcacatgccacaaaattcattcttttaaacaaatgtacagatccctagtttttagtatattcttaaggttatgcacccatcaccactattcaattctagaatattttcttttccctttttggagaatgggtcttgctatgttgccgggctggagtacagtggcttttcacaggcgcgatcatcacgcactacagccttgaactcctgggctcaaacatttctcctgcctcagcctcctgagtagctggatttcaggtgtgtgtcaccttgcttggccaattctagaatattttcactactcccaaaagaaacctcgtatccattggcggtcactccccatttccctgtttccccaaccactggcagctactaatctatactttctgtccttatggatttgcctattctggacatttcatgtaaatggaatcacacaatgtatggccttcatgtttggcttcttttgcttagcataatgtttaatgaaaggtgtgtgttgcagcatgaagcagtaagtacttcattccttttcatggcttaattatgtatatattatatatagtttttttttttttgagataaagtctcgctctgtctagcaggctggagtccattggtgcgatctcagcccactgcagcatccgcctcccaggttcaagcgatcctcctgcctcagcctcccgagtagctgggattacagatgtgtgccaccatgcccggctaatttttgtatttttagtagaggcagggtttcaccacgttggcaaggttggtctcaagctcctggcctcaggtgatccatccacctcatcctcctaaagtgctgggattacaggtgtgagccaccatgcctggcctcatggcttaataatatttgattgtatggatatacatatatatttcggacatttgggttgtttccagtttttggctattatgaacattcacatacaagcttttatttaaccacttgctttcagttctttgggatatatacctaggggtgggattgctgggtcatgtgtaattttatgtttaggtttttgaggagctgccaaactggtttccacagtgcctgcaccgttttacattcccacctacagtgtacgatggttccaatttctctacatcctggccagcactgtactttctgtctttttggtcctagccattctagtaggtgtgaagtggtatctcattgtgattttgatttgcatttccctaatgactaatcatgttggaaatcttttcatctactggcaatttgtatatcttctttgaataaatttctgttcaaatcctttgtctagttttcagttgggttacatgtcttcttttgttgagttgtaaaacttccttatatgttctcgatgctagaccctcatcaaatatttgatttgcaaatattttcttccattctgtggtttgtcttttcactttttcatagtgacctttaaaacacaaaagttttaaatttaaaaatctaaaataaggccgacgtggtggctcacgcctgtaatcccagcactttggggggctgaggtgggcagatcacctgaggtcaggagtttgagaccagcctgaccaacatggagaaaccccgtctctactaaaaatacaagattagctgggtgcgtgtaatcccagctacttgggaggctgaggcatcaacctgaatcgcttgaacccaggaggcagaggttgcggtgagccgagatcacgccattgcactccagcctgggcaacaagagcgaaactctgtctcggaaaaaaaaaagaaaaacaaaaaaaactaaaataaattatttttttacatcagataggcaatgtgctgatgtcatagtaaggtttgagagcggcacatctcagacatgagtgtgaaaacccaatcgctgtgcttgtgaaccacaaaaggatcataagttttattttattttattttttgagacagagtcttgctctgttgcccaggctggagtgcagtggggcaatctcgattgaacgcaacctccgcctccccagttcaagctattctcctgcctcagcctcccagcagctgggattacaggcatgcaccgccacgcccagctaattttttgtatttttagtagacacagttttaccatgttgcccaggctggcctggaactcctgagctcaggcagtccacccacctcagcctcccaaagtactaggattacaagtgtgagccactgtgcctggcctaggatcaacatttttaaattttgataaagttcaggccaggcatggtgactcgcctgaggtcaggagtttgagaccaaccagcctggccaacatggtgaaaccccgtctctactaaaaatacaaaaattagccaggtgtggtggtgcatgcctgtaatcccagctactctggaggctgaggcatgagaatgacttgaacctgggaggcagaggttgcagtgagccaagatcgtgccactacactccagcctggacgacagagtgagactccgtctcaaaacaaacaaaaaaaaagttttttgatgaagttcagtgtttcccttccctttccctttcccttttcctttccctcccctcctctccctttcactctcatttcctttcctttccttttcctccctccctccttgcttgctttctctttcttccttccttccttccttccttccttccttccttccttccttccttccttcctttctttctttctctctttctttctttctttccttctttttctttctctagtcaaatgcagtagtaagaaagggggaaagaatagaacaagttcaatctgtaactcaatgtgaacaatcaattgagataactcactacgtttggaccagccttctttttttcttttagttccttgtgccttggtttaacatctaagaaaacattcctgaatgcaaggtcacaaagatttatgcctatgttttcttctaagagttttatagtttcagctcttacatttaggtctttggtccatttggagttaatttttgcatatggtgtggggtaggggtccaaattcattcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccaaattcattcttattcatatggatatccatttgtcccagcaccatttgttgaaaatacatttttccccattgtattgtctgaatcttgttctttttcactcaacattttgatcctgaaattgctgcatataactacaaatcatttcttttttttttttggtggtggtggcggggcggagtttcactcttgttgcccaggttggagtgcagtggcgtgatcccaactcactgcaacctccacctctttggttcaagcgattctcctgtgtcagcctcccaagtagctgggattacaagtgcacgccaccacgcccagctaattttgtatttttagtagaggtggggtttcatcatgttgtccaggctggtctcaaactcctgacctcaaatgatccactcaccttggcctcccaaagtgctgggattacaggcatgagccactgtgcctggcccacatcattcatttctttatggctaaaaaatagtatcctttgtataaatctgccatgatgtatttatttattctttgttccatacagattgggttgtttccagaagttgctattatgaacactattgctctgaactcacttgaacgtgcgtgcgtgagtttctctccagagtatgtgcctagaagtgtagtgtgtgcatgtgttctccaaagcgattgtcatacttatgcttctatcagcgatgtgtcagaactacgtttcagaaaacagttttaagcattctgtttgttctgtctctcattgaaaaaagtcattactaaaaagaaacaagtggtatttgcaagtgaaatttgccttttaggcctctaatattttattagcaagaattaaataagcaaaaggccaatagcttgagaacgtagtatgcaattagtatctctttgtttgatttattttattttttcacagtgaagacttaagtatctctttacattttaaaatattaatgtggaccttaaacaggtctttggctggttgaggtagtggtttgtttgtttttgagacagggtctcactctgtcacccaggcgggagtgcggtgcagtggcgcaatcacagctcactgcagctgcgacctcccaatcccgagtgatcctcccacctcagcctcctgagtagctgggaccacgggtgtgcactgccatgcccagctaatttttttgatttttttgtagcgatgaagtctcgctatgttgcccaggctggtcttgaactcctgggctcaagcgatcctcccaccttggcctcccaaagcactgagattgcaggggtgagccaccaaccgcacgggcctggtgaaggtttttgctgttagtaggtgagtctgcgtgttaattaaagcaacatcacaccagcctactattgctctcttaactagggtgtggagcaagtataatagagcagttgggctgcgctgggtggctcacacctgtaatcccagcactttgggaggccgaggcgggtggatcacaaggtcaggagttcaagaccagcctggccaagttggtgaaaccccgtctctactaaaaatacacaaattagccgggcgtggtgttgggtgcctgtaatcccagctactcgggaggctgaggcagagaactacttgaactcgggaggcggaggttgcagtgagccgagattgcgccactgcactccagcctgggtgacagagtgagactcccatctcaaaaaaaaaaaaaaaatagagcagtttacagaattgggtatgaatgggaggtgggagtgcttccttttcttggtacccacctattagcatacagtggttatgctaagacagaatcctgcccataatgatgagacacctgccctatttcatgatctcattcaatagtatcatgtgaaagggttgaaggatgcagaattgggccagtagtgctcagaaccttgaaagagttggaaattctctctggagtggggcaaatctacagcttataaagaaagcgagttgtcctggaaagcgcagcacataggtcaccagggatggccagcaggaggtaaagaaagtctcctagaaggtggttgggccggggaggtgagcagcctgcctggtagagaagcatgttggaaagtgctccacctgggagctggggcccagggacagaatgccacttatgaggcatgagtgagggcaggagaaaggaggaagtgacaagatgccccaggcctaggggaacctgtgtcctagtaggtcaccaggccctatgttaaagaaacgggaacctgaagaccagaaggcaacttggtgtcaggaacaaggtaacgttatgattggttatcataactggggcacgagatcagagctagatggacttgctccttattcctcttacagagagtaataatgattttcatcctgggggtacttaataagggctaagcacttatgtatattaatttgtttaatctacacaacaatcctgggaaatagattctgttactgttcctgtgttacaggaactgggaaactgaggcacagagaggggagtggcagagccaggatttgaacccagatactctggctccagagtgcaagctcccttcccatggtactgcacttcttctggaaaaagcatggtttagggagtcaaacaggcttggtttctaatcttcatttcaacctcttactatctttcttttatgaccttaggcaagtcaacgaaattttctgtgacccacagtttccttatttataaaataagaagcatgagattcagatcacacatggaagtgcctcaccccttgcctggccctcggtagggacttagtaaatagccattaatactactcctacaaataaacctttccaaactgagcacaggacttggcctggagcccggggcagggtttaatgtgtgctgaggatggggtaatttatctaggagggatgagaaacatgggggtcaaaattccaagtagatactgacaaaactaggtgctgatggcacaagctccaggagccttggaattagccaagttctccaactcgactggagactaggttaaaatctcaaagacctcatccctcatccctgtaattagcctcttgattgcctgtgaccttaccttaaataagccctgatttaacctaaaagagaagaaatcagaacatgacaagatctgctgtttcatcttcttacatatttctctttcatttatttattttttttgagacggagtttcgctcttgttgtccatgctggagtgcagtggtgtgatctccgctcactgcaacctccacctcccgggttcaagtgattctcctgcctcagcctcccgagaagctgggattacaggcgcccaccaccacgcctggctaatttagtatttttattagaggcggggtttctccatgttgtccaagctgatcttgagctcctgagctcaggtgatcctcccgctttggcctcccaaagtgttgggattacaggcgtgagccaccgcgcccggccttcatatttctctttatacttaacttcctttttccttatctttcccatttgcaagttactttctagttcttatcgatcatttccttattactgttttttcctccttaatgagttggttgctagataataccttcggtgtttttgagaatctgagaatgatggaggagaaatggaaagataggaatagaaagagattacattaggaattaaatttcttgttcctctttttctgatatgaaaccaaattggaggttagatcatccagaaagagaattcagtgttttccagttttccaacctgcttgctcataagaatgacttggagtggtagatcttgattcagtcgttctgaggatagcacaaagaatttgtatttttagcaaacactctccatgattatagtattatatgggaattaaacttaaaccttctttaaataaagcccccaagtttgacccattagctcagctatagaattactgaatatttttagtatggcaatactgtcaagaaaaagcactttataatgtgcttaattttctttctttctttctttctttctttctttttggaaaagtttaaggctatataaaaaatagagagaatggggcttctcgctatgctcagcctgtgtgtcatcattactgtcatgctggccattgttctctgctgctgtgcccgggccctgaggcctccttcacctctatccccaccaccactatccagtcagtttgctgctgcttccgtggttcacatgaggcagatgaggagtttgatgcatgctgggtgacatgcttcaacaagccagagatagatgcctgggaattgcataaagaattgaacacacttgctggctatgacctggttccagaaccccaaatcattgatgttgcttcgcaggcatgcagacagttcgatgcttttcctagggcagtttgcatcctagaggttgttaaggacaaggcaggacctcataagaaaatgtcatccaagaactcagaccaactttaaatgaattgggaatccccactccagaggacctaggcttagacaaagtgtgaaccccagggacaagcgttccagggatttattggtattgctacttgattgtaaacactcccctggaaatgctgatgataacatgttaccttatttgaacacctttttctttattgaataccaaaccatgttatggtaacttggactttaataaaagggaaatgagtttgaactgaaaaaaaaaaaaatagagagaatggtgtgttggactcccatgtaccctcaacccagccttatcagttttcaaaccatggccaagtaagaggcacttttgaaagagaacataggaggagttaccaaacagtaaaggcagaaattaaaagcaactgtgcctgctttgtttagaatacccaaaacctggaaacaatccagatgcccaccaataggtgaatgcatcaaccaattgtggtatatcttttcactggaatactattcagcagtgaaaaggaaatgaactatttatacatacaacatgcaagaagttaaaaataattatgccgaatgaaaaaagccccacccccccatatatactgtatgcatctatgcatataaaattctggaaaactatacatatgtaaaattctaaaggtctgcaacctgcattccaagggccaattccagcccatcacctcttcttgtaaataaggttttattggaacacgggcacactcaaggtattgcctatggatgcttttgtgttacaatggcagagttgagtagtggccatatggtgtgcaaagccaaaaatatttgtcaacccgcaggggttgaaacagacagtaaacaacacaaaataaatacaaacagataggaataatgacaaatcacagtcaatgccatgtcaatagagaatatctggggcaaaggggaaggtccagttgaattgaaatactcatcagtttctgagtgtgttctatagagtttttctgtctctgtgtctttgcacattctctcttttttatttttattttttgagacagggtcttgctctgtcacccaggctatatagtgcagtggtatgatcttggctcactgcaacctctgcctcctgggttcaagcgattctccatctcagcctcctgagtagctggaactacaggtgtgtgccacgaggcctggctaatttttgtattttttgtggagacagggtttcatcatgttcaccaggctggtctcgaactcctgaactcaagccatccaccctcctcagcttctcaaagtgctgggattacaggcatgagctatcatgcctgacctctttgcacattctcttgatctgttatgctgtttgttgccatctactgttgtcaaattctacctacccttcagggtccaactgaaatgccacattaccaggaaaggtttttctcattgtccctgccatacttcatttctcttctgcccttctgtagctcaggaccctctttaggtgtcactcccattagattgtaagtttcctaacaagacgcacgtcatcgtctccaaatcctttgggtcagcacagcctcttttatattaccagtctaagcccctttgtgtgacatttaaagtccgcctggactgactgttcagcctcatcctctgcccttcccttgtgtcctgggctctggccaaatcaaaccaccgttccccaaatgtactatgtagttaacttttaatattgcttctttttattgccttggttctctcaaaaatcagaattaatggaatgttggctattacaattacgtggacatggttatataatggccttggcgatgcccttaataaatgaaatctaaaatgttacattttttttggaacccagaaactcattctaattttattctgcctgaggctttatagcattttctgaagatcatgttgtactcttctttcgtctagatgatttggtcaacagtgataaagttccaacttagacttgataaatatgcaagagtcatgaaatatgaatgaaaacagtgacttttgaaaatcacgcttacctaaaaaaaaaaaaatcctgagtatggtttatatttactatgtgtgtaaaaatgtactgccattcttcattcttctttgttcgttaggttgaagaacaattgtaaaaattgaaggcatggcactaccgccgttatgtatagattaatgtggaaaatagcacgtggcgggtggctaatgactggagtcttacggacccaggtacttactgaaaaattcacttaattttggacataagacttggtcctttttttgtacataaatttaaatctccctttccttgtttacatgtattgctttttttttttttttttttttttttagacagagtctcgctctgttgtccatgctggagtgcagtggtgcaatctcggctcactgcaaccacaacctccacctcccaggttcaagccgttctcctgcttcaacctcctgagtagctgggattataggtgccagccaccacgcttggctaatttttttgtttttagtagagatgggattccaccattttgtccaggctggtctcgaacacctgacctcaaatgatcctcccgcctcagcctcccaaagtgctaggattataagcgtgagccaccgtgtccagcccatgtattgctattttatttacaatggagcattgtatattttacccactgtcagatggcagatgcagcgtatttctgcctgcatcccttggcccccacctcttatcctggttcccaggtgcagggatgctgttgcactggcataggttcctggcatatttgagaagtacaatttttgctgaaccacgttcctcttttatgcaacttggcacctatgtcaccattcaagaacaacttatatcaacaatcagtgcccttaaaaggaaatgctcacaacattcagcattctctctgtctctctttttttctttttttgagatggagtttctctcttgttgcccaggctggagtgcaatggcacaatctcggctcaccgcaacctctgcctcccaggttcaagcaattctcctgcctcagcctcccgagtagctgggattacaggcatgcaccaccatgcccggctaattttgtatttttagtagagacggggtttctccatgttgatcagactggtctcaaaaactcccgacctcaggtgatccgaccgcctcagcctcccaaagtgctgggattacaagtgtgagccaccacgcccggccaacattcagcattctcttaaaaaaaatttttttttgagacatggttttgctcttgtcacccaggctggagtgcagtggcatgatcatagctcactgaagacttgaactcctgggcttgagtgatcctcctgcctcagcctagtagctaggactacagggacatgccaccatgcttggctaattttttacattgttttgtagagacaggtcttgctatgtttgcccaggctggtctcgaactcctggcctcaagcgatcctcctgcctcggcctcccaaagtgctgagattacaggtgtgagcagccacaccaggtccacattcagcaccctcttgattcttgagcccaccatggtgtcagcaaggaaagagaggcagaggtaatttaacctacatataatttcttggttgccagcctccctgagtcttctccattgtccttcagatctgtagtgtttaaaggcctgaattgaatctcttgtattttctgtaaaattctgatattctctgctgtgcatcatatttatatttgcacagctcttaagttatttctcaatcagctgcctcccagtagcacacctttgcagctggcaccattgaaaaggtttccctcagacatgggagctctgactgcttgaagtcaatgggggctgggtgcggtggctcctgtctgtaatcccagcactttgggaggctgaggcaggaggttctcttgagcccaggagtttgagaccagcatggacaacatggtgagaccctgtctctacaaaaaataaaaaaaattagctgggagtggtggcacacatctgtagtcccacctacttgggaggctgagatgggaggatcacttgagcccaggaggtccaggctgcagtggacgtccagccactgtactctagcctgggtgacagagcaagaccctgtctggaagaaaaaaagtcaatggaacaaggcagcgtattgaaatattctttccttgggaaatgtatgtcataaatccttttaccaacagatgatttggatctttaaggctcccaggcacatgactttattctcaggagatggttaggcagtagattaagatctgcttattgccttgagactatataaagctcccaatacctatttttattggagaccaaatttctaacttgttcaattggtctgcttatggcagtgctgctctcccagtcatgggagaagacagttttacatttaaatggaatattctaactttgcttagtaagtaaatactgacccaaagataaacaatgggagaaaatggaatttcagtgtttcatgcaaaaagttcctatcacaagggaatcgcagttttcattctttgggtaggtaggtagatttctccatgttctgtgaaactgtgttgttgcggggaaggaagcaaaagaacaaatcaatagctgaggatgggggcatattaggaatttttttttttctttttgagatggagttttgctctgtcacccaggctggagtgcagtggtatgtcttgtctcggctcactgcaacctccacctcctgggttctagctattctcctgcctcagcctcccgagtagctggaattacaggcccccaccatcacgccaggctaatttttgtatttttagtagggatggggtttcaccatgttggccaggctggtctcgaactcctgacctcaggtgattcacctgcctcggcctcccaaactgccgggattacaggcgtgagccactctgcctggccgtgagccaccccaccgggcctgaattttgcttaatagaatcatgatgaaaatgaatgcgcttgaccagagaaaatggacacttgtgatgacttgggtagtgttcagaaatcactcagcctgtgagaactttgtgcttcttaggtttggcttgatattacaaagctaccactggttacttttatgaaagctccccaggtaaggggcagaggacagcaacctgttggtccagattaacattcagtggtattaagcagagactgtggctttcaactataagtaaaagcatgcttgggggagaaggaggaagggagaaaaaaaaaaatgagaaagcagaaagatgcaacaggggttggcaaagagtcaggagcagggagtgagggggaaagtaggtacatgtggtggagaaatggaagctctcccaatggttccatcagttccaccacactggcacagattctagaagtttcctatttctggagtaggacgcagacatgatgcatttcctactaagacagatttctatccaggaaacatcatttcaagttgcagtgccaggctcgaggatccttctccgtcattgcttcaagtgtggtgggttcagtacctcctttaatgtaagagctggcccgtcttccctacctacttgggacactttctagttttgaccttaagtagggtatcaggaaaattccgagaaagggaagacactctttttcctgaattacagaatagaccaactcattagaaaaaataaattaaagaggccaggcgcagtggctcaagcgtatgatcccagcactttgggaggccgacgcaggcggataacttgaggtcaggagttcgagaccagcttggccaacatggcgaaaccccgtctctactaaaaatacaaaaattagtcgggtatggtggcaagcacctgtaatcctagctactcgggaggctgaggcagaagaattgcttaaacccgggaggtggaagttgcagtgagccgagactgtgccgctgcactccagcctgagtgaggctggagacccagagcaagaccctgtctcaaaaaaaaaaagagagagagagagaaaaccagaacccctttgtttcaaaaccatccacatctgtctatccatccgtaaagcacaaagttatcagagacaaatcatggtctcattttgcttcatgcattttggacctgacatgagtccgtctttgatccctgaggggtggtagaaacaagcaatgcttttcagagtgaagctaaaaaaggcactctgtggaagagaatatattttatagatcagtgattagtgagtcttttcatgacaagttttgtattaattatgatttgaaaacctccagtgcagggttctcaggaattactaagtgcccctgggtacagcaagaagcactggaataaagaatctcaatgtgtgaccaaatttctaaattcttgggggtgtacagaaattagccacttctattttctctctctctttctctctctccttccttccttcctccctcccctccctccctccctcccttccttccttccttcctcttctcttctcttttcttttctttctttttttctttcttgagtctttctctgttgccaggctggagctcggtggcgctatctcggctcactgcaacctccacctccttgggtcaagcgagcctctcactcaccctcctaagcagctgggattacagtcatccaccaccacgcctggctgatttttatatttttagtagagacggggttttgctatgttggccaggctggtcttgaactcctggcctcaagtaaactgcccgcctcagcctcccaaagtgctgggattacaggcgtgagccactgcgcccggcctcacttctgttttctacttgtgtttttatttccattgcatttcctgacttgtgtatattttctcgttgtagaagcacttagtgttttggcactcagacttactttccagtgtttcttctgatcaatcaatagccctttactcatactaactatatgtgatggaagcaaagtcaggaatgtctaatgtgggggcagaattcactatgaagctacttagaatttcaccagccatgaatgatacattatccatcatgttagctagaatatactgggctccagtctcttttgggggatctttagggtccttctgggtgcagaagggaagatgacatttcaggagatctctgcgcattccaccctggcttccttccttccaggtaggctgagagaaagctttcttcttgatggtgctagtgagaacttggcaggtggagcaggaactgttagtttttcactccctgttggagtcattcacacatacagctcatatagaagacggatgtcttttgtcttggtgccaaagacttgaaaacagagaacggtaacttttatttatttatttatttttgagatggtgtttcgctcttgtcacccaggctggagtgcaatggtgtgatctcagctcactgcaacctctgcctcctgggttcaagcgattctcctgcctcagcctcctgagtagctgggattacaggcactcatcaccacgcctggctaatttgtgtatttttactagagatggggttttaccatgttgcccaggctggtcttgaactcctgacctcaggtgatccacctgcctcggcctcccaaagtgctgggattgcaggtgtgagccactgtaccaggctagaatggtaacttttgaaacccatttttgttattctaaagtcttcacggtgtggtgttgggaaggctgggttgctgtgtcagatgggtaccctcaccccagttatggctgttctcacatccaattccaggaagcctcattcttgtgtggtcatagaaaagcaaccttaattttcctgtgtcttagtttccttacctcctagaaatgtggcaaagatgcagaatctgtttatttagtaaatatttatcaagttctgggaatacagcggcgaataagccaccaaatccttccttgatgggactcaccctctaacacagccaaggcaatgagagaccttccaggaataacattgagaggcaaattatgcatgtaggtgacacatgaggccaacaggaaatgacctcgaattgaagttgaaatttacagtgcgagatgagccaagaatctgtgaacccttagaactcaggcaaggtgagctggtgtgacttgcaggaagtatgactcaattgtgactgtacccaagaaggcttaaaccacatcatctgaaagaaggatgtgccaacatacgcttccaatgactaaaaggaggggcagagggaaaaacaaaacagcatgttcccaggcccatcctaggaggaaggaaggctattaatacattcctttgacattgtctacttaccattgcatagagttggaggtgagtggcatatggagagacagagatttggagacagactgagtttgaatcccaattttgtcttattaggccgtggacaagtcatttcaactctctaagcttcaatttcctcattatttattttttaaaatagagatgaggtcttgctatgttgcctaggctggtcttgagctcctgggctcaagccatcctcttgccttggcctcctgagtacatacaggtgtgagccaccacacccacctgcccagccctagcttgctcactgtctttctttttttcttttttttgagacagagtcttgctctgtcacccaggctggagcacggtggtgtgatctcggctcactgcaacctctacctcccaggttcaagagattctcctgcctcagcctcctgcgtagctgggattagactactacactcggctaatttttgtatttttagtagggatgggtttcaccatgttggccaggctggtctcgaactcctgacctcacgtgatctgcccacctcagcctcccaaagtgctgggaataaaagtcgtgagctaccacgccggtctagcttactcaaacaatgtctagtttgcagggtagtgtatgtacgtgcctcagtgtctttggtgtgatatacacttagtaaatgttagttcagctctaacagactcatctgagattttgattctgtaactcccaagagttcagtatgctagcatttttttttttttaacatgaggaagagttgggtaaggaagagctgtgttttaattgcattacggctcaactgctaactgttttgatatgttgaacaaagtccattgattcttcatggaggagtgcttgctggggagtgtgagtcagcacgtctgcgttattaacttgttcggaagctttttgtggcagattgattttaaaagcccccaaggaaacagaggattttatttaatagaaatattgtcagaatgacattgagatttgggtttagctttcaaatcactggatacaagttgaatcaggtcttttctctgacagatattggaaacatggtgtgttggagaaatactctccattgcctggcagggcccttaccttgggagagggggatgatatttgcctggagcaccccggtgaccccacctagcaggcctgactttctaaaggcaaggatgtgggcttggtacagagaggtggcgaaacctgaatattagtattttcaaatctgattactagtattttcaaccgacctgactaggcgcaaatccatgctcatttaaatgaaagtctacctgaaatcatgcctcactgcaaccatgcacttctgggcttaagcgatcctcctgcctcagcctccctgaaggtccacctgcatttgaataaggatggatgtgcgcccaggtatgtctttgtgggtttccatcctatagttctggagcaaaggacaaatggaagaaagttgctaaagaaaagaagagcgtttctgtggctccttcaagagcagttacagatttctgtcctgaagccaggagggaatatgtggcccaggtcccacagtggagagttgcaatgctccctcttgggcatctctgtcctcatttggattcagggctgaaacttcgggatcagtttcacagaagaggtttcaagtagatttcttgcagtcctgaaagtcacacttctctgaaattggtttaacaccaatccaaaacctattggtgttcctgttacattttacaactcttcatatgccacttaagaaatgacctctctagaattgtgactccagcctaggcaacagtgggagactgtctcaaaaaaaaaaaaaaaaaaaaaatagagttgaggatgaggagctcaagaataaaagtgagatgggatggacagagaaaaagcaggaaaactagcgaatggtatggtagaagccaatagagaaaggactttcaaggtggagggagagaatttaagagttgggacttctcttccagcaagaagaggaagaatggcataagagggactgtgatgtaggcactatgtcaccatcgtatttaatccaaactataactatgcaagattaccacttgaccttcaagaaaactgggctggctgggcgcagtggctcactcctgtaatcccagcactttgggatgccgaggcaggaagataacctgaggccaggagttcgagaccagcctggccaacatggtgaaaccttgtctcttctaaaaattcaagaattagctgggcgtggtggtgggcgcctgtaatcccagctactcaggaggctgaggcagaggaatcgcctgaacctgggaggcgaaggttgcagtgatccgggatcgcactactgtgctcctgcttgggcgacagaggaagactccgtctcacaaaaacaaacaaacaagcaaatatacaaaactgagctgaggagacaattcgacaattcatgcagtcaataagtaggttgcagaggttggagtacagtggcgtgatcggctcgctgcaacctccgcctcctaggttcaggcgattctcttgcctcagtgtcaggcctctcagcccaagctaagcatgtgaccttcgtgtatacatccagatggcctgaagcaactgaagatccacaaaagaagtgaaaatagccttaactgatgacattccatcattgtgatttgtttctgccccaccctaactgatcaatgtactttgtaatcttccccacccttaagaagtttctttataattctccccacccttaagaatgtactttgtgagatccaccccctgcctgcaaaacattcctccaaattccaccgcctatcccaaaacctgtaagaactaatgataatccaccacacttcgctgactcttttcggactcagcccgcctgcacccaggtgaaataaacagccatgttgtgcgcgcgcacgcacacgcacacacacacacacacacacacacacacacacacacacacacacacacacacacacacagagggagagagagagagaaatgacctctctagagaaagaagaatcaccatggtatgggagaatgaacccctcagaaatggtcacagcttattcaagtcctaaacccttgctatgggcaagggttgacaaactttttttttcttttctttcttcttcctgtcttctttcttttcctctctctttctctcactctttctctcccttcccctccctccctccctccttccttccttctctctcattcgctatttcttttctttctttcttttttttttagagacagggtcttgctctgtcacccgggctggagtgcagtggcgcaatcatgcctcattgcaactttgcactcctgggctcaagcgatcttcctgcctccacctcccaagtagctgggaccagaggcacacaccaccacgcttggctaattaaaaaaaaattttttttttaaagagatggggtctcactgtgttgcccaggctggtctcaaactcctagccttacgtgatcctttcacctcagcctcccagagtgctgggattacaggtgcaagccaccatgccaggcagcaaagtttttcttaaaaggccagaaagtaaatatttttgcctttgccgatcataaggtctatgtcacaaccactcaactctgccattgtagctcaaaagcaaccatagacaatagggtcaaggagtgagtgtgactgtgtttcaataaaactttatttaacacataggcctccctcctgcaatcccttttgctgatcacttcatagaccatcatacacttcctgtgctctttggagcttgaaaatcatactttggagtaagaaattcttttgaatataaattacatatgtttggctgtggagaaataggaatgcttttacactgttggtgggaaggtaaattcgttccaccattgtggaagacagtatggggattcctcaagactctagaaccagaaataccatttgacccagcaatcccattactgggtatatgccctaagaaatataaatcattctactataaagacacatgcacatgtatgtttattgtggcacgatttacaagagcaaacacatggaatcaacccaaatgcccatcaacgatagactggataaagaaaatgtggtacatatacaccatggaatactatacagccataaaaaggaatgagatcatgtcctttgcaggaacatggatgaagctggaagccatcatcctcaacaaactaacagaggaacagaaaaccaaacaccacgtgttctcactcataagtgggagttgaacaatgagaacacatggacacagggaggggaacaacacacaccggggcctgttggagggtggggggcgaggggagggatttagaggatggatcaataggtgcagcaaaccaccatggcacacatatacctatgtaacaaaactgctcattctgcacatgtatcccagaacttaaaataaaaataaaaaataaattacatatgtttagagaaaggaagcttccatatttatgtatcatcatgatttttttaaaaacttatttaatttgcatacaaatttgttccacatttgtttcctgtaaaatggattcctcataaatgcttggtaagagtatccatgtttgatgtgaaacaaactgatgatgcttgaattcctgtttactctgaagttcttttcacatgctggtgagttctgagcaccatgcttacatgcacctctcctttgcagcaaacataagttttgaggtccctgtgagtcctaatggcaccgaggtgctgtctcaggtgaccttctcctaatcctgaaaaagtctccatgattggccctggaggagttctcctggttgtctggaatgagttcatactaatagtcagggctctgggcattgtgagaccctggctactttctttctttcccacaatgtatactttctcactatttatttatttatttttttgagacagagtctcgctctgctgcccaggctggagtgcagtggtgtgatcttggctcactgcaacctccacctcccaggttcaagcaattctcctgcttcagcctcccgagtagctgggaccacaggcgcccgcaaccacgcccggctaattttttttgtatttttagtagagatggggtttcactgtgttagccaggatggtcttgatctcctgaccttgtgatcctcctgcctcggcctcccaaagtgttggtattacaggcatgagccactgcacccagccatgctttctcactatgaaaacctcctcggactcctcggactcctcacaagagtgagtgagctggatttgctgtattttcaaagtcatccttcattacacatgaacattggctgcacccgagcttggctgtgaactgattattctcaccagggcctgttaacacaaattccatcactcctacagctaaaaataaaccatatttaacaagtagaaacaaaactccaggcaaatacatcatctgatttgatggaatctttgttgaaaatgttaatggtggaatcagatgcttacctttaagatgggagattgcattccttcgtgagcaaggtgcctagaaatcaattccaactcttgatatgatcagagagattgatggatacctaagtgtctgaaatgataatagttcatcttgtctaagggcattcccccatttgtggcacattgtccttgacgatcagtcttctatttattttattattttattttttacagatggggttctcgatgtgttgcccacgctagagtgcagtgactgttcacaggcaacatcattgcacactgcaggcttgaactcctgggctcaagcaatcctcctgcctcagcttcttgagtggctggcactacaggcatccaccactgtgccaggctcagtcttctatttaaataatgctgctactttagagggtttaggaatatttagtgtttacagctagtgtctctgtaatatgaaaacatactgtgccttggctgggtgtggtggctcatgtctgtaatcccaggaatttgggaggccgaggtgagaggatcacttgagcccaggagttcgagaccaacttgggcaacataatgcccatctttttaaaaaataaaaaacaaaaattagcagggcatcatggtgcacacctatagtcctagctaatcgagaggctaaggtgggaggattccttgagcccaggaggatgaggctgcagaaatcgcactactgcacttcagcctgggcaacagagtgagaccctatctcaaaaagaaaaaaaaaaaaaagaaagaaagaaaacatactgcgcctagcaatacaaatagtgacctgcgggtaatgagattatagatgattttaaacattcttcttgataattttcctgtgttttacaaatatttaataatgaatatgtactactctaagaaaaacagtacaaaggttttcaaagttttttgacagtcatttacctgcagtaagtacgttatacatcccaaccccatataaactagcatttatgtatttataaacttaaaacaaacattagttaaccatttttttctacttgtcttgctttttttttttttttttttgagacggagtctcgctctgtcacccaggctaaagtgcagtggtgtgatctcggctcactgcaacctctgcctcccgggttcaagcgattctcctgcctcagcctcccgagtagctgggattacaggcatagtgccaccacgcctggctaattttgtatttttagtagagacggggtttctccatgttggtcaggctggtctcgaactcccgacctcaggtgatccacctgccttggcctcccaaagtgctgggattacaggcatgagccaccacgcccggcttttttacctacttgtctttacctcctgatgttttctgtttttctattctattttatcaaagaaggaagaaagaaaaaaagaaagaagaatattcatgtattgaccaggtaaaatgatttcatgaaccactgatgggtaaattgaaagctagtgattataggacagtggttgccagtcttgtatttcatgggtcagtaaaatttaaaagaaattttggggattgatgtaagatcatctgtttttcatgttgcaaagtaaggatgttttaaaacaaggtagctgggcgcagtggctcatacccgtaaccccagcactttgggaggccaaggcaggtggatcatctgaggtcaggaattgagaccaacctggccatcatggtgaaaccccatctctactaaaattacaaaattagctgggcgtggtggcgattgcctataatcgtagctactcaggaggctgaggcaggagaatcacttgaacctgggaggcggaggttgcagtgagctgagatcgtgccactgcactccagcctggatgaaagagcaaaactctgtttcaaaaaaaaaaaaacttacaaagtaattatttctaccaccattattcttttattcatttgtcatttaaaatcttgtttttatgaattttatgatttgagagaattttcatgtcaaaatatcctttcttttctgaaagaatattttagcattaaatattagaaggaatacaatttcagtagttatgtgatgaataaatttagctttctgaaaacagaccgcacttgctttgttttttccatttggcaatgaacctgtgcactagcatttaggaatcatttaggaattatcagtgtagtggaaacagccttgctttgaaacaacacaattttacttccagttctgaatcatttaatttttctgaacttctttttacccatctgcaaaagaggaatctcagaggtatagcaataaggtttataaagggtttaagacagttctgaatgcgcaggagtttatagatggtaacgtcttttctctggatcattaattctccttactactctgtgattttaaaaacttagaatgttggctagtgtggtggctcatgccagtaatcccagcactttgggaggctgaggtgggagggtcacttgaggtcaggagttcaagaccagcctggccaacgtggtgaatccctgtctctactaagacacaaaaaaattagtctataatcccagctacttgggaggctgaggcaggaggatcgcttgaactcgggaggtggaggttgcagtgagctgagatcatgccactgcactcgagcctctgtgacagaacaagactctgtctcaaaaacaaaaacaaaaacaaacttagaatgttggccagtgtggtggctcatgcctataatcccagtgctctaggaggcagaatgctctagagggtggaagcgggaggattgcttgaggtcaggagtttgaaaccagcctaggcaaggtagtgagacctctgtctctaaacaacaacaacaaaacagctgggcgtggtggtgcacacctgtcgtcccagctacttgggaggctgaggtgggaggatcagttgaggccgggagttcaagatcagcctgggcaacatagtgagaccctgtctctaccaaaaaaaaaaaaattagacatatgcagtggcatgtgtctgtagtcccagctgctcaggaggctgaggtgggaggatcccttgggcccaggaaggttgcagtgagaaatgatcacaccactgcactccagcctgtgtgacaaagcaagaccccatctcttaaaaacaaaaccaaaccacacaacaacttggaatgttgaaagaagttcattatgtgtttccattttatgatgaactatttctttaatttttactctttttagttactgtttcttttttttttttttgcgatggaatattgctctgtcgcccaggccggagtgcagtggcgtgatcttggctcactgcaagctccacctcccgggttcaagcgattctcatgcttcagcctcccgagtagctgggactataggcgcccaccaccacacccagctaatttttgtatttttagtagagacgggatttcaccatgttgaccaggctggtctcaaactcctgaccttaagtgatccatccgcctcagcatcccaaagtgctgggattacagagtgagccaccgcacctggcctcatgtcttgtcttacctacggctttccccctctttctgcgttttctccaccctttaccgctgagtcagcctctgtataccattattcatgatgggaactcagcttgtctgacagttggttttaaggcacaattagaaaatattccttgatagtacaatgagtttgcagtttttaagttgtggttttggccagagatattaataagggtttggacgttgagtggaatactaagaataagaaaggggatgtgcttaaaatacatctcatgtgccttctgtttaattacacggtaatttgtaaaagagactggtttctgtggccttgaatactaatatagactttccctcaccacagcttatcttcgagtcataaacacagaggcatgcatagttcacacatctccatgtattttctgtttccaaggaagatatgatcactctgaagaaccaaaagatgagtcactctgaaaacttttcttcctttgtcttaatgtcatgactgtcttaacaattgactgtgtttatttcagcaacatttatctttagtctcttctctttggctcagtcagatgttttcagtttcacccagcacggaccacagccatattacctcctatatcccagtggataacttctgcaggaaaacttcagctacttgacactcttgggaaacgagctgggtgttcctgataagaaaggtttaccagaatcttgtaaagatggtttctctaataatagctaacatatttataagcgtgctatgttttagaacatgggtgtccaaacttttggcttccttgggccacattggaagaattgtcttggaccacatataaaatacactaacactggccgggtgcggtggctcacgcctgtaatcccagcactttgggaggccaaggcaggtggatcacgaggtcaggagatggagaccatcctggctaacacggtgaaaccccgtctctactaaaaatacaaaaattagccgggcgtggtggtgggcacctgtagtcccagctactcgggaggctgaggcaggagaatggcgtgaacctgggaggtggagcttgcagtgagccgagcttgcagtgagccgagattgcaccactgcactccagcatgagcgagagagtgagactccgtctcaaaataaataaatacataaataaataataaaataaaataaaactaatgataactgatgagctaaaataaataaataaaggtccgtgtataatttttgtgatatctgccaccacagataagccaaaaagtcctcttattcaaagggttggacatggctgtttcagtaacttcattacaggctttgtgaacattatctcatgtaatcctaaaacaaaacaaaacagaacaaaatgactttccctgtctcgatttcctgagtgatctttgtaaacatcagctattacagtgtgctcttttgtgtagatttcaggtgtatgtgactcttgtaagcattcagcttaccactgtttattgagtgattattatgtgccagatacagctctggacacaggtgtgactaaaacaaactccctgccctcaaggtgcttatattctggaggtgggaggaggaccctgacaacagcatggaaatatacaaatataatataatgtcaggtagccacaaatatagcaggatatagggacagcgagtgggggtggggagagtggtggcggaagacccttgaggaggcgacagttgagcagagacctggatgaatcgtgggagcaaggcttgtagatatttggcaaaagagccatttgattgtgacttacgtggttctccctcttctgctttctatagttttcctgtctcctggcagtcagtgccaggaaagaatttagttgggccagaccaagggaagccagacctagaaaggaggcaaagctacaggtgcagagcagagattgctaaggtcttagccgcgggctgcgggagcgagcctgggcgggcgggtaaggctgtggaaccggagtctggagagtctgctggctgcgcacaaacacggctgtgcttctgggcagatgaatggagggcaagccagccccgggcagaagatagaacagagaggaagctggggagccgggtgcagtaactcgaaatcccagcactttaggaggccgaggagggcggatcccttgaggctaggaattccagagcagcctgggcaacatagggagagtctgggtgtggtggcctgcgcctgtaaacccagctactcgggaggctgaggcagaaggatcgcttgagcataggagtttgaggctgcagtgagctatgattgtgccactgtgctacagcctggatagtagagtgagactccatctctaaaaaatagaaataagaaaaagaggaagccaggtgcaggctcaggaggctgacgcaggaggatcacttgaacccaggaggctgacgcaggaggatcactggaacccagcagtctgagactagcgtgcaaggatcacccctgtgaatagccactgcactctagcctgggtgacatagcgagactctgtctcctcctccccataataataataataataataaagaggaatctggtgctggcatagaggtacaggctggatgggagggtggtcaggatggggcaaggggccgagaccacaaatggtcctgctcctggggcttagaacgggacctggttctccagggaggtgaagaggagcaaggccagagctcagcagcagaagctgtggtttaagagagaggcttgattatagatgttaggaagtcaagagcccagtgcctagaacctgggctgcagacggggaatgaggcttatggctccgtaatggtgatgtaatgctgacacctcagctgtggcaccacagagtcctgtgttacccctccctgtgcccacacaagattaccagaaactactttgcatcccattgaatgcaatctgctctgtgcctcttttgtaaaatctgcccatttacacatggtgttgccaccccagcctgggaactgagcagcaagaggaagcctcccacccgccccactcccaagtagcgtttccttttccggctcccacaggcccattacataacctttcttagggccctctgcacagagctgtaatctttggtagaggggcaggctgtgctttagaagcccggagctcaggctgggcgcggtggctcacacctgtaatcccagcactttgggaggccgaggcaggtggatctcttgaggccaggagttcaagaccagcctggccaacatggcaaaaccccgtctgtactaaaaatacaaaaaaatttgccaggtgtggtggtgcatgcctgtgatcccagctactcaggaggctgaggtgggaggattgcttgagcccaggaggtggaggttgcagtgagctgttgcaacagggaacaacagagtgagactctgcctcaaaaaaaaaaaaaaaataaaaaaataaaaggccaggctaggtggctcacgcctgtaatcccaacactttgggaggctgaggtgggtggatcgcctgaggtcaggagttcgagaccagcctggccaacatggagaaaccccgtctatactaaaaatacaaaaattagctgggcatggtggcgggcacctgtagtcccagctactcaggaggctgaggcaggagaatgacgtgaacccgggagatggagcttgcagtgagctgagatcacgccactgcactccagcctgggtgacagagcgagactccatctcaaaaaaaaaaaaaaaaaaaaaagaagcccagagctcaagatctggtcagactccctggtttgaaccttggctcctcttgggcaaattacgcaacctcagttacttcatctgtaaaacggaaattataatagtacttacctctgcaggattcttgtgaagataaaagccacagaacagtggctgggccccagaagtgttagtgcttttgacgtttctgtaaccttcactaaacgtgacaccctccggggccattgtaggcatttttgtaccctcagtgtctaacatgttacccagcaggcacatggattcattcaacaagtatttattgaatgccttcttccaggccctgggatgcagggacatagccaccaatgagacaaactcctgcccccatggggctgacattgtgctgggggagacagactgtaagcaagtgaacaaggacacaaataatacagtttcaggccaggtgcggtggcctacacctgtaatctcagcactttggtaggccaaggtgggcagatcacgaggtcaggagttcgagatcagcttgaccaacatggtgaaaccccatctctactaaaaataccaaaattaggcaggtgtggtggtgcacatctgtaatcccagctactcaggaggctgaggcaggagaatcgcttgaacctgggaggaggaggttgcagtgggccgagatcatgccactgtactccagcctggacaacagagcgggactttgtctaccaccgcaccctccccgccaagaagaacaatttcagctagtgataagtggtataaaaaaataagttggggtcctgtaatcgagtgacctaagatgtgtgagatacatggttggtggtttttttgtttgttcctttgttttactttttatttttttgagatacaatcttgctgctctgttgccccaggctgcagtgttgtggtgtgatcatagctcactgcagcctccaattcctgggctcaagggatcctcctgcttcagcctcccaagtagctgggactacagatgtgtgccaccacacccagccacccagctaatttttaaattttttgtagagacagggtctcactttcttgcccaggctggtcttaaattcctggcctcaaaggatcctcctgcctcagctgcctcccagagtgttgggattacaggcctgagccaccgtgtctggctgggggtgctattttaaaaagaatggacagaaaatttctgcgaggatttgacgtttgaacaatggtcttatctaagcgacaatctgagagacagctgtccagacacagggagcagcaagtactagcatggcctctttgtgtttgagccaggagaggaataaaggtgagggtgagggaggcaagaggtaagcagaaggtagggaggccagggaggggaaggagggtgatggaacgaacgtaccggacagggcgtggaaagcgttcggggcctggctgggagtttgggatatgtcctttttgcaatgggagccactgagagttctaaaaccagaagtgacataatctgattcatgtttcttggctgtgtgcagagctttgcaagaatggcaacagggataaaagtcctgagaccagggaaaacccaagggtcttggatttgtgtggatggctgaggtaaaggagactcattccatggccttttctggaaagctgggtcatctgttaccagttttattgattgtcttctgtagcaggttgaatagtgtcccctcaaaatctgtgtctgcctggaacctcagaatctgattgtatttgaaaataggggtgttttttttttttttttttttttttttttgagacaggatctcactctgcttgcccaggctggagtacagtggtgcgatcacagttcactgcagccttgacttcccaggctcaggtgatcctcccacctcagcctcccgagtaactaagactacaggcttgcaccaccatggctggctaatttttgcatttttagtggagacagggtttcgccatgttgcccagactggtctcaaactcctagactcaagtaatccacctgcctcggcctcctaaagtgctgggattacaggtgtgagccactgcacctagccggcagtagggtttttgcagatgtaattagtgaagggcctcaagatgaaataatcccgaaattagagtgggacctgtatccaatgactgatgtccttataggaaggggagcggacatagagagacacagggagaagatagccccttgaacatggaggcagaagttggggtgttgcagccacgagccagggaacgcctggggccaccagaagctggaagaggcaaggacagatttcctccagagcatggccctgctgataccttgattttgggcttctaccctgcagaactgcgggagaacacatttctgttgctttaggcacttggtgatactgtgtttctgcagccctaggaaactaatgcacctcctaagcatcactggtttcttaggaatatttgcattggggtgcaggcatgagagaggcctcatcaggaagactggccattctatagaccttccttaagccctggagaggtgggtggtcttaccaggaactcaaaggagctctaagatcccagaggaggtccctgagaacgaatgaacaaatgaatgaatgaaagggcccaaggccgagtgcggaggctcgggcctgtaatcccagcactttgggaggccgaggcgggcggatcacttgaggtcaggagttggagaccagcctggctagcatggcgaaaccccatctctactaaaaattacaaaatttagctgggcgtggtggcacacatctgtaatcccagctgctggggaggccaaggcagagaattgcctgaacctgggaggcggaggttgcagtgagcggagatctcgacactgcactccatcctgggcggcagagcgagactctgtctcaaaaaaagaaaaaaagaaaaaaaaagaagagaaaagaaaaaagaaaaacaaagatcctaagacagggctgtgtctgaccttcaggtcactcaatagccctagccatgaacgttgtaattgaccctctgcagcacatagacctctagtcagtgcagccaccatcattccgctgtgtgccttctaagctgttctgggttgtaagatctttgttagaatttggataaagagaacagagttctaagtgactttttttttttttttttttctgagacagagtctcgctctatcgcccaggctggagtgcagtggtgtgatctccgctactgcaacctctgcctcctgggttcaagagattctcctgcctcagcctccccagtagctgggattacaggcacctgtcaccatgcctggctaatttttgtatttttagtacagacagggtttcaccatgttggccaagctggtcttgaactcctggcctcaagtaatctgcctgcctcggcctcctaaagtgttgggattacaggcgtgagccaccgtgcccagctgggcctaagtgactttctaatgcacagaatgtgtgaattttagaatatgatcttttaccatccagttttctggactcagaagtaacttttccttcctctcttttaaatgttcattaggtcaaattagaactgaagaagcaaccctgaggtataatactctgccccagcaacaaaaagcagtactgctgctgacttacggctactattctgagttgaaagtgctgaaaagaaaactccaggccatgcgcatttaatttgattgtaatcctgccagagatccacctgctttgctcccatccgtttcccttggcctgtcctgtagaaagggactgcaattgagcacttttttaaattaaaaaaatgacctgcactctccacaaaatacaggtccaaatggcagtagcttattggtcatcagtttctcctaggaaacctgggccacaagtttctggttggtttcggacacacagtaggtgctgaattaattaaaggtgtttctttaattcagcccagaagcatctgatttgcttaggaaattgattaggcatatattacctggatgatgtcaatttctatgtaaccatttctctcctgtgtaattgatgagcctcctaatgttgattttattttattttaccaagcactgtatttagttaataaaaaatacagaataggattcaaaacagctgtgtttgctattggcatggccgtcaccctcctaatacctgtgcatgtcataatagactacatttgcagaaacaaaaggttaggaataaaaagatgacttttgtccctccagctgccagtgacaacccacagcctcagcttatggtatttatttaatcttgtatctgtgatagggctctgagacacttctgtgaagcagatgtttgaagatctgacaattatggaagaaaatttctcatagaaaaagatatgttctccagccttgggcgggggcctgacattactcttccacatttcactcattcatttattgaaaaatgaaaaattatatatatttataatataccaggtgatattttgatatgtgaatacattgttgaattattatgttaagctaattaacatatctctcaccttacatacttattttttgttgatgagatggacatttcttttttaagtatgcttaaatgtgttcacggattgtgtgaaatttttggcatcccgtttcttgatataccaccttttgccacatttcttgtttatatagtatgtatctcagccggtgatgaatcaaggaaaaagataaagaaaaacaaacaaacaaacaaaaaagcaaacaaacaagttaaaacaaacccaaaaccttctttcccagtaggcagtaatttgggatgtaaaatgtatgaggtaggcaggaggaagatgaaaagtctgtctgaaatgagaactgtctgttggcttaattcaggtgatcacagattgtctgtagccttgagcaaagcctagagaatagtgaggctagtaaaacactagcccttgggctcaaaatttaagatggcaccaaaaaactaaaaatcagggtaaataatattttgatgcaatatttttaaaaaataaaaattaatgcacaatactctacaatgaacaaaatatcaaaatgctaaagacaggctctaaccccgcactggcaaacgcaacctcacttgtctccttctaatcctggccttgacccctaataacaaaaagtaagatcatctagacctcaaaaggaaaagttgctagtccctctaagccttcgtttgctctgggtttgaatccaaactctgttatgaccaacttagtgaaatcaggcaaattactcaacctctgtaacttccttttgaaaaatggagatgttttctcttgcaagactttttatttatttatttatttatttatttatttatttatttatttatttatttgagacagggtctcactccattgcccaggctggagtgcagtggtgccatcatggctcactgcagtctctacctctccaagcttgggtaatcctcccaccttagtctcccaagtagctgggactacaggcatgcaccgtcatgcctggctgattttttttttgaaaaaaaattttttttatagggataggggtcttgccatgttacccaggctggtctcttaactcctgggctcaagaaatctgcccacctcagcctcccaaagtgctaggattacagacgtgagccatcacgcctaacctcttgcaggacttttggggtggtttaaaaattacgcctgtgtagcactgggaacattatgacacccaataaataccaaataaacaacagctttaaatattataattcataatgattcacagagtattaagatccccaggcgatgcaaccaggtagtacctaagtgtatcagtcttgggtgcatctgtcagggttaacctggctttgtttttaactttacaggacatatcagagtatagctattgtgcctgtgctttgaacactcaaacatccgctcaactgctaagtaactgatttcctgtttagtcacagctccttgtctgggaccagccactggcagcaaattgtcatcttctgtatctccctctcaaagcaactcagccttctgaagacgtgtagaagttaggtctcgcaggcttgtatttattaagcccccccccgccacccatcagtccccagttattttgagtgtctcaaacgcatttcccacacctgatgattcatctgaggacgactcacccttgttgtcactgacactgtccacagcccagagctcagcctctgatttgctcggcagagatggggctatgtacatatcgtgtgagacggaagctaacataagcagaggagaaatcacggaagcaaagtgaagtgggaatccagttaatacttggaacagaaaactggaaagcagctcattcattctctccgattgtaaaaggcggatggaaacaacacttttgtcagcctttcttctaatccgatcacagctgtaaagaccataaagccaagccccgacgtcaattattcttctccctgttcctaagaatgtgaaattagatggggaaaagtgacagaagagtgtcactaaaataacttattacactttgagggtcttagtcgtcattaatagttgttactttttgaatattcatcagtgcgccctgctgttcggcaagagaggctgtatgaagtaggaactgcacacgcctggcttcagtcatgtatgccttggatttaagctcttcttttccacttaattagttaacaggaacttactgagctgggtgcaaaatgatacagaagaataggagaatgggattgtaacccctgaagcgtttgtgatttagttgagtagaataaactctgctgagcccaagctgagcctcagcctcatgcacctgctgtatttccacattctttcatttctgccccagaaatgttgcttgaatctggtttctcctctttaaccatctaaacttttactattgctttaggactgcctctcctcatttattgctatgttgattgcactgccctgccaaaccatattggagctggatcaggggaaaataagcatatatatatatatatatatatatatatatatatatatatatatgcatgaaaatatcctcccatattgtggaccaagtggaaaagttaatgaagctctacaatgaaaaaaaaagttgactatgagtaaagtctcatgttgtccaatctgtaatcctattattgtcaaccctcgtaagcccgcccagtggatgaggtggtgggagatgacgagggtgggatgggcattctgcagccagtggggaagaaggcagggccctaaaacaaacaagaacaagcatatctttatttagaatttggatgtattttcatcgtgaatttcctttgcattcattttgattaaaaaaaaatgcattatggctgggcgtggtggctcacgcctgtaatcccagcatattgggaggctgaggcaagtggatcacttgagcccaggagtttgagaccagcctggccaacgtggcaaaaccctgtctctaccaaaaatacaaaaatatatatatatattagctaggcatggtggtgtgcacctgtagtcccagctactttggaggatgaggcaggagaattgcttgaaccaggagacgaagggttgcagtgagctgggattgcatcactgcactacagcctgggcaacagagcaagactctgtcccagaaaaactaaaaaaaatgcattaaaataatatttatctgtattgctgaggtttgaggcaccctcttaaattttacacctaggcaatacctccagctctcacactaatccaggctctggtctattacaaaagtccccgcgggctctgacctacacagctgccagttaccttcctaacagacgaccagtgatcatgtcactttcttgttaatccagactgctgggagcgaaaattcagccccctcggtttggcgttgaagcccctttacaatctggcccccacctaacccaccagggcgcctgccctgtctggccctgttcccacctctcttgcctcatcaaacttctgccagactgcacctttgtccatgctctgctgtctgcctgaattgtgcccctgtctcctgaattgtgtctccaagccccttcacctaaaatattcctgttagctctcaagtttcacctcagatatccctgactggctgggcagacttcttagactctcgcaagcaggcttctttgttctgttttcccataggaaattgttcgtttccactcaattcatatcttggtggttgcattcatttttcgactgtgatttatctgtttaccggtgtccctagttccactgccagctccttgaggcgagcaaccggggcttttcatgtctaatgaataaatgaatacaatttgacacagtgaaaaaggcaggaacagcaaccataaaaaatccatgaaaaacaaaagcacagaggacaataggcagagaggacactggtcttttttttttttttttttgagggggaattctcactcttttgaccaggctggagtgaagtggtgtgatcttggctcactgcaacctctgcccccagggttcaagcgattctcctgcctcagcctcctgagtagttggaattacaggcgtctgccaccacgcctggctaatttttgtatttctagtagagacggggttttgccatgttggccaggctggtctcgaactcctgacctcaggtgatctgcctgcctcagcctcccaaagtgctgggattacaggcgtgagtcactgcgcccggccgacactggtcttaaaatcaggagaacctggatttggcttttggtcttgtcattagccagctttacaactctgtcattattttcagattttttactatggaaactttaaaattgtagcaaaaatagaacagcctgatgaacccacatgtacccatcatccaactagaacaatgtgggttcatcaggtttcttgtcatactgccccgctctgctacccccatccctggattgtttggaagcaaatcctagaccttactgtcacttcacatataattattaaaggaagaacatgaacattgtaattgattgcaaactcaccatgaacctggtggaaagaagagatcacaataggccgagatcacggggaagctcttggaagcaagttatgaaggaggaatacggattttggcagagaaagtctgtaagtaggaagctgtaaatcatgtgtccaacatgtggtgagcagattgttttatctggagtggggactgggtggcggaggggggtgagcagaggaaaatctaggcctgggacagagaggcagcctttgggcaatgggacagactggagactcttttagttttatgtaatgcaagggctaaggaaaaaactttgcctttgtcccctgaaggtttgctgaaaaatcaactgacaaaaagcagattaatagaagagaaggctggccaggcgcggtggcccacgcctgtaatcccagcactttgggaagttgaggcaggaggatcgcccaaggtcaggagttcgagatcagcctggccaacatggtgaaaccctgtctctactaaaaatacaaaaattagccgagcgtggtggcatgtgcctgtaatcccagctactcgggaggctgaggcaggagaatctcttgaacccaggaggcggaggttgcagtgagccaagatcgcaccactgcactccagcctgggcgacagagcgagactcggtctcaaaaaaaaagaaggcaaggtatataagtgtattagtgtgcgctgtgggaggagggaggaacacagagtgattacccatatcctagtggggtacagatgtttatatgtcttgttttttttaggggaaaaggagatggggaagtgtggatgattttagggaggtaacagatgatttttaggggaattcaatgagcttgaagaacatacaatggcttgggacaaagtctgtttgggcagacaatggtttgtgacaaaaatctttccaggtgtgttgaccgacttcagtgttttgccctgtgatatgggttcagttaatgaaaactcagggagggaatggatcagaggtgattgttttcttttttgccaggtctagacgttaggcagataagggaactccagagaataacttttattctgtgttttgggaggacagaaatgatgggaaagggaggaagatcagagatacattgaggcttcttcctcaattcagcatgtcaaagcgccatattttgggataccgctttctgagccccaacagtaactaggtattattttgaagggttgcattcacacttgtgacatggagtaaaggccagtggtaatatttctgtagagcgctttagttctgtctctcaatgtactttccttgttaactaatttctcctttagtagcaaaaggaattgtgacaggtgcatttaaagaaactgttacctgcaccaactaccaggcattcgttagttggggagaaatgagaactcatgttttccatactcagccctaccccaagatgacctggcaactgtacattttatcccactgggtttaatccttattatgaataacagagcgaaactttgttattcatgggagtggatttctcctgctgagagaattagcggcaatctcattcaggaagctgccttctgatgcaatgaggtcttttgaactgtgcataaatagaggccattctttaggcatttggagcatagggcttaaattgctccagaagttccaatcagactctaggtatctttggctgttttttttgtattttttttggttttttttgagacagaatctcactctgtcgcccaggctggagtgcagtggcacaatctcggctcactgcaacctctgcctcccgggttcaggcaattctcctgcctcagcctcccaagtagctgggattacaggcgtgcgccaccatgcccagctaatttttgtatttttggtacagacggggtttcaccatgttggccaggatggtctcgatctcttgacttcatgatccacccgcctcggcctcccaaagtgctaggattacaggcgtgagccaccacacccagccttctttgactgattcttctctgtgtgcgcatgtcctgaggtcacaagtggtagtgtgctccgtattggtttcttgacctgcctcttcaggactttctaaaattaaggtacaaccgattcttttgctgcagtcctttctgcctaaagaaggaagaaattcttctgttttcagaaaaaaaaaaaggaaaataaaagaatatgccagcttcaccaggataacccacagacattgagcattaggagtatggtacaaaaataatttctttcctcattaaggtttttttttttttaatttatgctacgagaaatagaacagagtgagcctattgttgtcttgccatcccagaatctcttaggaggacaaagagagatactttagtgtttgtaaagggagggttgactatttgtgcaggtttcaaaactcctgcaccccaagtccccagcagaataagcctctctgggtccattgaatggtgggtttttgaatggtggatctggggccttgtatggcagatgcacctgacagccataaccgaagcacatcctaagaatgaccctaaggttggccaggcgtggtggctcacgcctgtaatcccagcactttgggaggccgaggtgggtggattacttgaggtcaggactttgagaccagcttgggcaacatggtgaaaccccatctctactaaaaatacaaaaattagccaagtatggtggcgggcacctgtaatcgcagctactggggaggctgaggcaggagaatcgcttgaacccaggaggtggaggttgcagtaagccaagattgtgccactgcactccagcctgggccatagagtgagactctgtctcaaaaaaaaaaaaaaaaaaaaaaaaaaagaatgaccctaggatctaagaagaatgtgtgtttggacttccaagctaaggaatcggagagtggccaacctggagattcactccttatctatgacagacatccgaacccctagctcgttccttggaatgcaggccacctaggggatggaggccctttgctttgggttaaatggaggttgctaggtgggagggtgctaagtgaaaaacacaatataaactgcatgcttagtacaaacagcagtggttctcctgtccagcctgctgcccctggaatgccccttatgtaagtcctcaataaaccctgtctccctcactagctccgggtctctctctcttttttaatggagtctcccaggctggagtgcagtggtacaattatagctgactacaggcatgtaccaccacgcccagataattttaaaatttttttgtagaggcaggggtctcaccatcttgcccaggctgttctcaaactcctgggcccaagtgatcctcccacctcagactcccaaagtgctgggatttcaggcctgagccaccacgcccatcctgggtctcttttttggtgcctcggacatggtgccatccctgcttggagtcagcagaggtcttacgcgacagtccttggaatggtggaagcctgttttgttgtctttgatactatgaagggacaaacccctgctttgaaggtgtttatttcctgaaatttttacctgggatcccagctatctctttctttctttctttctctctctgtctctgggatcccagctatctctttctttctttctttctctctctgtctctctctttctttctccttccttccttccttctttctttctttcagatggggtcttgctctgtcgcccaggctggagtgcagtggtgcgatctcagcttactgcaacctccacctcccaggttccagcgattctcctgcttcagcctccggagtagctgggattaaaggcgcacaccaccacaccaggctaatgttggtatttttagtagagacaggggtttctccatgctggtcaggctggtgtcgaacttctgacctcaggtgatccgcccgccttggcctcccaaagtgctgggattacaggcatgagccactgcgcccggctgcatgacttttctataaagccttattttaaatgattttgggggcttaatttaggtgttttcatttgcttttggtcacagtctttatgtgtcactgagtgtgtggatgtgggggttcttctacccagaggaaagtgatttgatcacctggaaccaggtgctctgagaactggggcagcttccctgacttgcaggagagggtgcagagacttcttcgctggcatgtagctgcagcctagaaaaccgcttggtggtcctcgttcatgaacctgccgttgggggtgcttcatgctttatcttggtctctaccttgattaatctcacctccgtttctccgctccactggaccattctctagaacccctctagaaccactggaccattctcttctgtcagagtccagtgcttccagtctttcctgtgggctcttatcttctggtgcaaagttctttctcaccttccacagtcaaaatcaccatacttacctaggccatacttactaggctggagaggcaggtacatcaatctttcttgtttatttgtttgtttgtttgagatggggtcttgctctgtcacccaggctggagtgcagtggcacgatctcctccgcctcccgggttcaagtggttctcctgcctcagcctccccagtagctgggataacagttgcatgcaaccatgcctggctaatttttgtatttttaatagagacggggttttgccatgttggccgaactgctctcgaactcctgacctcaggcaatcctcccgcctcggcctcccaaaatgctgggattataggcatgagccagcatgctcagccaggtacattgatcttctaagtatttattgttctgctccttattcagtgctaacatttttattttcttattctttttccctgtcacttgaagatcgtcacccaagcaataaatccatttggttgtacttatttaattttctctgactttctaaggagtgacacagcaaagtgccttatcttgcatttctttccttttccgtgttctagttggaaaggctcagagtttgggagaagttaaacgtgactcagagaattgcttttgatggtggtgccgatacacacatcttttgaagcttagattgggtattgtcaatttaatttggagtctatcagcctgtagtgttctaatcacctattttgaagccttgctgacgacccgagattccttgttaaactgccactggaataagcataacacttttcattaaaggaaaaagaaaatgttacttaaagtaataggcacacccttttattttcttgacagatagcaaagaaaaaaatcttctgtctttaccttgacaagacatgtaccattgctgggaggttttgcttgtatgagaacttcaacgttagaatctagacatctcggagaattgaaactcaacaagtttctctgttttggggtggagaaaaaggacaaaaagttgtcatatacagctagctgtccaaacagtcaaatacgaaagctaatttatcttttaaaaggttaattctttgatgcctctatcacagttagtgttaaaatgaaagcattggaaacaaactctttttctgttagctcagattttaaaaaaattctttttgcagagatgggggtctcactatgttgctcaggctggtcttgaactcttggcctcaagcgatccttctgccttggcctcccaaaatgttggaattacaggggtgagccactgagccagattttgaatattttaattacttaactgcttgtctgtctggcaatgagataagcgcagtagccagtgattaccaacagttaaacagaagaacaagtcacataaacaacacttatacttcctgtaaacccaattaaaaccacatttcaggtttgctcttatgatttagaagtaaatttagaatcagtttcatgaatcttgcagtatttttcaaattaatgtctttaggcatttggacaatgggctgtgtgaatgcaaactgcgttttcttcaattgctatcaattagagacagttaagaactcaactgatgaagaaatagccacctgaaagtgagcccacaggcaagtcacaggcccctcttcctcctgaaggtgcacgggagacttcgttaaaaaaaaaaaagctgtagtaaaatacgtataagataaaaatttaccattttaagtttcttttttttgaagacgaagccttgctctgtcacccaggctggagtgcagtggtgtgatcacaattcactgcagcctcaccctctccggctcaagcgatcctcccacctcagcctctcgagtagctgggactacaggcgcacaccaccgtgcccactaatttgttgtagttttagtagagacgagattttcgctgtgttgcccaggctggtctcaaattcctgggctcaagtgatccacccgcatcagactcccagagtgctgggaaggtgtgagccaccatgctcggcccattttaagcattgtaaattgtacaatttagtggcattaagtattttcacaatgctgggcaaccatcatcactgttcactttcagaactttttcatcattccaaatagaaattccacccattaaacactaactccccaatgtccccttcccccaccctctggtaacctttatcctatgttctgcctctatgaattggcctattctaggtacctcataaaagtagaatcaatattatgtgttcttctgtatctggcgtctttttcttagcatgttttcaaggttcagctgtagcccatatcagaatctaatttcttttcctttttttgagacagagtttcactcttgtcactcaggctggagtgcagtggcacgatcttggctcactgcaacttccgcctcctgggttcaagcaattctcctgcctcagcctcctgagtagctgggactacacgcgcgcgccatcacacccagctaatatttgtatttttagtagagacggggttttgccatgttgaccaggctggtctcgatctcctgacctcaggtgatccacccaccttggcctcccagactgctaagattacaggtgtgagccaccgtgcctggctaaaaattcttttttgcacatgataaactcacctatcttaagtgtaaaatgaataagtttcagtaaaacaacaaaagctcttaagttttagtaaatccatacatctgtgcagccatcaccgcagtccagttttagaactttccattcccccctaaacatcctccttgcctgtttgtggtcagttcttgctcttaccctgatccccggcaactagtgatgtgatttacgtctctatagttttgtcttttctagtaatttcgtataaaaattatacaacatgtagtcctttgagactgaccttttttttttttgttttgtttttttttgagacagagtctcgctctgtcgcccaggctggagtgcagtggcgcgatctcggctcactgcaatctccgcctcccgggttcatgccattctcctgcctcagcctccagggtagcgggcactacaggtgcccacatcacgcctggctaatttttgtatttttagtagagatggagtttcaccatgctagccaggatggtctcaatctcctgacctcgtgatccgcacacctcggcctcccaaagtgctgggattacaggcctgagccaccacgcctggccgagactggcttcttttactcaacataaagtttttgagttcattcgtgttgttgaatgcatcagtggttgggttttttttttgttgttgttttttgagatagggtctcactgtgatcacccaggctagagtgcaatcacagttcactgcagcctccacctcctgggctcaagtgatcctcccaacgtcatcctcctgagtagctgggactacaggcacatgccaccacacctggctaatttttgtatttttgttttgtatagacgggggtctcactatgtttcccaggctagtctcgaactcctgagctcaagcagtctgcctgcctcagcctcccaaagtgctgggactacaggcgggagccatcatgcctggccaatagctggttcttgttttactgctaatagcattccattatagggatgtaccacattttgtttattcatcaccagttgatagagatttgtttctaattcggggctactgtgaatattgctgctgtgatcatttgtatacaattcttggatggacatgtgctttcgttcctcttgggaagatactttaaggagtggaattgctggggtttttttttttttttgagatggagtctcactctgtcgccaggctggagtcactgcaacctcctcctcctgggttcaagtgattcacctgcctcagcctcccaagtagctgggactacaggcgtgcgccaccacgcccagctaatttttgtatttttagtagagacagggtttcaccatgttggccaggatggtcacgaactcctcatgatccacccacctcggcctcccaaagtgttgtgattacaggcgtgagccactgggcctggccactgggtcttatattaaacttatgtttaacttataaagaaattgccaggctgttttccaaagtagttcttgcatttttttactctcactagcaacatatgagcgttttgggtttgccacatccttgtcagtacttggtattatccgtcttttgtttgtagcgattctaatgagtgtgtggtggtatctcactgtggttttactttgcatttcctgtactcttttaaaactgctttccattatagaacatgttgtgttgtgctgttatatatataaagcttctgctcacctgtgagctactctgtctagctgattgatccagtattgtgtccgggggcagggtacatggaaaatgcttagggtttgttgagtgaatgagcaaactgatactttgtaggagtggccaattttcaaatattttaggtaacagaaaacagtggtgaatcaactcaaaagatgaggtaccagtcaaatctcttcccttttgtcagtttctaagtagtattaaacttgagtgaactaagttttacttttttttcctttgctttgcttaccccttggtgagaggtaatggagaaaatatagacagagcaggaggaggaaagaaactcaatctcgaaatgactaagagcttgtggagcagcttgggagagaaccagctgggttattggctactctgtagttccaggtgtggggaattattctcatcaataccgtgaccgcctgccactcccctctgccctctttctttgtgttaattagagcaggggtctgcaaacattttctgtaaagagagtaaacaaatatgtcaggctttgtgggccaagagaaaacatcagcgacgttgtggaggtgcttacataacgacagacaaaacaaatttccatgaatttttatcgatgaaactccaaacatagtaatggggtacgattttctgtaacacaagtctgctaatgagaagaattgaattatttgagggaggaaaacattttgcttaattggaagttcagagttaatgtttcctatcatcatggtagaaatgtggcctcattcttctacaaagcttctctgatatgcagtggtcttccctcctgagaattcaccagaatgtactggcttgatttgcccttgatttgttggggaacttttcacatgggggaagcacattaagagtacaggctcgggctgggcgtggtggctcacgtcggtaatcgccagcattttgggaggccaaggcgggcagatcgcctgaggtcaggagttggagaccaccctggccaacatggtgaaaccccgtctctactaaaaatacaaaaattacctgggcctggtggcgggcacctgtaatcccagctacttgggaggctgaggcaggagaatcgcttgaacacgggaggcagaggttgcagtgagccaagattgtgccactgcactatagcctgggacacagagcaagactccgttctcaaaaaaaaaaaaacaaaacccaaaagaggacaggctctagggtaagactctggggtctgaattccagctcaacaacttattaactatgtgatctttcactacttacataacccatctaaaagctttggtttcctgatctataaaatgaataatagtacctatttcacagagttgctgtatagattaaacacaaagatttagaatgacatattatactttttattcttcttttgattttttttcaaccatttaaaaatgtaaaaccattcttaagtcatgggcagtatgaaaacgggtggcagggcctgcaggatatagtttgtggaccctgcattggagtatgaacttgaattattgccgtttactttagaaacgatgattgcttttttcctaattgcaaagcaccatatgttcactgcagaaaacttggaaaacacaaaaaagcacaataaaacaaaagccattcagaatctccaccatccagagacgtttcatgagtagtatgttgccccatagccttccagacaattgtgtacataatacacatatttcattattttttattttcctttttttttttttttttgagtcagggtctcactgtgtcacccaggctggagtgcactggtgcaatcacagctcactgcagcctccacctccagggctcaagcaatcctcccacttcagccccctgagtagctgggactacagctgcatgccaccaggcctggctaatttttattattttttgtagagatggggtcttgctatgttgcccaggctggtcttgaactcctgagctcaagtgatcctcctgctttggctttccaaagtgctgggttaacaggtgtgagcctctgtacccagcctacacatatttcaaagtaaaacccaagcccatactatgcatactgctttgtatctttttcacctattaatatgcaatgcttgtcattaatattcttctataacctgaattttaatggccacatactattctgttatactgtgttaaaatttactaaagcaatttccaacaacattaatgctgttttgaatttttcaccattagactgaactcagcaataacctggtacatacatgcttatacacatctcttgattcattccttgggataaattacaaaatttaatcactgggtgacagggtatctacatttttatttatttatttattttgagacagactctcgctctggagtgcagtgatgcaatcccggctcactgcaacttccgactcctgggttcaagcgattctcctgcctcagcgccagagtagctgaggttacaggtgcgcaccaccatgcccagctagttttttttgtttttttttgttttttttgtatttttagtagagatggggtttcaccatgttggccagactggtctcgaactgctgacctcaagtgatccacctgcctcggccttccaaaatgctgggattacagacgtgagccaccgctcccagctgggtatctacatttttaaagctttggtgtatcttgcaaagttgtctcctaggaaagttgtatagttagtcattcccagatgatgtatggagcactgttgtttcaatgcccctcttatatttttacttggttactgggtttgtgaacttaaaaaattaaaacattcttattttaaaaacaattcaaatatataaaacatgtacagataataatgaaacgtacacttatgtacccagcagaaagattaaatcggtgttaacattttgctgtatttgcatttgttacttttaaaaaacacattccagattcaaaaacaagtctattattatcatcccattttacaagtgaggaaactggctcaaaaactttaagtaacttgtctaattcttaagaaccagtaagtgggctgtaaagaaccagttgatcctaatgatgcttttaccttaggcttttactgatattaatatagcccttccagtcttcttcccctttttggtcagtttctgtctggtacatgttttctaatgtctctacttttaagttttgtatgttgttgtattttagatgggcctcttgtaaatagcttatagctaaattaagaaaaaaatctcgagtctgggtttttaaaccagctattaataacctgttttttaaccagctatttcagtctgtttgcatttatagcaattgttgatgttttttgaattatttgtcttatttcatgctttctatttcccatactttttctgttttttctccatttcctgtctcctactgaattgagttttaccaggttttctctttttctctctactagctttgttatcctaaaaatattcaatgtgtatacttaaatagcagtcagaaattaccctatcacctcccccacccagtttttttcttatttagtgttttaatttctccttttttggtattttattgtattttgtattttattcactgttatttttgttgttttgtgcagcccaaactgtatatatttttatttactagggtctttactcgtctttctaagtactcttttatgtacacattttattttctgaaaatatatactttagtgcattttagtaagagcctgtgaatgtacttagttcttgtttaaaaacagcttctttgtcctcatctttcaatgactctcttttagcttagtatagaatctcccctcaaccctctgaagatagtatttctttgtcttctcaacttttcttttcctcatttgttttctcaacttctcaaccctcttttttcttatttatttggaaatggggtctcactatgttggccaggctggagtgcagtggccactactgatcagcacaggagttttgacttgggctatcacttcacccctccttaggcagcctggtggtcccctgatcctgggagatcaccatattgatgccaaacctagtgtggatacctgtttggaatagtgcactacagcccagacctcctgagctgaaacgatcctccctcctcagcctctgaagttgctgggactatagtctcgtgccgccaaaccctgctcagctctcatttgttactgagaagtcttctgtctgattgctcttcctttgtaggtaatctgccatatctctctggctgttttttgttttttgttttttgttttttgttttttgagacggagtctcgctcattcggcccatgctggagtgcagtggtgcaatcttggctcactgcaagctccgcctcccaggttcaagccattcttctgcctcagcctcccgtgtagctgggactacaggcgcctgccaccaggcccagctaattttttttgtatttttagtagagacggggtttcaccgtgttagccaggatggtcttgatctcctgacctcatgatccgcccgcctgggcctcctaaagtgctgcgattacaggcaggagccaccacgctggctatctggctgttctttaggcttcctctttgtctttgaaattctggagcctcagtcctgtgtgcatggattcatttttatttattctgcttagaacttggtattctttacacggagaattcatgacttttacaattctggtaagtccttaactattatcttttaaaatgttgcttctccttcactggggcagccataaaatcatgctgctcggttgtcttgctggaggaagcatagttgactgagccccagaggccatgtctcagattcactcacgcttctcctgggctgctcccagctgatggcagaatatgacaggggtaccagtgctggcccactgctgcaggaggtaggatcctttcatggatgacattggctcctggactccccatcagtgtgaccaaactttcttacatctgcgtctcactctgagtctcttcctacccagtactcctttcttctctctccatcatacctacaccatggtctgaaggctctccctgcctcctcctgcttcctcctctttttccttcacaggtgtttttcccaacatctcgtctcagcatctgcttcttggaggacccaaactaacaccgtatctctgttttcatcatctgaatcttgtattagatgcatatggaccttctcattgtgctctctatgcccttagttattcttttatgcctcattgacctctctaatgctctttgggtaatttcctcagatctgtcttccattttactgaattctctcttcatttctgtctaatctactatttaatctatctattgcattttaaaattataatatttatttctaaaagtaccatttggcttgttttcacatctgactcttacttttttcccagtatattcttctcagggttttagtttctcattttttgtctttaacagtctaaagcacacttacattgtactccctctttcaaattgtagttttatcattccaagttccctggagctctaataatcttgtttgttgtatttgctgttttctgcttatggtgtattctaatttttaattttcctctaaactaacctttagtgggggttattttttttccgtgggaatcttacatggtctgatagtgaggctccttcagaacaattagcattgctcagaacaatttgcattgcttcttctagagatctcaggagtgtcactgccttggggccaatatttctgttaatttcttagtttagaacggcctggatcaccccgcttaaggctcaggtttgggatatccatttttcaggggagaggtttttttcacttagaacccaagaacacaaaattgttctcctagacccctgtaccaggggatgatttttccccctagtctttcttttcactgggaagtatttctttgaagatcctaactctctttggggcttttttttttctttttctttttttttttttttttttttgagactgagttttgctcttgtcgcccaggctggagtgcaatggcttgatcttggctcactgcatcctccgcctgccaggttcaagcgattctcctgcctcagcctcccgagtagctgggattacaggtgtgggccaccacatccagctaattttgtatttttagtagagaaggggtttcaccatgttggccaggctggtcttgaactcctgacctcaggtgatccgccccgcctaggcctcccaaagtgttgggattacaggcgtgagccaccgtgcccagcctctttggggttttagttccaactctctgcttcatggtgactcatggtttcacctcctttgtccacttgggttttaaattgtaagtctggaagttactagaacaatcccagaattagctcacacactttcactctgtttttccctttcttcctggggttatattttacccagcattcctaggtgtttgtggtgggagattccgcccctacgttatcttaatttgttgccatatttctgaaccaggaatcccatttaccacattgagttctggacatcaaggttctccgggcatcactttctatgctgtgtcatcagtgaagcccataaacttacccgttatcagaaaagcgaagatttcgagatcttgttgagacggtaggtatatagtatgtcctgaggggtttagaaaaaatagctacctttatttccaacccatggtaacttcattggtaaatccagacagacctgtaagatttttacaaatggaaccagcagcttagaaaacaaaaaataataattactttatcatcacaagtattccttttactgcctcagcccagtaacagagctcttctatctctctcgtttctttctcccagctttcccaccatccttctcaatttgtcctttgtcaacagggcagaaaaggggttgaagtgatgtatgggtgtaatccactgtgcactgctgaaaagataaacttaaatgaagtgatttataacctgtggcaggtattctgcacccagaattgtttgtcaaagtgagtgctcattgattttccatgccttccgtgtcagcccctggattgccattgttccttagaggtggctaagcagtttaaggcatcagggtgttctcccagcgcgggcactcactccgctgcagggtttagccttcaactgtgttccagggctcggaactccctagttgaccccttgctgcaggaggcaggattctttcgtggatggcattagctcccagactccccatcagtgtgaccaaaattttcttgttttttttttttgaaacagagtctcactctgtcagccaggctggagagcagtggcccgatctcaggtcactgcaacctctgtctctcgggctcaagcaattctcctgcctcagcctcccgagtagctgggatgtgccaccacgcctggctaatttttgtatttttagtagagacagggtttcaccatgttggccaggctggtgtcaaactcctgacctcaggtgatccactcacctcggcctcccaaagtgttgggattacaggcatgagccaccgtgcccggccctttcttttttctttttctttctttcttttttttttttttttttttttgagacggagcctggctctgtcacccaggctggaatgcagcggcgcgacggtggctcactgcaacctccacctctcagattcaagtgattctcctgcctcagcctcagtagctgggattataggcgcgcgccaccatgcctggctaatttttatatttttagtagagatgaggtttcaccatgttggccaggctggtcttgaactcctgacctcaggtgatccacctgcctcagctcccagagtgctgggattgtacaggcgtgagccactgcgcccggccagtgtgaccaaaactttcttacagctgtgttgcactctgagtctcttcctacccggtactcctttcttttctctccatcatacctaggccatggtctgaaggttctccctgcctcctcctgcttcttctctgctaccatccacactcactgtgtccatgaaaagaccagattccactggtacttcagatttctcaaatgagaagtaaaacatattctataagttttgaaaatgcttctataaaatgcttctggaatcttcctactggaagtcaaatagataataggtccccatagaatagcacgggacaatagtacagcttcgggggcggtgcccagggaaatctgggctgagttagatgaaggatactaagcatcctatgggaactcatgcagcagggagtctccttcgcttaaggggaccacatacatatcacacaggatgtgtctttcttgtttttctccaaacccatcccgttgtgttggagggtgatgaagtttttccagcaaccacagtgcagtctggtgaatcagaatcagtgtcattgagcctcagcaacacccagatatccaagagattgtcttaaagaatcttagaactgtaggctgggtgtggtggctcacacctgtaattccaaaactttgggaggccaagaggatcgcttgagagcaggagttcaagaggatggcttgagggcagaagtctgaggctgcagtgagctgtgactgcaccattgcactccagcctgggtgactgagggagaccctgtctctaaacaaaaacaaaaacaaaaaacttagatttttggaccttagatcatttaatctagagttctaactcgataggcaaggaatctgaagcctggactatttgatgacttgctcagggtcacagaactatggagctccacagccagcattacgacctgggtttctggacttcctgctcatccctgtttctggaagggcttctgctccaggtctctctgggtaatgtcccatttgctttcacaacatgcctcttgaatctaaagaaagcagtgctgttggtggttgtcttagttgcagtttatttgcttggtcctttgaacaggaagagagttatgtttattatgggttgggaggaatgaacttgcctacacctttttttttttcttttcttttctttttctctttctttctttcttttttttttttttttttttttctgagacagggtcttgctctgtcgtccaggctggagtgcggtggtgggatctcagctcactacaacctctgcctcctgggttcaagcaattctcctgcttcagcctcctgagtagccaggattataggcgcccaccaccatgtccagctaattgttgtattttcattagaaatggggtttcactatgttggccaggctggtttcaaactcctgacctcaggtgatccatccacctcagcctcccaaagtgctaggaatacaggcgtgagccaccgtgcctggctgcactttttcttttttctgttgtgtgcctaagacatggttatctagacaaaaataccacttagtaggcactttaccaatacatatcatgctagaaaacagattgctttcatgcaaatgaggtggagctaggaaagttatttatgtaatgattatttcacaattggaatttttttttttttttttttttgagatggagtttcactcttgttgcccaggctggagtgcaatggcgtgatatcggctcaccgcaacctccgcctcctgggttcaagcgattctcctgcctcagcctcccaagtagctgggattacaggcatgggccgctacgcccggctaattttgtatttttagtagaggcggggtttctgcatgttggttaggttggtctcgaactcccgacgtcagttgatccacccacttcagcctcccaaagtgctaggattacaggcgtgagccgccgcccccggcaacaattggaaattttttaaaaacaaagactatttagcttgagctcaactaaagactttggtttgcatattatagacaaatacataaattgtgtttatatagactgtgtacatatataattatatactgatgagatatagcatttgtatttttcaaaccacaaacatcctgtagtaattcagacttataaatacttctgcatagcaagtaacaatttataatagctaaacaggaatgaatatggatggtgtttctttgtgcctctgattggtgggtaggggggattgaaagcttgattttgatcagtttttttttaaacttatgtgcattattgattaatcacttaattgaattggtgggatatattttcatacatgcagttgtggcaatattgattgagctttctctgagcccaaactaccaattcttacaagtgaaacaggatgtcatctccgtgttgtaatcattttatacttcacatagtacattggaagtctgaggtagcaaattcggcttccggaagtccttgacttggggtcaaagagcatcgctgatatcaggagaagctgcctgaatgtgaattcggtagtaaaaatggaaagatattttatgtgtttggctaggcgcagtgcctcacacctgtaatcccagcaccttgggaggctgaggtgggcagatagcttgagctcaggagtttgagactggcgctgtgggcaacatggcaaaaacctatctctacaaaaaaatacaaaaattagctgggcatggtggtgcacacctgtggttccggcggctacttgggaggctgaggtgggaggatcgtttaagcccgaaaggcagagcttgcagcaccactgcactccagtgtgagtgacagagtgagaccccatttcaaaaaagaaaaaaaaaagagccaggtgtggtggctcatgcctgtaaccccagcactttgggaggccaaggtgggcagatcacttgaggtcaagagttcgagaccagtctggccaacacagtgaaacctcatctgtactaaaaatacaaaattggccaggtacagtggctcgtgcctgtaatcccagctattctggaggctgaggcaggagaatcgcttgaacccgggaggcagaggttgcagtgagcagagatcacgccactgcactccagcctgggcgacagaacgagactccatctcaattaaaaaaaaaaaaatgatattttctgtgttcatctaagtagagaaataagtatagactgccttatgttcatttgcttcccagtgttccttggtggctggattattcatctaagtgagatgtaagatcttttgagcatctaacataatagttattcataaagacatttaggctgatggctttctcagaacgtcctgctgttcatgatggacttcatctatatttcaatgaatttctaaatggaggaaacagaacatttttcctttgattaattcattggttttcagtcctcaaggacccataggctggcgaactctaagaggaagtcacaaaaggaagaatggtaaattggaattggaactgtggaactcaccccgtaaaaatctttcaacactgtcctgagttcaacatctgaaatacagtggaccaggagaagattgatggaagctaatttaaaaagctaatttaaaattgcaccaaaaaaagcacagcgttatgaatttaataaagttcgtagggtgttttggaccacgattttacaactctctcactttttttttttttgagacagagtctcactctgtcacccaggctggagtgcagtggtgcaatctcctctcaccgcaatgtctgcctctcgggtccaagcaattctcctgtctcagcctcctgagtagctgggactacaggcatgcaccaccaggcctgattgatttttgaattttattagagatggggtttcactatgttggccaggcaggtctcaaactcctgacctcaggtgatccacccgccttggtctcccaaagtgctgggattacaggcgtgagccaccacacccggccacaactctcacttttaattgactgtgccccagaatcaagcactttggctagcaaatgatggctagttagatcacagaggtgtgtgttgcattctgtgtctgttcactgtgaaatcgggattttaagagtgtatgttgttgaacatacacctgtctttgagtgatcggtccccagaggccacctctaaggtgaagatttggggaggtaattgtgggaagccccaggaggagcagaggaaaatgagaaaggggacgaagggaatgtaatagaatgtgtgttgggagagggtttccttatgagccagtgcagaggaaagtcttgaaatgcactaaggaaatacagtctgtgccgtgatggtagcaccgatgtggaatcccataagcagctgcttgaaaaagacttggtggcagacataactctttttgccttttaagtgctccgggagatttcacatgccaatgttgaattgtccccaacttgggttcagggtgcccaggaactagcaaaatcagcttttttgtggtaggatcttcataggatccaggagctgtcacccacgaatgacagagcccctgcactggatagcctttctccaatctgtataaggtggaatagggaaatgaggctcctctctgatgttcggggctttagctgggctgggttctgagtcctctgtgcctagttccccttgggaagcactggagaccttgaactggaaattctcttcctgggatcaaccaaatactcccaaaacttcgtggaagcttagctccttgtgccttttgtcaggtttccctagaagtcaagggattctcatggagatgatgtatgggatgggggctagagggctgggaggatggtagggcgggggtaaatctaaacttcaggtgtcttgggagtccatgacttgcatcacagagctggtttcccccccgtcaggcaaggtcggcctttatttatttatttatttatttattttagagacagagtctccctctgtcacccaggctagagtgcagtggtgccatcatagttcactgcagccttgaacttctgggctccagcgatccccctaccttagcctcctgagtagctgggactacaggcacacgcccaaatgcataactaatttttaaagtttctgtagagatggtggggtgggggggtgggggggggcgcgtctcacgatgttgtccagtctggtctcaaactcctggcctcaattgatcctactgtcttgacctcccaaagcactggaatttacaggtgtgagccactgggctggccaaagtcagccttttgtacccctctcaatgtcagccattgattggttgtgggcctcccacaggtggagaggttcccatttgttcaaacgcaatttacaaacaagggggcagatgggacccattagtagctgaaactcacagcaaccagtgcctagtaaaggattcatgcagggccctcccacacgacccaaaacagcaaagagaaagggccaggtgttggcctttttctaactcatcccttttaacacagtaagttcagcagtcctctaagagtcccacttcaaagtacccctcttgccttccgaattcagtgttgttagcccttttgcttgaaaaacccccactcttggacacagaggaaataggagtcagatgtctgcaccttctgcacctgtggtttgaacaggaccctctgggagtcgcaggaggagtgcttggccctggtgcttggcaggaggttgggctgggagatgatgattgccttgatcctctctttcaactacttcattccaactgttggaatacctcagtagtgagtattaattttcttcccccccaaatccagcaagcaatctagctccttaagagaagactatgttcctgctattaacagggctttgactgtttttgcaaaataataactgggcattcttgtgttaaggaccatttgtttccttcacctgcttttcttcccaatttagctgaaaagggacctgagccagttaggagatttttttttttttttttttttttgagatgaatcttgctctgtcacccaggctggagtgcagtgacatgatctcggctcactctcaggttcaagtgattctcctgcctcagcctcccaagtagctgggattacaggtgtgcaccaccattcttggctattttttgtgtgtgtgtgtttttagtagagatggggtttcaccatgttggccaggctggtctcgaactcctgacctcaggtgatccacccgcctcagcctcccaatgtgttgggattacaggcatgagccactgtgccccgctggagactttttttttctgaactaaaatatcttttcagatacaaggttcagggagggtggtgtggaccagtgagagaagtttcatttgcacctttttcatttttattctgatccagagtgactggagtattaatggatgttgtcataggcttttgaagtggccttgcttggtgattgagtggctctcgcaaaattctgaattttggaaccaggtattgctttctagctatactaacatgtccctttaggagtctaatgagatctgctttgcctctgccccaaacagatttgctttacaagttactgtcactcagggcaagctccaagctctgtatctaaaaagcaaagccacctgccagccacaaccaggtgcatgttgcctttgggccttgtgtcaaaatatcttcatcatctaagaataaaacccccaaagaggtcagcctgatcttgtagaaagccgtccctgggaaaatgattaaatgtcagtaaacaagagcatttcagaaactgacatggtccctaatgtttgtgtttagagactcctaatgtgtcagaattgagttggagacttacgatgtaattgcatgtcttgtatttcatgccagcctctcggcttggtgctggggcagagtgggaagcagaccacagagcagagagggcctctgcccttttattgtcctgtgagagagatggatattcacaaataatcctgtccctaattaattgcagctgagataaccattataaaagaaactagagagtgtgacaaggggtgactatctcttggtcttggttgtcaggcaatgctatggaagggttatttagagtcgtagaagtgtctagtacaaccaccagctgatgaagatagtacaggaggaagcaggcatgtttgagacatggtgagtttcaggctcaattaaggagctggagatagctaccagctgttagcaacactgggggcgtgcaggagcagcatcagggacagatttgggagtcccttggggaagccgtggtgaagccacaggaatgaacaggtggctttctttcctttttttttttttttttttgagatggagtctcactctgccgcccaggctggagtgcagtggcatgatctcggctcactgcaagctctgcctcccaggttctggccattctcctgcctcagcctcccgagtagctgggactactggtgcccaccaccacgcccagctaaatttttttgtagttttagtagagacggggtttcaccgtgttagccaggagggtctcgatctcctgacctcgtgatccgcccacctcagcctcccaaagtgctgggattacaggtgtgaaccaccgtgcctggccgcttttttttttgagacggagtcttgttctgttgcccaggctggagtgcagtggcactatctcggctcactgcaacctctgcctcccaggttcaagcgattctcctgcctccacctcccaggttcaagcgattctcctgcctcagcctcccaagtagctgggatcacaggcacccaccaccacgcctggctaatttttgtatttttagtagagacgaggtttcgccatgttggccaggctggtctcaaactcctgacctcaggtgattcgcctgcctcggcctcccaaagtgttgcaattacaggagtcagccactgcgcctggcccaggtgactttcttgagagagtatggagagggatctgggagaatgtctggatgaaaccttctttaagggcctgtcacctacatgcaataaagaccatactaattgtaataagaccattgtttactttttgttccccaactggtgcaattttcccagtccctgtagtagccccaggatggctcagaaactgtctgggttcctgctgtagacactgtgagaacttcctttccaagtgtagccaagcacccgccccactgctgcagcctgtgccatcctcccccttctctgcacacattgcatatccctgtggtctccgttttgagctcagagtgtgggcctccaaccctcagcaccgtatcactccgtagcttattagaaatgcagaatctgcagcccccgcccagcttgctgaatcagcctctgtgttttaacaagatccccgggatctgtctgcctgttgacaagggagaagcctggtctcggttacctcctcctcagcgtcctgagcctggctggatcgccagcacactcagaccagcggccccaggctcttgtgacagcagccgtcagacccgtgggagttcaggtgcgggtcatcagggccctgctggctactccacctctctgggtccctcagctcagagattccacttgagtgtagagagaattgttcccctctgctctggtgccctctttgcactaatgtttagggacctagaaagggcatcaggaaataagacagaacaaaagccaccaagaggaagaaggaaattcaagtgccatagctatagagaggctcaggaggataaaaacaaagcaatagcaggggctgagagattttttaaaaatcagctttactgtgatatataatatatatatgtgtgtgtatatgtatatatataatttttttttgagacagaatcttgttttgtcatccaggctggagtgcagttgtgcaatctcagctcactgtaacctccgcctcctgggttcaagcgattctcctgcctcagcctcccaagtagccaggattataggcacacaccaccacacttggctaatttatgtatttttagtagagatggggtttcaccatgtcggccaggctgttttcaagctcctgacctcgagtgatctgcccactttggcctcccaaaatgctgggattacaggcatgagccaccacacctggccatattgtgatatagctaacatagaatagaactcactttaagtgtacagcttgatgagttttaacatatatatacacacactgtagtcatgtaaccactgccccatcaagatacagaacatttcatcacccctagaacttcccttgtgacttttagctgtcaattacttctctctaccccccacattccccactcctgttcctaacaagcactgatctgcttttgcactaaagtcttgcctttcttaaagtttcctatagatgcagtcatacagatgtagtctcttgtgtctcacttcttttgctcaacacaatgtttttgaaattcatccatattccccgtccgggagggaggtggggggggtcagcccccctgcccggccagccgccccgtccgggaggtgaggggcacctctgcccggccgcccctactgggaagtgaggagcccctctgcccggccaccaccccgtctgggaggtgtacccaacagctcattgagaacaggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaatgtaaaaaaaaaaaatgtaaaaaaaaaaaaaaaagaaattcatccatattattggatgtatcaatagtttgttcctttttattgcatagtagcattcccctgaatggatataccacagtctgtttattcatttaccagttgatggacatttgggttacttccagttttggatgattttgagtaaagttgcaatgaacattcacatacaagtccttgtgtggacctacgtcttcatttgagagatttttttccttttaaactttttattttattaggttggtgcaaaagaaactgtggtttttgccattactttcaatggcaaaaaccacaattacttttgcaccaacctaaatcttccctctctctggatttgcaattattctgtaaatctaaagttaactttagctaaatcaggttgacatcatataccccctaaagttaactttagatttacagaagagttgcaaatccagagaaccccccgtagtcttcatccaccttcccccaatgttaatatcgtactaattatgatacatttatcaaaactcaaaaattaacatgggcacagttgtattaactaaactcccgactttcttcagatttcaccagttttttccactaatgtcctttttctgttccaggatttaatcaggatataatgttgcacttaattattatatcataatagtcactttcaatctatgtcaatttctctgtctctccttgtttttttatgactttgacatttatgaagtgggctggtcaagtattttgtaggatgtccctcaatctggatttgtctgatgttttctgatcattagactgcagttggggtttggggaaagaataccccagaggtgaaatggccttctcatcacataatattagggggcacatgatatctacctgattgctcactggtgaagttaaccttgatcacttggttaaggcgttgtctaccagagttacccaccgtaagctgctaatttccctttccatactctgttccaggggtgtccaatcttttggctgccctgggacacattggaagaagaattgtcttgggcaacacataaaatacatcattaacactatgacagctgttgagctaaaaaaaaaaaaaaaaaaaaaaaaaaaaaaaaggaccgggtgcggtggctcacacctgtaatcccaacactttgggaggccgaggcgggtgggtcacgaggtcaggagatcgagaccatcctggctaacacagtgaaaccccatctctactaaaaatagaaaaaattagccgggcgtggtggtgggcgcctgtagtcccagctactcaggaggctgaggcaggagaatggtgtgaatccaggaggaggagtttgcagtaagccgagattgcaccactgcactccagcctgggtgacagagggaaactctgtctcaaaagaaaaaaaaaaaaaaaggtctgtgcataaatatcataatgttttaagaaagtttatgaatttgtgttgggccacattcaaagctgtcctgggccacgggttggacaagcttaccgtctattcattagaagtgagtcactcaggggagggagattaggccctgcctcctacagggaggggtttcaaagaatttgtggacatatgctaaaaccagcaccataattaatgtggtatttttttttttttgacggagtcttgctctgtagcccaggctggagtgcagtggcctgatctcggctcactgcaagctctgcctctcaggttcatgccattctcctgcctcagcctcctgagtagctgggactacaggtgcgcaccaccatgcccaactaatttttttgtatttttagtagagaaggggtttcaccatgttagccaggatggtcgcgatctcctgacctcgtgatccacccgccttggcctcccaaaatgctgggaatacaggtgtgagccaccgtgcccggccaattaatgtatttttattattttaaaagttattcttatttttagagatagagtctcactatgttgcccatgctggtcttgaactcctgggctcaagctgtctacccacctcggcctcctaagtgctgggattataggcgtgagccactttacctggcctgcttgtttttttgagacagagtctcgctctgtcgcccaggctggagttcagtggcacaatctcggctcactgcaagctccacctcctgggttcacgccattctcctgcctcagcctcccgagtagctgggactacaggcgcccgccactacatccggctaatttttttgtatttttttagtagagacggggtttcaccgacctcgtgatctgcacgcctcagcctcccaaagtgctgggattacaggtgtgagccaccgcccccggccctggtgtgctttttaatattttttggagatggggtcttgttatgtttcccaggctggccttgaactcctgagctcaagtgatgctcatgcctcagccttcagagtagcaggcattacaggtgcatgccacctcacctggctaataaatgtttttggagggatgtgttgagcctatgcaggtatcctgtttccccttaaagtttgcccatgaacttaacattcctcagtggaccctgcctgcagctattattactgtaatgttctcctggtgattttctattctcccatgccttctgcctttattacatggaattcttctgtaagggaaatttgtttcttctccaggtatttgtttatctatcctctcatttatttatatcagtgtggactcacaagtacttattttattctctgggtgagagatgtttttaagatgggaaaatggactactttaagttaacctaactgtgagccaggtagcaggaggtgtggggaggaggagcatagatgctgggggaggaatgggcggtggatggagcgaagttcctaggaaggtcagtgagaaggagatccggaggtgggggtcttggcaaaaacaagggacaccctgttcccacaaatgggtaagaggaaagtttgggagggtcgatttccatgtcaggaaggagaacttgaaggagttccaactaattagcttttgtcttctccgtcaagatgttttctgtgacgacaatgggaagttgacttttggaattttaattgtcttggccaaaattcctggcctctagagtaacgtttctcaacctcagccctgccgacatttggagcagataattcattgttgtgggagccgtcttgtgcattgcaggctgtgtcgcagcatccctggcctctaccctctagatgctttagtgccctctcctgtttccccagcagtgaccaccaaaatgtctccaggcagtgtcaaatgtgccctggggagcaaaatcgccccatgctgagaaccacagatctaaaattaacacacacaattctggcaatccgtaggattcttcttctctttatttttatttttttgtctccctctgttgccaaggctggagtgcagtggcatgatccatagctcattgcagccttgacctcccgggctcaaacaatcctcccacctcagcctcctgagaagctaggactgcaggtgcacaccaccatgcccggcggcttttttttttttcttgaagagggggactcactgtgttgctcaggctggtctcaaactcttgggctcaagcagtcctcctacctcagcctcccaaagtgttgggattataggcatgagccactgcatccagcccacgggattcttgaccattactttgaaagactaagatgatggcattcacctattaattttctgcagaaagagctaagctgctctagtgtgaacactcaacgttgacgctatggatgagggagggccctgctttcttgggaatagcggatggtcctttcagcacacagcacagatgaatgaagaggaaatgaagttctggttcgcagagggtctttggttctgaaaagcgttgccgtggttctagccttcctcgcggtggagggtgttttgctttctgcgcggtttctgtgtgggccgtgggaagcaacttgattgttatcacagttggggacacagcagctcttctcataggttaatttctgaaagcccatttgttctaaatccaacgtgacgcctaccgagctgggtacaacattggtttgtttcataaaacagcccggggtgtttgggactcttactcctttacaactctcatttgactgtccaaagatgcttgcactggggcctaattttctgtcaccttccctacgtttttaacaagacactgccatttcaaacatagcgaacacgacagattgaggaacaaggccaaggcagaggctgcgacgacctcgtacagccgctgatgccatctgttggtggctggcagaactgatgccctttgctgcgagggagctttgtttattgcacagaaagttgaaagttggcagcagagaaccttgttaccacctgggaggataggattggcaggattagggaggactggaaggggagggaatgcgtgtttgctttgtaggttgtgcatcagtaagcacaatcaggattcagtgccaggaatccatagttgaaacaattttaggaggatttttcaaggttctggctgggatgccatggggacctccaatccatttctcagtcgactgtcagttaaggcattgggctgtgggaagttaacagagcaacagagcggtctctaacgtaaaaaaaccccagtgtctcccatagagctagcatgcagtccttatttgtggaatttgatattgagggacagtattaactcctcactctaatcaaagaagctatgataatatgatgcaaaacaactattatattctatccccttccaaagtgctttcaaagactaaatttgtcttgataccaatccatttataccaacacatccccacatttctgatgatgaaacagattcctagagactaaatttctttcttttctttttttttttttttgagatggagtctcgctttgtcacccaggctggagtgcagtggcacgatcttgggtcactgcagcctctgtccccccaggttcaagtgattgccctgcctcagcctcctgaggagctgggattacaggcatgcaccaccatgcccggctaatttttgtatttttagtggagacggggtttccccatgttggccaggctggtcttgaactcctgacctcaggtaattcacccgccttggcctcccaaagtgctgggattaaggtgttacccaccacgcccggcctagagactaaatttcttaggtccatatgtctgcttgatagcaagagctggaattagttcagccagtgggttcttaactctggatgcatataagaatcacctgggaaacaaaaaaaaatcttagtggttggcttcactctcagatatacagatttattttttaatttttgtttatttttttgtagagatggggtctcactatgttgcccaggctggtcttgaattcctgggctcaagcaatactcccacctccacctcccaaagttctggcattacaggtgtgagccactgtgcctggccagatatatggattaacggggccgggccagggctgggtcctgggctgtgattctaacctgctgcctggggttgaagcgcttctcctccaggtgtggtccatgaaccagtcgcatcagcatcacctgcgagcttgttagaaatgcagagtctcaggccccaccccagaccctctgaatcagaacctgcattgcaacaaggttctcagatgattcctgtgcatggcgaagtttggaaactctgagtgttgcttttgagatcagacatacagtgctatccattggtgtctgtggaggatgtcttatttgtttatttatgagacaggtctctgtcaccagggctggagtgcaatggcatgatcgcagcacactgcagcctctaccttctgggctcaagggaccctcctgcctcagccccccaagtacctgagactacaggtgtgtgccaacacacccagctcttttttttttttttttttttttgagatggagtttcactcttattgcccaggctggagtgcaatggcacagtcttcactcactgcaacctctgcctcccgggttcaagcgattctcctgcctcagcctcccaagtagctgggattacaggcatatgccactacaccagctgattttgtatttttagtagagatggggtttcactatgttggttaaactggtctcgaactcctgacctcagctgatccacccatcttggcctcccaaaatgctgggattacagacgtgagccaccgtgtccagcctgcccagctcatttttatttatttatttattttttggtagagacagggtcttgctatgttgcccaggctggtcttgaactcctggccttaagtgatcctccacctcagccccccaaagtacttggattacagattacaggcataagccaccgcatcaggtctgtttaatttttaccattcagacagcactcaaggcctagtgtgagtggcctccatcgagggccctgggcttccctctaccctgagggttccatgtgcctcccaggttgaagccatgagagagtccagaactacccccaccccaaaaaaagtcttgctcatggccagctgagtgttccacagcccttgatttctgggtgtgtcataatgtagtcaccaagtcaggcctgtgggctgcctctgggtccttcctgttgagagtgatggcatgtcactgctggcttccccgaggatgagaggttcaacttgtttggttcggcccctaagattctcttacattacctctagctcagacactctgcttgtattggaaaactgggaggcagtgccttttcctctttcttcctttctgaaatagaaggtactcagtagatgttggatttggaatattggaatgaaatgaaggctgtgtgggcctctgggcagcctttggtgttagaaacaggcttcatccctgctggacttgagtttcagttgaggagctcctatctgggcagcactcttcaccagcaaaggctgtccgtggtcttttgaaaagagatcttttttagttcatttcttaaaatccagtgctatatgagagccagtctgatcttttctaaatctgtactttcattttgggtagcgcctaaaagagacacagcagtccctgttcaacctcttttcgggaaaccaagagccttggctgcttattcatcccttctctgccgttttcaacaacaaaccccctttgatgaaagaccattctgagacaggctagagctggttccccttttatttctcctcttttccaagctcccctctgccacctcctgtatctcttccaaccttcctcccccaaagaaaaacaacaacaaaccaaactttgaaaaaacaagggaggcttgtccccattggtgaaatcccttgaaaggatgtcactgagaaagggtctctgtggccctctttttccgcaagcgttgggaggtctctgaggatctgacctggggagactggagcgctaattatacgcacagaagccattcattagttgccactagcaagaagacttggccaatgctcactcctctgaattcagaggttttgaaagaaccccaaactgagcctgcgactttcttcaatctttttttttttttaatatatatatatttctttcttctccagcctctctgttctcctctgttgcccacagcaacctcagcagttggtaccagcacagagtggagagggcaggccaggttacctcggtgtcaagcaatcattactgagcaattcaccagagcctcacaaagaaacagatttctctgaaaatctcccgatccaaaccacccccaatatttaaccagcaactccccaaccctacctttcctgagaggtccgtgttttctagtacctgagcagacagttatgagccactgcctccctgcctttttgaggcctttctttaccaacaatgctttgttaactctttaacacactttcctgatgttcacactttctgcctaccacacacacgtccagtagagacagacaagggggagaattaaatgattagccagcagctgcccatgaggaacaggcagtcaggccataggtttttcccttttccgctttaccatgagacagtgctttgtcaaaaggaagtgccaaagttgtcatggaaataaatcattagctagattgagctatctttaatttgggcgggagtctgccattaatatgtctaaatctcagtttacaaatgagcacttgatgacttgattcctgacacttattcttgtgattcttttgaatctcaattagtaagactttctttctcatagaatgccatacggcttcttggaacaaaggacaaacgggtagaatgcttgaaacagaccaaatcaaagattatgatttttttttctgaagggaagaaaaaaataaaattggaaaaataaaaataaggcttatcatgatatcctgccgtctgatttctaaaagtacagttcctttaggttctaaggactggcatgttctttgtgatatttgtcaatgacatgtgaaatgtgctctgagtaaaggcattttcttctgcaatgttcatttctatttcaatggtctgcctcagtacttttctttaattaatactgtttatgctcactgatgaataattcagagttgtacaagcaacagatgtcagcggattcaaaatgactttccctgaattatttattatttccaaaaaagtaacaggtttgttgaacaagtaattggcaacacagatgtagatcaaggtttgtcagcaggcaacaagtttcactactgtttccccttttgtgcatgttgataaccaggatggcattgtctaggagcgggggtctgcctgataccactgcttagggagtcattgacccatcctgttgctgacttggagagctggaaccttagttggtttccaggttgtctaacgatgaaacatgaatggaaattcatccaaaaatgtaattaatgaatgtaggcttgtaaatatctcgcagacagaatgacttaatacaggtgcccagaaagagggaacatctttgtttgcagggatatgttaagaatagagacctagaagaaaaataatttgacagatatgtaaaggtttatgtataagaatgttctctgcagtgctgtttatgacagaatttttgcaaggagacaactcaacgtccaacaatgaaagactggttagataaattctggtagatccaagcagtgaaatattatatcaccactgtaatgatatatatgtatttttgatctggaaaaatgtcaacatattaaataaaagatgatattaagtgagagagtctataaaccgatatggcttatttctgtaggaaaatacatgtatgtatttttttttgtaggcatagggaaaagtctagaaggaactaccccaaaatattaatagtggttatttaggggtagtaggatccagcatgacttttcttctgtctcacatattttgccatcattttcactgtaagtatgcttatgttatgaatctcagttaatacgactttctttctcatagaatgccatacctcttcttggaacaaagcacacatgggtagaaggctaagctgctgtaacaagagatccaacaacattgtgacttaaagaaataaatctcaggctgggtactgtggctcatgcctgtaatcccagcaatttgggaggctgaggtgggcggagcacctgacatcaggagttcgagaccagcctggccagcatggcaaaaccccatctctacaaaaaatacaaaaattagctgggcgcagtggtgcacgcctgtaaccccagctacttaggaggctgaggcaggagaatcccttgaacccaggaggcggaggttgcagtgcgctgagatcgtgccactgcacctccagcctaggcgacagagcgagacctggcctgccttgttatcttctaaagagccaagtctgggtgctgtcgtgagaaggaaacatgggtatggaagaggcacaacttgccgtctcaaggccctggtccaaaagtggcccatatcactcctgctcccagcccttagcagggacataggcacatggccatactccactgccagctgcaaagcaggctgggaacaaaatccttacaggcatttatgtgaccagcaatagctctgtgctatggagaaaagagaaaaggaattttgctgggacagctttcggtctctgctaaatttattgattgattttcaaattttttttagatatgaggtcttgctttgttgcccaggtaggtcttgaactcctgggctcaagcgattcccccaccttggcctcccaaagtgggattacaggcatgagctaccatgcccagctgctactaaatttattacccgtaaaataaaaataaaaataaatttaaaaaggaagttgagttttgattcgatgtcttcagagggcatttccttttggaattaatcatacagaagatgtatactctgaagcaatttgaagatttaaaaaaaaaaaaaggaaaggtataaaatgtggacactgccttccagggatttacagtctgattgagaaaccggaccaataacaattcgaagtagtatatgcaaaaggccagagagtgttcagataagtgcagaggagcaaattggctagggtcatggaataaggcttagataaattgaaaggcttgcaattctgctttgttgagctaccaggattacttgtacttttggaagaaataaaactatttgtgttttgtgacattttagggtagcgtgacctccccttacaacacagaggaactgaatcatattttcctactgactgactaacagtaatttaagactctaattggtcttccgttagctgtcatttattgtaattctttgtgaaatgcacatgatctttaacataaaatatcttggaagagctacaacttaaaggaaacttgacttgataatgtaaaaattatcttttaaataattttttaaatatatggttttaaagctttttaatatggttatcttgagtagggtatttctaggcttatttggaaggcaaaccaaaaagcatagagagttttttttcctcccttggatagaaatttttctgtctttaatagattaatggtaatcatataacacattacctccttcacaataagatcaaattttgcaaatcttttgccttgaatcagattcttcaactctggagtttaggttagtagaacccaaaaatatgttgttttatgcacaaagcctcgcaaagtcaagtggtagattttgacctcttctttaacctaccctgaatgtagtcccttaaaacatgatggaatccacatttggtatttccctgctatttcatgagatgcaacaaaatgtttcaagggagacagtaggaaccatttggtgctttggtgatcttttcaggaaaatctggtttcggaagccccataaggcgagaattattgcaaataaggcccagatttgaaaattgctgttttgcaaattgtgcttattctaggaataatgatttctacagctgggaagaactttaaaaattgggtgaaccagttgcctgctttgacagatgaggtactgcaatgcagagaggtcaagctagttgctggggtcacctagctcatttgtgacaaaactaggaaccgtgggtctgactcagtcctctgccctgccgccctgtaccacagtaggcctctctatattatgccgcttggtagtcacccaccttgcttcctaccatcaaaaggaacttctggtagaaactcctttcacagcctcctgatctgcaggagtgatgaatttagcctgggatgaactgggagtggcagagccatctttaaaccccaggtcctttctggatgctttgtttgcagaagagctgcagagatcatgagggacatttcttgattcatattaatcagaaactcatttggggcagaatttgaacttgtagccaattttataaggaagtttcacagctaaaacctctctgtgttgtaaaaggaggtcatactaccctaaaatgtcacaaaacattttacttcttccaaaagtacaagtaatcctggtatccagataaagaagttttaatttgtttttattggtttaccttgcctcagagttctgagtgttggattttcactgtgacaacaaaaataaaatatttcctgcttattgtaaagcggtcaaagagctgaaaagcaataccatcttttagaatgcatttcttacccttctttgatcaacattaagatgcgttgccactctggggtatgattctggtttgatcgttgcagtgttttggaaaatgtttgatggcctataggtttattgatttcaaagactgtaaatccatctgcccatctatccatcattcaccctcctatctgagagcagtgtgggaagcttctactgaagtaccaataacttggattggtagccttcaagccctggggggacttggtaattccacacttaagtttttctacctgaaaaacatatagctcttaaatttcaaaatacagcttcgtttatgcctgaagaggagaagtttcataacgcagccagcactgttggttgtcatgcaataaccattctcccttcacccttgctaacgttttctttctttttttttttttttttgaggtggagttttgctcttgttgcccaggctggagtgccgtggcatgatcttggctcactgcaacctccacctcccaggttcaagcgattctcctgcctcagcctcccaagtagctggcattacaggcatgtaccaccatgcctggcttattttgtatttttagtagagacggggtttctccatgttggttaggctggtctcgaactccccacctcagatgatccgcctgccttggcctcccaaattactgggattacaggggcgagcctccacacccagcctgttaataacgcttttcttcattccattttcttgcctgtgagatgtgcataagacccagctcagagagttgttgttggttcctactctctaactttgcctaattagatttctgttaagcttgagatcatttatagccaactttttccatattaaaatcataagcctctgttgaaaggttttgttagtccaaattggaaccgtcttgacttcgcatcaaatcattcatctctagctcagtcgccacataagcttgtataattctctcagggcttctgtcattgttaatttacatctgaccttgttctgaaaactatttaaggcagtggagccctaacttagaacttgctggcttttaactttgccagttggtctggacctgtgaaaatatttatccaatcccctaagaaatcagagtaaagattttcatgaaaacttctagccgggcacagtggctcatgcctgtaatctcagcactttgggaggccgaggtgggcggatcacttgaggtcaggagttcgagaccagcctggtcaacatggtgaaacctagactctactaaaaatacaaaaattagccaggtgtgatggtgtgtgcctgtaatatcagctactttggaggctgaggtaggggaatcgcttgaacccgggacatggaggttgcagtgagctgagatcatgctactgcactccagcctgggtgacagagcgagactccatctcaaaaaaaaaacttccaaaaccatttttacatattggtttattttgactcttgatcgttgtgccaagaaagttgattatgactagcgtttccatcttacaaatagggaaatggaaaactcagaaaggtcaagtgacttccctgaggttggtaaggagtggtagagccaggatttgaacctgggcagtgtagccacagggtcctcactcttaaccacttggctaaactgtcttcatatacgtatgtatgcatgtgtttggttcccggtggtgatgccatggggagcatttaccatgagcgcagtgggaaaagcatggagcatgctggaaggcatggatgcttacattttcattccggatttgtggattttgcactagggtatctgctaggccatgaactagaattgtgtactgagagtcatcattagttgggtgatttttttttttttttttttttgacataggcactgctctgtcgcccaggcagtggtgtgatcttggctcacagcaacctccgcctcctggattcaggcgattctcctacctcagcctcctgagtagctgggattacaggcactcaccaccacccctggctaatttttgtatttttagtagagatggggtctcaccatgttggccaagctggtctctatccacccacctcagcctcccaaagtgctgggattactggtctcagccgccgcacccggccaattagttagatctttctacggaagaacaactgacttgccaatttagtctgtaagatcaggagttgagggacattggaactacagaaaaacattattaaagatgactcttaagatgtcaagaggaaagaaaaatgacttcttcggtcaaaaaaagagcaaaagctatcacgctgtatgagccacaagctgaaggctgtcttctgggggcggcttaaatgcattagattagtctgcaatgtggattaagggaccgtgggatttaataacttgcgtattaaagaatggctctgcaaatgttaccctaacataaaaatgtaagcattctaattgaatttagaagcaatagtattaaaatttcttctggtgatgctccttagacgcattaaataaaatatcaaaagtcacaattgattaaactgaaactttagcatgagagttattaagcattaaattctgctgctagaggtttttattttattttttcctgacatgtactcagaaaattctccctttacataatttatggtcattctgctgtttaaatgtgccaaaaaatgttctcggagttttggcagtgttttgaaatagagtatattatcttagtcttgggctatatatatataatgaacactcaatatatattgatggtggtgttttcatgagttgaagtctcgctgtgggcaaaggaaggaataggctattctattacatctgatgcttagcctgcctttaatgagtaatgtagaaaaatagacctcttcttcctcctatggcaagtctgtatgtagtcttgctaagcttgtgtctgcccacaaatcctaatgagaagatggcattgatcggagatggtagcaaagtacagctgggatactgctgtccatatgttccatggttccagaattccaaggactacagacagccttgtagaaatcacaaagcatgagtgatagttataagcaaagaggtcttctcctttttatccaaggacaagcaaatggcagggaggcagaaaggtgacgttttgaatctgtagacacataacgaggaatgtggttgactgaaaagtgtctatgcatttagggcggtgagagcagacagttaggggcatccaggaaacctcctcctctcttgcctttcagggtgtctcctggagtcccgagtgtggcatgttctgcattcaagagtattgtggaggccagacgtggtgaaaccccatctctactaaaaatacaaaaattagctgagcgtggtggtgcatgtctgtaatcccagctacttgggaggctgaggcaggagaatcacttgaacctgggaggcggaggttgcagtgagctgagactgcaccaccgcactccagcctgggcaacagagcaagactctgtctaaaaaaaaaagagtactgtggaattcattcttatgtagctgtatgaaaaagaaaaccaacatcataaaatatgagtactagtttgaagtccattacagacaaatcacaccatttttatgttagaccaccccaaccacttcccttttttgtttttgtttattttgacaggttctcgctttgtcacccaggcggaagtgtagtggcacgatctcagctcactgcaacctctgcctcccaggttcaagcaattctcttgccacagcctcctgattagctgggattataggcactcaccaccacaccagggtaatttttgtatttttagtagaggtggggcttcaccatgttgaccaggctgatctcgaactcctggcctcaaacgatccacccacctcggcctcccaaagtgctgggattacaggcatgagccaccacacccagcctcctttttgttattgctcagatttacagaaatttattttgcaaaattttacctcgaagaaacaagcgagtgtttctctgtatccatctgagctcaggaggatgcccaagtgaaaggtgtttaatccaacttctgttgaatgattgacttctcagggactgttaatttgtaaactctaagaaagggggaaagtttaagtttttccggctgccaaactttgggcttcatggtgaatcatcaggacaggctttctaggccaagtgtaagcgctgttctgggggccactggtctgagggtgggggagcaggatgtgtttatttagatgcacggccagagttcacacacttggggtttgggatcagcctccagggcctaagtaatttctcccaggagatgtcttcgcatcttataccctgtataggatcatcacggactgctgattgaagaaaagggttaggaccactgatcagagagaagctacgattttttcttttctgtctgtcacagaggtgtcagtaaaggagaaagcttacttgaaaggtttggattaccgagcagctcaaaagagctgttgctggcgggattttctccttgctgaagtttttctttgcccctagaatactaagcaaaaaggaaagaaaagatgaaaggtaagtccctctttaaaaatacattgagtcaacccatcgcagaaaaatacagatttctcaactgacaaataagcggcatcactgcatttgggaatcagaaaaagtccccacgataaagttatttgggaattaatcaacacttggctcatcctaggcgtggagcgcttcggaattcacctcgtgttgcttggaagctggcagcccggttgttatataatgtgaacccagaggcctgccagacggccctccctgtgccccgggggagttacaaggctctgtaactcttggagtcagtcaatcctgcagaacagagtccaggggcctggtgtgtgctgtgttttacagatgacacattaacctttgaaattctgtcctcagtcaccttcatcaatgcctgagcgaacgaaggaagggccacatgtgggctctttttttgttcacttttccaaatggagataagacatgtaacaaaatttaccatcttaaccatttttaaatgtacagttctgtgttattaagtgcattcctatcgttgtaccagtatcaccactatccatctgcagaactctgcatcttgaaactctgtgcctgttcagtggtaactgcctgttcccctcctggcagcccctggcagccgcccgtctctgaatttcagagccactttctgtccctgagtttgactactctaggtactcacataagtagaatcacactgtatttgtccttgtgtatctatctggcttatttctcttagcgtaatatcctcaaggtgcatctgtgtggtagtgtgtatcagaatttccttccttttcaggagtgaataatattccattgtacggatataccatgttttgttcatccatccatccctccgtggatggacatgggttgtttccaccttttgactattgtgaatagtactgccatgaacacagttatacaaatacctgtttgagcctctgctttctgttctttggggtactttcccagaattggaattgatgggtcatacggtaacagactccttttttaaaaaagaaaagtatcttgagaacttgggagagccaccctaggagtacttactgggctggattgtttgctccgtctccttttgcctccaggtacagcccataggcctctgtcctcacagatgtggtatggaagagtggccctgttccagggtgagatcaccagtgtagaccttctcagtttgaccctacatctgatgaacccccaaaagcacagagaggatctcagaatgaactaaagatcatgggctataaatgactccttccttctccttttcttccttggatgacaaagattgtggtcactatacagttatggtggcctcaagtctggtaaatcaatgatgtttcatgttagctgctcacgggattcaccttgtggcttattgatgtccagaccccgcctctgatcccgcctctagagattctgatttcattggtttgagtcctggcctcagcatggggacttttgaaagcttccaggcgagtctaatatgcagccagggttctgtagcacccaagtgaattactgaacccgaaccttttctcaatccctttcatgctgtctgttgtctttttggttatttcttttttctttttcttttttaatttgagatggagtctcgctctgtcccaggctagagtgcagtgataggatcttggctcactgaaacctcttcctgccaggttctagcaatcctcccaccttagcctcccgagtagctggtattacaggtgtgcaccaccacgcccggctaatttttgtatttttagtagagacggggtttcaccatgttggccaggctggtctcgaacctcaagtgatccatccccctcggtctcccaaaatgctgggattgcaggcgtgagccaccacacccagccaggttatttctttggagcatatcttcagatttgtacatctcagcccaaggtttaaagatttggaaacaggcttttctgtgtgtgtgtgtgtgtgtgtgtgtgtgtgtgtgtgtgtgtgtgtgtgttttaattaacgaggatgcattatgtaactttggagctaagaatgaggaatgaggatgcattatgtaactttggagctaagaatgaggagacctgggtcatacttgtgtgtgtgtgtgtgttattatctaaccagggataatgaattatttaacttggcaggatctcagtttgttgttgttggttttttgttttttgttttgtttttttttaaatcttggctttaaaattagggcatagattggcaaaccagataaaagaatgaaattaatgatttttttaaaaatgtcccctctagctctgacataccacgactctgaatgaacaggtggaattgatggggagtgaggaggcttggagagagagcccccgggtgtgaacccatcctgttctaacaataatgagctttgggatgaagagcctccccgcaggcaggggactgctgggagtttctggtgtcccagaagaagccttcagggcagctctgatcagtaaataaaaggatacgaaataaaaatctcaaaggatccgtaatgaataagaaagcaggaatgtcgtccccagggagaaatgagttgggggctttgtcagtcacgagagaacatagcacaggactctgggtccaatggagctgaacgtcagcgcctctgtccccacgaaaatagtaacttccctgacaccatccacctgatgccaagagctgtttatatcaacatttcttctcgggattctttcaaactttatacttacttctctcctcctctgattctattcaaggaatgtgaatggctgaggttttgttttgttttgttttcctctctagattagcacagctaatacagtggaattgtgatgccagggtctattagtgtagagaaacaaagaatgcagtcctgccctgggcaccagggtttacttccatggtgacttcttcttaagcccatgggaaagtgagagggaggtgacctcctcacagtcggctcagcctctggagcccggagccggagccagccccatagtgtgtggccatcaggatgacgcagagaggcgtgtgaacgcagccggccactgcagctggtgcacttgactctgggcagcgcgttcccaggaacccgcaggacactgaggaccgtgcgtgatgtaacccagatctgccagatgtgggagccagcatgagtcacaatgccgggccgttcattaagaaatgctttctgggtcatctgggtgcagggcactgctgcttccctgctgtccagggttggaggcatcaagtctgcccaccaggaatccccaagttcatgaacatctgtctaaaattatagcctggttttctgagctgatgtggcacagagcacacgcacgctgatggtctctggcttgtaatttgttaaaggatctcaccactttggttagtggtgggaaatcagataataaaaacatacgcccaggtgggagggtcacttgaggccaggagtctaagaccagctccagcaacatagtaagactccgtttctgcaaaaagataaaattacctgggcatggcatgcctgtagtcctagctacttgggaggttgaggtgggaagatggcctgagcccaggaattcaaggctgcggtgagctgtgatcacactactgcctccagcctgggtgacagagtgagaccctgcctcaaaacaacgacaaaaccaaaaaccaaaaaccccaaaagtgtaagttgctgtgaggtttctgcacattttagtaagatcagaaatgaggtggggtgttgggagaagccaaaaactgtgctggcattgtgccagtgaaatgccagcaatcacgagcggtcttcctttttttttcttttttttttaaaaaaaaaaagatgtgcaagatgccttatggtgaataacaagtatatttctgagaagttgtaaactaactccttaaaaaaaatccttatggatataagacatacagtcagaaaagttcatgcatgcatccctgggtaaaatctgacacccaagtaactgtagcaagttgaagggtggccccttaaatatcccccagagcctgtgaatatgatcttatttggaaggagacctttgcagacataattcaatcaaggatcttgagatgagatcattctggattacctaagtggaccctaaatccaatgacaagtgtccttacaagagacagaagaggagaagacacagacacacaggaaggaaacatatgaagcaggaggcagggattagagcactggagctgcaaggaacagctgagccaccagaaaccaaaagaggcaacaaacgggtggtcccctcgtgcctttggagggagcctggccctgctgacaccttgatttcttttttctggcatccagaactgtgagccagtaaactctgttgtgtgaagccaccaagtttgtggtgatttgataaggaaactaataaaatcatcacacctagatgaagaagcagaatgtttccaaaaccctggaaactccccctcaagcctagtttctgttttcacaccgccccaggacagctactgtcctgatttctaacgccggggataggttttatgccatttgaacataataaatggaatcttacggtgcatcgtcttctgtgtcagatttcttcccctccacgctttgtgagatgtgtttatcctgttgtgtgtttgatgattctcactgctgcttagttgtagtgttccacggtgtgaatataccacgatttatttactcttctcctgttgggggcatttgagtttggggctacgacaaagagtgctgttacaaattctgtttcgttcctttctgatgaatatacgtgggcgcttttgtgagttacattctcaggagctgaattgttgggtcataggctatctgtgtgttcagcttcagtagctattgccagttttcctattaattttttaaacaccccatccgatttggaatctctgtgtgaaatggagaatccaatggtagattcagtaaccactctttaatgtggctattttataaggtccaaatgttgaacgcagggttttcttggagcaagttccttccttagatcacaatcaggaatattccatgtctcagaagagcccattacagggctgggcaggcgtgaaagcacaccagtttctgggaatcggagaggctgggctactgactgtgaattttaaatattcttaacccatcgctggagtgatgaatagcacagctgtcgtatcctccatctcgagactcagaaataaatttgcagtcttttaggagctccagttttaattctcctttccagcttttaagctctatgctccataacttaggatgcaaccaaatgatatgcagcatttctaaatattctgctttgataagtgagtggaaatagtgctggtacagcggataagactagattaaaacccagggtccccagctgtctaaagaagatgtgctgctttggatttgcctgatgccccaagatctttctggaaatgggggagggtggctttgaccttggaaatactggaaaggggaggaaagtgtggtgatggtacctcagaggactgttttccctccagacgtgagatgggtgggatggtagcaacctagctatcattatgactgataagccttctttttcccaatacaaaagcaatttgtcttccttgcagaatgagaaaaattcaggtccaccagaaaataaccacaaacctgacacccacagttaaccactgttgaatatatttgcatatatacatttcatatacaaacctttcttcccatacaaacattttatttctgcagtcaacgagtatgtattgaatgcctgccatgtgccagtccccagggatagagcatgaataaaacagacaaaccatcccctgtccttgcggagctgaccttccagtgggagcttattatacgatacatatggtactaaaatgagatcttatggtacatgtttcttatcggttgcttttttccactaacaatatgtgtaacctctttctttctttctttctttctttttctttctttctttctttctttctttctttttgagacgtagtcttgctctgttactcagactggagtgcagtggcgcaatcttgactcactgcaacctctacctcctgggttcaagcaattctctgcctcagcctcccgagtacctgtgattccaggcacctgctaccacgtctggctaatttttgtttttttaatagagacagggtttcaccatcttggccaggctggtcttgaactcctgtcctcgtgatccacccgcctcggcctcccaaagtgctgggattacaggcatgagccaccgtgcccagccctgtaacctctttcaatggcaacagatattcagatataacttttatagatttatcaatgaactaaatccccagtggttttgcttgctggtggtggccagcacattcggagatggtgactgctctgatagtacaggtcccagagtgccaaaaggaccagggtgctgccattgacttgcagaagcaagaagtaggctgggtgcagtggctcacgcctgtaatccccaggaatttgggaggctgaggtgagcagattgcttgagtccaggagttcaagaccagcctgggcaacatggcaaaacaccatctctacaaaaaatacaaaaattagtcggacgtggtgctgcatgcccgtggtcccagctactcagggaagctgaggcaggaggatcatttgagcccagggggtcaaggctgcagtgagctgtgactgtgtcactgaacttcagcctgggtgacggggagacctcgtctcaaactggcaaaaaaaaacagcaacaacaacaagtagaagtaaactttggcaatattgagccatggagttgtttttttttttgttttttttttttttttttttttgagacggagtctggctctgtcgcccaggctggagtgcagtggcgctatctcggctcactgcaagctccgcctcccgggttcacgccattctcctgcctcagcctcccgagtagctggggctacaggcgctcgccaccaggcccggctaatttttttgtattttttagtagagatggggtttcatcatgttagccaggatggtctagatctccttacctcatgatccgtccgcctcagcctcccaaagcgttgggattacaggcatgagccaccgcgcccggcctctgagccacggagatcttttttaaaaaaacttttattttaggttcaggggtacatgtgcaggtttgttatacaggtaaactcatgtcatgggggtttgttgtacagattatttcatcacccacttactaggcctagtagccagtagatacgttttctgatcctctccttcctcccactctccaccatcaagcaggcccccaatgtctgttgttcccctctttgtgtccgtgtgttctcatcatttagctcccacttgtaagtgagaatatgcagtatttggttttctgttcctgcattagtttgctaaggataatggcctacagctccatccatgttcttgcaaaggacgtgatctcaattcctttttgtggctgtatagtattccatgagctgtggagatgttgaggttctttgttaccaagcattaactggccagtcctgaccaatacagctatggtcataacatataaagcaccttaagggaagaggacgtttagctaactctatgatgttgtcacgctgacatgaatagagagggttttgttttttaagccaaagacgttaatccattaattggcatttaaaaggtagaaatgccattggatgtaggaaagttcatctgtatttgaccattttttatttatttttgactctttatgcttataattttggaaattccaaaatacaaaggagtttttggtgatgctgggaattgaattctgaggagaaaatgttgttggaattatagagagtgcttttggaatactaccaagcatagtacttgaccttagaggaaaaaatgctggggagcacaacttaagatgggaaaaaagaacaagtttttaaaatatcatccctctaacgaatgcttccgtgatggaaacactcccctttccctgttatcgttcttcatttcctcctactctttactttaactacaagttcttgtatgcggttattcccccatgtaaattacatgaaaaatagttttagtcttctaactacattatccaatatgcagctttttaactagttccaagaggcatttgaggcccatgcgtggctccctttgagttgagtcatctaaaggttattgctcgtcttagtaaaacctgtgctgtgttgagtgcaccggtgacgacaatgaccccagtcttgagtcccagcctccccgtgtttactatggaattatcacagttccactcttgagaaatatggaaagcactcactgttcactctggtttaaccctcctgagagcaggaggtatgattaatcctggaaataatgggttcactctgtgggagcgcttcagtgattttcaaccccagactcatacatggtgattgaaaagaactagtgtgatcacagaaggttagcagaattatttctacttagaatagaaatgagaaggttgagggtcgtaatttcaaaaatggaaaagtaggttttaaaaattcaaatgtaatacataaatattccaaatatatttagagcgagaagccttctttccgccctcccaattctgcccttctctgcagagcttaccatagtttaaaaaaaaaaaaaagtgctgttttatccttttggaccctatactgtgcatttataaatgtgagaaaaccaggcatggtggtgtgtgcctgtggtcccagctactcgggaggctgaggtgggaggatcgtttgaacccaggagttcaaggctgtttttagctatgactgttccggtgaatagccactgcactccagcctgggcaacacagtaagagcctgacgttaaaaataattaacatgagaataaaacttatctatgttttttgtttttacataagtagtcacacaagacatattattataaacctccttttttttttttttgagacggcgtctcattcagtcgcccaggctggagtgcaatggcgcaatcgtggctcactgcaacctccgattccccagcctcagcctcccgagtagctgggattaaagcttaatttataatggaagtcaccctgtgcaggcacacttataggtactgtattctttggagcagtagctcattaaattgataaataaaactttattttcttaatgatggacatttaggaagtcgtctttttttttttctattacaagtaagataaacctgtgtctccataaacttgttcgtgtcttttttttttttttttttttgagatggggtctctgttgcccaagctggagtgcagtgatgtcatcatggctcactgcagtctcgacctcctaggctcaagcgaacctcccatctcatcctcctgaataggtgggaccacacgtgtgagccaccacgcccagctaatttttgtattttttgtagagacatggtttcgctatgttttccaggctggtcttgaactcctgcactcaagcagtctgcctgcctcggcctcccaaagtgctgggattacaagcgtgagccaccatgcccagcctgtttaggtttttgtgcacttgtgtatttttctttcttttttttttttttcaagatggagtctcactctgttgcccaggctggagtgcagtggttcaatcttggctcactacaaccttcattttccaggctcaagtgatcctcccacctcagcctcctgagtagctgggaccacaggcatgcgccaccaggcctggctaattttttgtatttttggaagagacggggtttggagttttcaccatgttagccaggctggtcttgaactcctgagctcaagtgatccacccacctgagcctcccaaagtgctaggattacaggcgtgggccactgcgcttggcctctatcttatgtttattatccatgtgtatatcatcttcagaaactggctccctcatatctcttgcttattatttccttttgggttatctttttaattaatttaggaactctttatatattagcaatattaatctttaatattggccggacatggtggctcaggcctgtaatcccagcactttgggaggccgaggcgggcagatcatctgcagtcaggagttcaagaaaatactccattgtatgtatataccatattttctgtatgcattcacctattcatgaacatttaggttgtctccaacccttggctcttgtgaataatgctgcaatgaacttgggtgtgcaaatatctctttgaggtcttgttttcaactcttttgggtatataaccagtagtggtattgctggatcatgtggtagttccagttttaattttgttaggaagcttcgtattgttctccatagcggctgtgctacttgacaagctcatcaatggtgtgcaatgattccagtttctctacgtccttgccaacacttgttattttctgttattttgatagtggccttcctaacgagtgtgaggtgatatcccattgtggttttgatttgcatttccttgatgattagtggtgttgaatatcatttcatatactcatgtactcactagtcacttgtgtatcttctttgtttttttttttgtttgtttttgtttttttttttgagatggagtcttgctctgctgcccaggctggaatgcagtagcacgatcacggcttattgcaacctctgcctcccaggttcaagcgattctgttgcctcagcctccagagtagctgggcttacaggcacccgccaccatgcctggctaatttttttgtatttttaacagagacagagtttcaccatgttagccaggctggtctcgaactcctgacctccagtgatctgcctgcctcagcctctcaaagtgctgggattatgggcatgagccacgtgcccagcccgtatatcttctttgaagaaatatctattcaagtcctttgcccgtttttatttattttgagaagcagagtctcgctctgttgcccatgttggagtgcaatggtgtgatctcagctcactgcaaccttcacctcctgggctcaagtgatcctgccaccttagcctcctgagtaggtgggactacaggcaagtgccaccatgcccgtgtaatttttttatttttttgtagagacaggggtctcaccatgttgcccaggctggtcttgaactcctgggctcaagcaatccaccctccttggcctcccaaagtgctgggattataggcatgagccactgtgcccggccagcctgaggaatcttaggaaacaaagtaaagaccttggcctgaatagctggtctgctacctccctacttcctactgcccagaggcaattacagtcatgcaccatataacaatatttcagtcaaggaaagatcgcatatatgatggtggtcttatgagattataatgctgtatttttactgtaccttttctgtgtttagatacacatacacttatagttatgttacagttgcctacagcattcagtacaatagcatgcttttcaggtttgtagtgtagaagcaacataggtgcgtagtaggctacaccatctaggtttgtgtaagaacattctatgatgtttgcacgacagaatcatttcacacatttctcagaacatatccccatcgttaagcaatgcatgactgtacatctgttcttagttcttccattggtgagcctccatcgttttaaataaatgcatatactgtatgctctttctcaatgtatcagttttagaattatccatcttctccccttgaatatataagtaggctgcagaggatttagtttgcttgtactgcttctcagcttatcttcttctgatggttaatcattttaaacaattagttttagttctcttagctacctctagttattgcatttctgtctctgtttcttgttttgtcagttttcggcaatattctctttcctttctaaataaaacattaaggccttaccctttcatttttctcccttttacgttgtccaaattctggataaatgaatatggtatatccataaatgggctattatctggtaataaaaaggtatgaaattctgatatatgctacaacatggatggaccatgaaaacatcatacccaagtgaaagaagccagacacaacgagccacatattacatgattccatttatatgaaatatccaggataggcacagaaagttgatgagtcattgccaggggcctcgaggaataccattaactgcttatgggcaccaggtttctttttaggataaggaaaatgttctgaaattagatagtggtaatggttgtaacaacctcatgaatatactaaaacccactgtattctacactttaaaaggacaaattttatggtttgaattatatctcaatttttttttaagatttttttttttttttaattgagagaaggtctcactctgtcagccaggctggagtacagtggcacaatcacggatcatggcccatggctcacggctcactgaagcctcaaactcctgggctcaagtgatcctcccacctcagcctcccgagtagctgggaccgcaggcgcgcacaccaccacacttgacaaaattttttttttttttaagtggagacaggggtctctctatattgcccaggctggtctcaaactcctgggctcaagcagtcctcccatctctgcctcccaaagtgctggaattaaagacgtgagccactgcacctggccaaaagaaagattcttaactgttacattccatttattccattttctaatcttaatatctttagcttatttctgaatgttggacaccagtaaacaacatttattgtcgctgtgtaaacattgcccactgcaggtctaggtgctaatgtcatattattactttctctataggaccaatgccacaatccacaggccacctagaggatagcatttcatgcatcgcagttcgagtgaattctcttttcttatttaccatcgactattccttttgtgttatcctggaattccttcttgctttctttttcatatagaccccaaaaatacactttcatcacctagtgctgtagatgcactccgggttatatgacatctccttacttctcagccatcgtcatctggctccaatctaccagcctgtcctgtctccttcgctgccttgtctcaacattttattaaatttatttcttcctcttttttgttccattcccttattttgcaaccttttggatgttaccctttggaagttaccctcttgtaacttccacattaaaagtttgggggctggctgggtgcggtggctcacgcctgtaattccagcaatttgagaggccaaggcgggcagattgcctgaggtcaggagttcaagaccagcctggccaacatggtgaaatcctgtctctactaaaaatacaaaaatgagccgggatgtggtggtgggagcctgtaatcccagctacttgggaggctgaagcaggagaattgctcgaacgtgggaggtggaggttgcagtgagccaagactgtgccattgcactccagcctgggcaacaagagcaaaactctgtctcaaaaaaaaaaaaaagtttgagggaagtaagctttctaaattctagcatgcctgaaattctcgtcattttggtcttctgctttgtcggtgcctcagtttcctcatctgtacaagggaggtgatcataattacactgacctattagtgagtattaaattaacgaggattaaatgagctattgtgcagaaagtcttaagacaacttttggtacatcataaatttgtttgggaggcgttaaccattcacgttgtagttgaagcacattagatgtgtcttcgtgttctgcactctgaagacatcgtgtggactaacagcaaagtaataagatgaaagtttgtgtggtgaagtaaacgatcctattaccatagttgaaccatagcttatgaattattccttagtgctcttctctgctttcataaaatcataatccgtgttttaagatttacttgtactttttttttttttaggccactaggctgttctcagctctctagatactcagcaaagcacagtcatttccaggaaatggattgaaattgtaatgcagatttggtttagatgtatgcaagtggctttggagagtaacaatgcaatctacttaaggagattggaaaatttaggatattgaagatttaaggaacgggttggcccaagtaacaaaaccattgccctagtcaatctatagtggccacttggaacactggatggaagaggattgggggcagcattggggctgttgtcagtaagtgacatctgccatggggtagaagggtttgtcattcctggccttaccttgatcctttctcatgaaggaagtacaagatattattgagaggatctgacagggagaattggtctagttttgggtacttgaggaagtttgtgtgaagtaagattattgcattgcattgcattgtattgtattgtattgtattgtattgtattgtattgtattgtattgtattgtattgtattttagagatggagtcttgctctgtcacccaggctggagtatagtggcgcgatcttggctcctctgcaacctccgcctcctgggttcaagcgattctcctgcctcagcctcccgagtagctgggattacaggtgcatgccaccactacgcccagctaatttttgtatttcagtagagacggggtctcaccatgttggccaggctggtctcgaactcatgacctcaggtgatccacccaccttggcctcccaaagtgctgggattacaggggtgagccacctcgcccaggctctatttctttttaaaggaagtggagatgtcaaagaaaacatatttgttgtgtagagttttagaaaataaagttaccaaaaactcaaaataaaagaagtagatttattgagaagtaagtctacaggttgtactgggggttggggtgggagtgctccaaggattatggctcctgaatttcccattgtaggactgggtaaaaggtggtaggaactagaaaaaaaatgatatcacttaatgaccactttgtctcataaatgagatgactaaagcttaaaaggtaaggtgactcactctgggtcacagagctggcaatagaatccagtggcctggttccatcttgacggggagggagggggcattgtttgttgcccaggtaccatgtcacactctgagtaacttctctgcagcccttgtattttctctgtaggggacaagggaaaacttaccctttgtttcttgaaacaaaggcaaattaataggggaaaagccatacaaatgattagcgtgcatgggaggaaaatcacaaagcgattacccagtatcctaatggggtacagatgtttatatatcttattttttagaggaaagggagaggggaagtgtggatgattttagggaggtagtagatgatttttagggaatttgatgggcctgaagaacatacaatggattgggacaaagtctgttgggcagacaatggtttgtgacaaaattctgtccaggtgtgttgactgaattcaggctttctttacgcgatatgagttcagttaatgaaaacacaggggagtgaccagaagtgattgtttccttctttggcatttctgtcttcctctttttttgttctattcccttattttgcaaccttttggatgttaccctttggaagttaccctcttgtaacttccacattaaaagtttgggggctggcagatagaaggaactccagagaacaacttgattctgtgctttgggagagacagagaaatgaggggtgtggaggaaggtcagagagaccctgaggcttctgcctcacttcagcatgtcaaagcaccctattttggggtattgctttctgagccccaacatctccagccttccaggagtctgtggcatatccttccccaaaggagtaggatcacttgaccactctactgaacctaagttgtttttcattttcttttgcatctgccttgaagtctagagcaaatgaaaatacaacaacactgtgtaaacaaaacacacaaaaaagctgctctgatctttctgttttctcaggtgcaaaacaggtcttatctaaagcaactgaaaaggcatggaggtagcaattgctttgctattccaggaactagtagccaccacatgtgtaaaactattgaagaacaagttttcaaccttctgctgtgaaaaggtacacaggaatggctaaagtctctctagaacccgtaccttcctggagcaaagggaagacctgggaaacgttttgacaaagcaatgcttacgatatttttcaatatcaggggaattcagtcagtcttctttcttttttgtttggccagtttagctaaagttttgtcaattttgttgatcctttcaaagagccaacttttggttttgttcagtttctctgttatttttctattctctagttcattagttaattaatttaggttaattaattaatttaggtttgacttgctttttttgttccgctgtcttcaggtggaaggttaagttattgatgcgaaatctttttcttttttaatatatgcatttacagctatacacttctctttaggtagcacagccttagctgtgtcacttaagttttggtatgttgtatcttcatttctaatcatctcaaattattttctactctcccttgtgatttcctcttaaacccattggttatttgtgtgtgttgtttaatttccacatatttataaattgcctgaatttctaattctattccattgttgtcggagaacttgccttgtatgagttcagtccttttaaatttactgaagtttgttttatggtctagtatacggtctatcctggagacttccacatgcactgaaaagagagtgtattctgctgtgttgagtgatgtgttctgttgattttttaggtctaattggcttataatgttcaagtcttctgtttccatgttgatcttctgcctagttgttctatccattattcaaagtggggcactaaggtctccaactatagttgtgatagtttagtttaattgtgcatttctcttaccaattctgtcaatttttgctttatgtatttcagggctctgttaggcacatacctgtttatcattgtatcttcctaaggaattaccctttgatcattataaaatgtcccactttatctctggtaccattttttgttttaaagtctactttgtctgatattagtacagccactccagctttcttatggtttactgtttacatgacatatttttcctgtcctttaattccagtctatttgtaactttggatctaaactatctcctatagacagcatatagttgggtcttttttttagtagagatggggttttaccgtgttagccaggctggtctcgatctcctgacctcatgatccacccaccttggcctcccaaagtgttgggattacagacgtgagccaccgcgcccagcccaagttgtttttgagaacacctgtagggagtgtttcctagcctttgcatgtgttacgcttgcacacagatgacagattggccatatgtaaaattttggagtaactctcttttccctcgcaattcttttgatggtgtttcttcgtatttttggcctccccctctacctggattgcactggagcctgctatcaagccttgtgagacgtgccttttgtccagttgttgatcctccattgttactccaccctttcctgccctcctgggcactgggcaagccttagtcccactcagtccctttcccttttctctccctcctccctcaaatcatcatgcttgggctggcgagatattacctagggctactgaaaagtcactttactatgggcaagcatataaatcatatttgtaactggcttttacctactgaaaaaatttcaatatattttaatgtgaagagacactgctgaagaaaaggaaatgaagaaaaggtgaagtaagattttacacacattttcagattagatgatactaatgttcctgaatatacaatctccctttagatttaagatattgtttttagtttagtttagttttgctttgtttttcaaatcactgccctaatcatgaatttcagtctttgggagaaggaatggccctcatggggtggggaaagcagtagttttttcaggtgtaactgacttttaattgacacaaatttacaaatttatattacacaagctgaaaacaatttttttctgtttaaataatgtatttgctatctgaatgatcatgtaaattcaggacaggatttgcctatttttattttattatactaataataaaaccccaattcaaatgacttttcagtacttactatacgcgatgtactgcgggtaaacaagaaaatttcttaaattctcattcaataattggaaatcgattaaattacacctatactaggagagattttatgcaaccattgataatttttgaagaatatttaaagatatgggaaatgctgataatatattcagttagaaaaagcacatttcaaagtaatatattcagtataattttcatcgtatctaaaaaaaattcaaaaccagaattcaaaactaggaagaatatgtacccaaatgttaacattgtctatttctggatttgtttttttaaaaaagtttccttattctaatttttctagaatgaaaacaaatcgatgctataatcagttgatagtatggtggtggtggtggtttcttgtaatgacatagacccactcgttaggattgccaggaatggacacattcatcccacttcaacgagtcactgtgacctcttagaaaaggtgggatagaggcagggccttgatggaagagtaaaatattcatagatgaatacatagaaagaatgactgagtcactgagcagagaagccacgctgagaatgtgtgcagaacagagcaggcaagcagtcagtaaccggggtggatgatgctgagactagggtgggtatgagtcaaggccgagtccgagagctgcaaaaacttgggagaggagttcagatgttgctgtgtacgttggagaaaatcattaaaggtttcagatttgcagtgagatttagatctgtctgggcacgcatggtggctcacacctgtaatcctagcactttgggaggtagaggtaggcggatcactttaggtcacaagttcgagaccagcctggtcaacatggtgaaaccccatctccactaaaaatacaaaaattagccaggcgtggtggcatgcatttataatcccagctactcgggaggctgaggcaggggaatcacctgaaccaggagatggaggtttcagtgcgctgggatcgtactgctgcactccagcctgggtgacagggcaagacttggtctcaaaaaaaaaaaaaaaaaaaaaaaaagagtagaactgtgttattgaaggctgggagaccaggggcaggagagcatttaggaggtgtgctcctggtttgttctttctcttactggtccttctcagtgtccttcctgggtttttcttccttcccctaccccttcactgttgttgctcctgggtactgtttagtgcccatcgctccatggcttcactgaccatctgagtgctgtggtcttctgaccctgagctgcaacctggatcgctttcctgggctgcaaaccaggatgtgtttaaacatgtccaggccacctagttgtccccggaatccttaacctcacaggaagttattttttccaaagcctgctcctcctccttctatatttaattcccaagagtaatctccgttctcccatcctaccagttacgcagccagaaaattgaatgtcctcatgaaatttgcaaagctgttaccagaaaggggccctgatccagaccccaagagagggttcttggatctcaaggaagaaagaattcaggtcgagtctacaaagtgaaagcaagtttattaagaaagtagagaataaaagaatggctactccataaacagagcagcctggagggctgctggttgcccagttttacggttatttcttaatgatgtgctaaacaaggggtgggttattcatgcctactcttttacaccatatagggtaacttcctgatgttgccatggcatttgtaaactgtcgtggctctggtgggagtgtagcagtgaggacgaccagaggtcactcctgtcgccatcttggttttggtgggttttacctgggttctctactgcaaacctgtttttttatgacctgtatctcacgccgaccttctgtctcatcctgtgacttagaatgccttaactctctgggaatgcagcccagtagatctcagcctcattttactcagcccctattcaagatggagttgctctggttcaaatgcctctgacaaaaagacaaatacttagctgaggtaccttcaagaggcaaattcatagagtcagaaggtagaatggtggttgccaggggccagaggggagggaaacggggagctgttgtttaaagagtgtagagtttcagtttgtggtgacggaacgttctagtgatggctgcacaacattgtggttgtacttaatgcaccaaactgaatacttaaaaatggttaaaatggtaaatttcatgttatgtatgttttaccataatttaaaaataaaaacaggccgggcttggtggctcacgtctgtaatcccagcactttgggaggccaaggcgggtggatcacatgaggtcaggagttcgagaccagcctgaccaacatggtgaaactccgtctctactaaaaatacaaaaattaaccgggtgtggtggtgcacgcctgtaatcccagctactcaggagcctgaggcaggagaatcacttgaactggggagatggaggttgcagtgagccaagatcacgccactgcactccagcctgggagacagagtgagattccgtctcaaaataaataaataaataaaataggccgggcgtggtggctcatgcctgtgagtactttggaaggccaaggcgggcggatcacgaggtcaggagttcaagactagcctggccaatatggtgaaaccccatctctactaaaaataaaataaaataaatagctgggtgtggtggtgcacgcctgtaatcccagccacttgggaggctgaggcagaagaatcgcttgaacccaggaggtggaggttgcagtgagccgagattgcaccaccacactccagcctgggcaacagagtgaggctccatctctaaattaaattaaattgaattaaaaataaataaataaataaataaataaataaataaataaataaaacgtgttcaaccgggtttgacttagtttttcctcagacttatttgactgtggtcccctctgatcagaagaaaaaaatgctttaaagtgtgacatatatcacatcctttccatgttagaaaaacacactttggggaacattcccacatacttgggggtggggaggaagaatcaacttcctgagtgtattaactcagagaaatattattagaaatggtggctgagtttttatttgggggaattttgggtcaattcgtcttctctgagcaagcctaatgacgtcatttctatgaatggatttggagctttgaaacactttagcctgaaaagaaacgtctagaacacagccggctcaaatcggagaccaattgacttcaatgagtcttaagtacacaatctgctgcctttatgcagaggtttgggaattattttggaaagataggaggttcctcctattgggaggcttccagtcagtatcttagatctctaagtgctgaaacacttgaagctgagcacagggcattgggtgagtaaagggaaagtgaaatagacagccttgggcaacacatttgtccttccttcctctgccccaggtcctagactaatctgggtctaaagcaggagttgcttaagagactcagcccacacagtggcttcactgtctttcactctgtctgcagatctgggaatcagagccccctctggcttctttggccaccatgtggcccactttcaggacaccccgaacctgccttgtcactaatccctgcgtccagagctgatgtgcgcacccctttccttctctccaagacccccattcctaacagcattcctgcccctctttagacccctgggctggcttttgctttggttgcctttctcagttccttcttcagaagcctctctaatgcctcaagcccttcactactcaagagggcgcccttgaccgcctcggcctcccaaagtgctgggattacaggcgtgagccaccgcgcctggccattttttttctttttgagacagagtcttgctctatcactcaggctggagtgcagtggtgcgatctcagctcactgcaatctctgcctccggggttcaagtgattctcctgcctcagcctccctagtagctgggattacaggcactcaccaccatgcccagctaatttttgtatttttagtagagcaacctctgttaccgcccttgtggataaagactcccgggtcccatcctcattctctcttccccactactcagggattggaatgctgccttgaaatttcagcattaggcccccttttccatgccagcgtattgtttcttctacttgaaaagtacatgttccttataaaaacttcaaacctcatagaagtatctttcccacaattatctcttaggtaattgccattaacaatggacaatatatttttttagatttttctttttctattcatatatgagtacacgcgtttgcattttagcaaaactcctgctatacctactgttttgcagcttactttccttcccccacataattatgcaactggggcatctttccatcttggcaaggagagctctatttcatgatttaatagctgtattgtatttcattgtttggatgtaccatgatttatctaacggatcccattgatggacaactggagtttttccagctttgttattgcatataatgtagacatgaataatcttaagcacataaatctttgcacaattgcaaaagggtttctctaggataaattcctaggtagagtagctaggtaaaatggtaagaacatctttaattttaatagacgttgccaaatcatcttcctaaaggacttaaccattttgttcttccaccacattgtggaccgaggtcggttcccttcacctcgtcaatactggctagctgttctttttctttttgagacagagtcttactctgtcactcaggctggagtgcagtggtgcgatctcagctcactgcaacctctgcctcctgagttcaagtgattctcctgcttcagcctcccgagtagctgggattacaggcactcaccaccacgcccagctaatttttgtatttttagtagagatgaggtttcagcatgttggccaagctggtctcgaactcctgacctcagatgatccacccacctcagcctcccaaagtgctgggattacaggcatgagccattgcacccagcctggctagctttttaaatttttaatactttgatagatgggaaatgttttagtttacattttaaacatttgttttgcaggtcttcccattgcaaaactctagggtgatactgattacttgaggttgaacattttcatatgttaattggccatttgtatttcttctctaaatttctgcctggtctcctgctgatgatgcacttgaatttcgcattgctgttctctgcctgccaggatggaaaatctattccttctcttcagacctgcccttccctgccccaaggctagagagtgatgtccagctcagaacttggggtgagaaagatccacgttgactcccaactactccactagtatgtgaccttagacctctctaggtcccagtttcttcaaatgaaaaccggatttgggggccgggtgcagtggctcacgcctgtaatcccagcactttgggaggcccaggcgggcggatcatttgaggtcaggagtttgaggccagcctgatcaaacagggtgaaaccccgtctctactaaaatacaaaaaaattagtcaggcgtgatgatgggtgcctgtaatcccagctactcgggaggctgaggcaggagaatcgcttgaacctgggaggcggaggttgcagtgagccgagatcgtgccactgcactctagcctgggcgacagagtgagactgtgtctcaaaaaaaaaaaaaaaaaaaaaaacagctggacttggagccggaagatcagaactgttaggctctatcctgtgttctcaggtaccctgaacttgcttttagagtatttatattttattatcattttttgtttatatatcgatttctcttattagactctaaactccttgatcacaaggaccgtattatccatcctcacatctttggtgtccaggatataatggtgttcactcaatattttccaatacatttaatttttgagaattttattgactttttttttttaccataagaaaagctgcgttctaggtgccatgagaatacaaaaaatatttaaaatgtagttcatatcttagttggggagataagctcgatcactcattcattgagttattcaatatatccggagttatctaagctccagccagcttggcagtatctgaaaagataaagtcaagttgtgtaccccacacttaagtggcttccagtctagtaggggagacagatataaaataaacacaacataatgggatgcacacaatcatatagaaatcatataataattattaaaaatatatagtaaggctgggcacagtggctcacgcctataatcccagcacttagggaggccgaggcagatggatcatctgaggtcaggagttggagaccagcctggtcaacaaggcgaaaccccatctctactaaaaatacaaaaattagccaggcatggcggcgggcgactgtaatcccagctactcgggaggctaaggcaagagagtagcttgaacccaggaggcaaaagcgagctgagatcccaccactgcactccagcctgggtgacacaggaagagtctgtatctatatctatatctatatctatatctatatctatatctatatctatatctacatctacatatgtgtgtatatatatgtatatacatatatgtatatatacatatactatatttttactatatgtgtgtgtgtgtatatatatatatatatatatatagtaaaaaataaataagtaaaaacagtcacagaagaattatcacaaagcagtgcatgacttggtagttgccaagtgggagtaaagctcactttgcacttaatgtgttctaggagtcactaagggcataggaagaagagacggctggaagggggcttcccagtgcaatcaatgagtggtcacgtgtgtgtcagtacagcaaagaccaagaaggcttgcaggaaaaacttgttgaattctctttgacctaatgtcacccacattcatttaactgtgaagctcttttcctcccactgcttagcatcctatggatctatcattctttaaaatcgttatgggaaattctggtgtagataccatttgtaattagatagtgtctcttaacctctttggaacataggccttttgagaaatggatggtcggaggggattgtgcacaattctgtgctcttcgaagcccaccgaagacccgcctccatgatcagggaaagcaaagaagggaaaaaaaaaaatcccaggtagtgggagtatctgtgtaggtcgagatagaagagggtagaagatacggagcttgttcactgccgggcagttgactgtgagggagagactgtgtggggagggggacaccaactgtggaagacctcaaatacttggactacttggtgtagaattcacgggttttttgtttttgtttttgtttttgttttgagatggagtctcgctctgtcttcgaggctggattgcagtggtgtgatcttggttcactgcaaactctgcctcccgggttcaagcagttcttccagcctcaacctccgagtagctgagattaccggcacccaccagcacgcccagctaatttttgtattttttagtagagatggggttttaccatgttggccaggctggtcttgaacccctgacctcaggtgatccgcctgcctcggcctcccaaagtgctgttacaggcgtgagccatcatgcctggccaaattcacggttcttgataactgatcaactgtgaaagtcaagggaagccgggtgcggtggcttatgcctgtaatcccagcactttgggaggctgaggcagacagatcacccgaggtccggagttcaagaccagcctggccaacatggtgaaaccccatctctactaaaaaatacaaaaaatagcccagcatggtggcatgtgcctgtagtcccagctactctggtggctgaggcacgagaatcgcttgaacctgggaagtggaggttgcagtgagtcgagattgtgccactgcactccagcctgggtgacagagcaagactcagctcaattaaaaaagaaaaaaagtcaagggagatgccccagtcaaagataactctgccaacagacactggagtcatagttaggattatttacagaaagaaaatcatggagctaaaacttcaacacttcaaaacctatgttatgatcatgttgaaatgccccacgttgcctttattaactagtgctcagtctcccaactgaaaactcattgtaagaattgaatttgccatctaaccgggcatcctaccttgaatggttaaaaatcagatttgtctgatttctaattttagaaggaaccaggctgaccttcattccgctgttgctaactggagccctgttacctgggtgactagatttacaatatgtcagtatgcaaataccatctgcccaagaggagaaaggaagcaaggccttcttcctctaggggttgtcagcagttctggaaacgtcttcctctgggaatggggaggaaggcatgcccaatagaaggagaacagggaagaagatgtgctgattcgtttctggagcctctcccttgttctcttcccacagaggagtttgtggtctgccttgtggacagtcctgaatgtatatcattaggatatagacaggaacttagattgtacatttctcctggtagagtgagcaaaagaagtagtatatatcacttcagtggatcacaaaacacttagattcagataactggaatggcttaatgaagactatgaatatgcgattcctgcctccccaaatgccattaggaatctaatttccaactgataagagagtgtgggctgggcgtggagccggctgcctttactggacgaactctgaaggaggatgaagagaagtggatattccggctcattttcctacacttgaggttgactgggcaagcggaagggatttttctcccacagaatatctatattcagcacttgtcctgagtattgtttcaggcgagggcttggaatcacatttggaaacattcaaatccaaaggcagggacgttctgctttccttttcatgaaataactgtcacatcagctgtcagctgcaggaatctctcccacccacgcattttgtgagtccaaattaggtggactaattaattgtaatttttactttcaagtctcaaggactttgatgggcggctgtgcttcctttcatggttgtgtgcaggaatttatgtaggaggaagaccttctaggagcaggattgaggatctcaggctcttggcttctgattttgtacccctgggttacttcccctgtgacctctcctctctttgctctccttggctctgctctctcatctctttggtaaaaaagaactcttcttaccatcaacctgaaactgtcagcaacatgcaggagtgagcagtcactaaacttaactgtgacattttcatccacctagcctttttatctgcatgtcaaacaagtggccaaggagattaatgcctgagtgcatgctgcagctagacgggctgggttcaagtcccagctctactacttactacctgggtgacattgggcaagtgacttaacctctgtgtatcagtttcctcatttgtcaaatagggatttaaaacgctaccttcctcattgtgttgttgtgaggattaaatagtataaatattttagaactgtgctgaacctatagaagccagggctctgtatggcagcttttaagatgactctgtcatgcatctgcaggggtcctagtgaggtagtgaagttttgctgtgagcaagtagatttccagagcttgcttgcaggcagtgacctccccgttctttcttgccatgctagtttcttttttgagatggagtctagctcagtcgcccaggctggagtgcagtagcgccatcttcactgcaatcacctcccaggttcaagcgattctcccgcctcagcctcccaagtagctgagattacaggcgcccgccaccacgcctggttaatttttgtatttttagtagagatggggtttttgccatgttggccaggctggtctcaaactcctgacctcaggtgatctgtctgccaaagcgctgagattacaggcataagccaccacgcccagccatgctagtttctattcatgcacagatcaagcctaattttccatgtggcaccccccaccaacaacagtaccccatgctgctctgttcctaccccttgcaccctttctgtcaatgctgtgtaattagcacatttggacacgatgtcttagcttctcactctgattgtaatgtgaagttcagctcttcattgtccttgaggcataatgaaaagatgccatgtggctggagagctgcctgcgatcgttgttcaatggatgatgtggccaagtacataaaacagtgacttggacaaccacacttgtcctttagcttactcttgaagtcacttattgctttcttattgcttatggctttcttgttgctttcttattgcttatggctttcttgttgctgtacataacttaaaactatcaaaagaaaatatgagatgttgcagctgctatggaggaaagtctgacagttcctcaaatggtcaaacatgttgttaccatgtgacccagtaattccatatccaagggaaatgaaaacatacgtcctcaaaagactcacccacaaatactcatagcagcattattcataatagccacaaggtggaaaccacccaaatgtccatcaactgatgaagggataaacaaaatgtggtatatccatacaatggaatattattcagtaataaaaaggaagtactgatgcatgctaaacatgaatgaatcttaaaaacatgttaaatgaaaggagtcagtgacaaaaggccatgtattgtatgattccattgatatgaatgttcagaatggccacatccatagaaacagaaggtaacttagtggttgctgggactgggaggagaagagaatcagggatgactattagtgggtatggagtttcttttggagatgatgaaaatgtggaattggatagcggtgatgatttcacaaccttgcaaatatactaaaagccaccgaattgcatattttttttaaaaaagtatgggaaacatctatatgctcaactacagagcttaaagtcatctttaagattactttttccagcgtagctgtcacctaaaatagaataaaaagtgacttgatctgcaaggaaaacatgaaaaatgcaaatggtcaagaatggctttttcaccccaaattgttgaatataaattatatacatgcaattcgtaagtaaacgctgtaggactcggctgccttctatgttgtgattctgtaatttgctacattcctggatgggccatcaaaataatactgaaaacagcttctataacaaatagaagtgctgtttcaggtcatgcctaccaccactcctgggttccctaaggtactaattcatagctacctctttgtggtgcccttacaaagagtgatttaactgtttgtaaaggtgtctggacctttttgacattaaagagatttactgaattaaacttatgtttgcaaacagaatatttccaggggatgccttccagccccctaagaattaaccatcttagtttatcagtgtttaatcaggaccctactgattgactcttctggtttaaataaataatggggttgaaatctctaccagggctgtttcagtacttatttggaagaaggatgtgaaatacccaagctccacctaaaataggctttgcaagaataagtgatccaagagagaacctacagttgactttaaaacatcctgtaatcatgtcacacctgttaggatggtggttatcaaaaaaacaaacaaacaaacaaaaaaaggaaaatgatgggccagccatggtggctcacacctgtaatcccaatactttgggaggctgaggcaggaggatcagttgagactagcctgggcaacattgcaagacccatctctacaattttttaaattacccaggcatagtgccgtgtgcctgtagtcccggctactccagatgctgaagtgggaggatcacttgagcccaggagtttgaggctgcagtgagctatttcacaccactgcactgtagcctgggtgacagagcaagaccctttccctaaaagtatttttaaatgtaaaacaagtgttggtggagatgtggagaaatcagagccctcctgcattgctggtagggatgtaaaactgtggaaaacagtttggtggttactcaaaaagttcaacatagaattaccaaatgattgagcaattccacttctaggtctgtactcaaagtaattaaaagcagagactcagattcttgtatactcatgttcacagcagcattctgtttttttttttttttttttttttgagatgatgtcttgctctgtttcccaggctggagtgcagtggcacgatctcagctcgctgcaacttccgcctcctgggttcaagcaattctcctccttcagcctcccaagtagctgggactacaggcgtgcaccaccacacctggctaatttttgtatttttagtagagatggggtttcaccatgttggccaggctgttctcgaactcctgacctcaagtaatcctcttgccttggcctcccaaagtgctgggattacagatgtgagacaccatgcccaggcagaagatagattttttttaaatgtagcaatttctggaaatataccaaacttactgttttccctgtcttcactgacgacctcaggagagcaggagttgacacccatttgctttcctcaatctgctatctgcttctttttaccaaggaggaaacactcttaggccaactatggcctaagaatgaatggtgcctccctgcaaccagccatacaccctctctggctacaagtgccatccatgcctctggaacctggagcttctcctaagtagggtgagcaaagatgctggaactttccaagtctcaatctacatatacaatccacatatataaccctctcccagccttgctaggtagttaccagaaccccaaaaccacttgccaagccagtcagcatttaggtaagcaaaggagtccagtgaccctcaaatatcactgagatcttgtttgtctaggcatgaagtgccttgaataactctttcaagacattaagaactcccgctgttcaattgtacctgaagcagcaagtgcttctctttgcatttcctttaccctctgttctcagaaggtctcaaagatgctgaaactaattgctgtcattcctgaaagatttctgcttttaagtggtactgcggcttcccttgatgctaccagccgttttcattaaggatttcatgaagggttgatgggtgcattaggcttcacaaacaacggttcttttcatcctggaaaggccttgctaccttggtagtggatggacctctctgctgcgaacatctctgtttatggggctaaggttacagagatgacaaagaggtcacaagcggatggcgcaggatatgtgtcctgggaaagctctatcttgattttccctctttttggtcttgtgattgactgtgggtttatgttctgtagtaaacacaagagccttgattgcttactaaaggtcagacttgtcagcaaacctctccattaacttgagttgcgatcggtttcacatttcctggcaaatcgtttgagagctctgatgaatgcatcagtttccttcagtcttctgtcttcaaggcagaaacgctcaagaaatccccctctttgccagacaccaagtgtatcttgtttgcagctctgcctctagcatctacagggcttggcatacacgtgaaatgcatgttgagtgatgaacgggagcgcacaggactcttaagaaccgagaccgtccccacagccaacgtatgaagaaatcccatgttctgcttctagagccaactgcccttgtggtttcgagttgagttctggcagttcctgtctttgctctcttaatcattcttcatgggctcccactaatggctaatttgctcagcttgtcatttataaatacaaggacatgacacccactgccttagccagtgcttataaagtaacctgtaagtgctgcatgttatcatctcggcttttcaatttatgagtcaagtgaattctcggggctagaacatcacccctaaaagcgagtcagtgttggaagaagcagcaaaaatatacatgcactcttacttgcatagactatgaagactattgttactctcctgtactcagtcaagtagattatgctcctccatggtcaagtacccttgaggcgatttgcacagttttgcagcaacagcaggatagaggttgtgctggtaccagcaggaagcatagcctgagcccttcccttggatttcagttgctctatttctattcagttcagtccagaacttaggacaggttaagcatcagcgtccaatacagtttatattagtttgtcacaaaagggggattttttgaattaaatgttgataacccagcttcttaaatctttttatcagttttttcattcccataccctggcataatgacacaggtattacgtaaacaagacacctccgagggctgcttataaaaactcaagagaaaagataaatatgtgatgatgcactgatatcctgaaatatgagctgcaggtttgtattttctttgtgggatcggatattggttttcatggtttattgaccaggctgagagacatctgacaaaacacccaagaactttacaccttttttttttgttattattttttaaccttcctgtctacatggagaaatctacacattgaatcacagggcctggaagactggggcttagccagtcatgttcttagcttgggcagaacccaaatcagatccagctgttggaggtaaaaatacacgctgctttcccaaggaaaaagcaattggaattggtctcactgtagagttactctcgggcagaacttcgggataaggagcaactggagacggtcgactgtgaatgtgatgttcatgtgacattcatgttcattgaggaatgtgttctcattgagaccggatcagaactcatttgggttcagttaatgactctttcctttctgccgggtctttgtctgcaacattgggcacgcagtcagtacctcgttgtgtgggagcatcaccgacaggaatcctccagaatggtcatatattaaagacctctcgggctgggcatggtgattcatgcctgtaatcccagtactttggaaggccgaggcaggtgcatcacctgaggtcaggagttcaagaccagcctggccaacatggtgaaaccctgtctctactaaaaatacaaaaattagccgggcgtggtggcacacgcttgtaattccagctactcaggaggttgaagcagaggaattgcttgaacccaggaggtggagattgcagtgcgccgagatcacaccactgcattccagcctgggagagagagtgaaactccatcccccaccaccaaaaaaaaaagacatctaggcttagggcacggcaaacaaagaactcccctggcatggcaggaatcagggaatctcatgtaacattcattgtttctccggggagtcttttcatatttctcccgtcttctaggctcaatacctttcaggaagcttctaaaccaaaggttcatcaaatagaaataattttaaaaattatttcataataaactttaataattttttcataatcataaagtaattgttagatggtttccttgaggcatgagccatactcactgaaaaatgacaagttctgagcctttttaattgtgatcaaatatacatatcataaaatttaccattttaatcttttttttttttttggaaaatgaggtctcacttgcttgcccaggctggagcacagtggtatgatcatagctcactgcattgcaccctggacctcctgggctcaagcgatcatcccgcctcagcctcccgagtagctgggactacaggcgtgtgccaccatgcccagctgagtttttatttttttgttttttgtagagacaccatctccctatgttgtccagggtggtcaccaactcttgggctcaagctgtcctcccacctcagcctcccaaagcactgggattacaggcatagactaccatgcctggcccactgtaaccaattttaagtgtatatttcagtgacattcagtacattcacattgttgcaaaaccatcatcaccatctacctccagaagcttttttaccatcctaaactgaaacgctgtaccctaaacactccattacccactctttccagtccctggcagctaccattcgactttctgtctctacgaacttgacacttctagctgcctcgtctaagtggaaattctcaagctttttataatacttatgggaagtagtcaatctgactaccgtctaatgaaatttttacataaggaaaagatagttttgagcagatggtcagatttcctttggttttggcattgtacaagtatatggcagatgcctcattctcttatactttctggaacccgcagcataacagggatatgaatgaaacagatctgcaagtcacagtcagacatgtggccaactagaaggagcagtggtgagggcagttggtgtacaggtttattatacaatttatgaagcattttaatttttaagtttttttttttttctcacttgattctcaccatgtcttgcgaggtattctattagttccattttaatgataataaactgtggctcagagaagtaaatcgtctaaggttacaaagctagtcaatggtagaatcaggacgctggcttcacattttcatttttaaaaccccagtgctttccatcacagcccactgtgaacaattatcacgtctctggaggcccaggtaatagccagtcctcaggaagggagggcctctccaaatgcaaccctaattactagtgctccacctcaccagctcagaaatacatggaaaccgtttttttttttttttttttttttaattgagacagagtctctgtcaccaggctggagcacagtggtgcaatctctgctcactgcaacctccgcctcccgggttcaagtgattctcctgcctcagcctcctgagtacctgggattacaggtgcctgccaccacgcccggctaatttttgtatttttagtagagatggggtttcaccatcttggccaggctagtcttgaactcctgacctcgtgatccaccctcctcggcctcccaaagtgctgggattgcaggcgtgagccactgcgcccagcctaaattttctaatagccacattttaaaaagtgtgtagaaagaaacacataggctggctcatggtagcttacacctataatcccaaaactttgtgaggctgtggcgggaggatggcttgaggctaggaatttgaggccagcctgggcaacatagcaagataccatctctacagaaaaaatacaaaacttagctggacgtggtggtgcctgcctgtagtcccagtgactcaagaggctgaggtggaaggatcgcttgagcactgggggtcaaggctgcaatgagctacggtcatacctctgcactccagcctggatgacagagcgagaccctgtctctaaaaaaataagaaagaaaaggaaaaaaaaaggcaagtgaagttaattttaaaaatatattttagttaacccagtatacaaaaatatcatttcaatcaacataaaaattattaatgaactattttgcttttttttgtagtaagtcttccaaatctagtgtgcattttagacttaaacagcactcccaagtcagacgctaaattttcattggcagtacttgatctttatttagatttcataaaattcccagttgaaaaagtagattcacatacccaaagtgtttcaaacatatatgaaggttttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcatgagccaccgcgcccggccgaaggttttctaataactgaatcaagcaccagtcttaaatttaaatgaattaaaatgaaagaaaatttaaaattcaatccctctattccatgggccacacttcaaaggctcagtggccacacatagcaaatagctttggtcctgggcagaacagatctagatgaacagctgagggtggcccagactggacccagccgtggaatagaacaacggtctgcaaacttatttctataaagggccagataataaatattttcagccttgggggttacacagtctctcaaagtattcaactctgccattgtaaatgaaagcagccatagaatgaatgagcatcgctgtgttccaataaaactttatttacaaagcaggcatcagcctgcatgctttgccaaccattagactagaacatttgtcctagggccttagctgtgctgtgggattaccagaaaaagagacagctctcacctctagctttctgagatgaggttgtcaaaatctggactcactggatctcctttcctgtgtgtaattagaattttgacaccacttggcatgaagcaacggtgggccagagttctgcgtcatttatccttcaggtgctctctgcagtggatggtttgtgcctcctgaagcaattgcttccctgtgctttgaggtccagcagaggtaacagcggagaaagctggaagaaaggcttcaacaaaagcattaatggtgatgtgaagaatgcaggaaactcccaagaaagccaaatgatatcactctctgcttttccaacatagccagtgtgaggcaggaatcacacacgtttcacagctgggtaaatatgtgatttcacgtgaaatcagagggacaggtgtttctctgtgcttgttaggtgatatggcgtccgcccattttgatggtaaaggccaaagtaaatataaattctgtttcctgacctggggccttgaggtccccaggcggggattaccaccacccaatttgggaatctacgttgcaaagccatggttcccgctgttcacattgtgacgtttggaaatggtattgggactaatggagggaaagaaagaggacaggaagggagggcatagagattggttggtaggaagatgacccccactaggtgctttagggtagggggttatggaggctggctttgcagaaactctgggacgcagcagttggggaagggtgaagtgaaaatcagtgatagcttagagctctgctgaccctagaactttggatccagtatttcttcaggcatggatgatgttgaaggtattgttggcactcatttgataatcccttactgtactcagaagttttggcttggggttgcctttttaattcaaggttcaagattaaatgacttggctgggtgtggtggctcatgcctataatcccagcactttgggaggctgaggcgggaggatcacctgaggtcaggagttcgagatcagcctggccaacctggtgaaaccccgtttctactaaaaaaataacaaaacttagccaggcatggtggtgtgtgcctgtaatcccagctacttgggaggctgaggcaggagaattccttgaacctggggggcagaggttgcagtgagccaagattgcaccattgcactccacctgggcgacagagagcgagactccatctcaaaaaaaaaaaaaaagttaaatgactggatggtgccccatgtaagagtttgcaaaagttcaaactagtgaaactgctgagcttcttcagtacattatgcaactctgccttgcctccaattttgcagctctatcaagtgtacagcgtggtgtgtggggaaagatctgcatcccatgatgtttttgactatggaggtaattatttggagtagctgttctgatgataactcacggaggttcagtctgcagcatggaactgtctctagtcatgattgcctgtaatgatgattacccaaactctggaattataacaatagattttacaaagttagagcataattgctccaccattccttacatgtgcacagattaaacaactttgatctttcaatcagatttttgttactcatcttctgcaatagcaaaggtcagaggcagtagctttctgccacctccctcccctctttttaaatcatcacgaggcctagatttttaaagcatttaacttggtaaagaaataagggctgaagttgtgtggactagaatgagtacaggcctgtggggggtcagaatcccaattctgacatctagaaactctgtaacatacagtcttcaacctgtctgcaactcagcttcctcgtctgtcaatactcacttgtctgaatcattgagagattagaatgaacataggcggccgggtgtaatggctcatgcctgtaatcccagcactttgggaggccgaggcggatggatcatgaggtcaggagttcgagaccagcctggccaacatggcgaaaccccgtctctactaaaaatacaaaaattagctgggtgtggtggtgggcgcctgtaacctcagctactgaggaggctgagcagagaatttcttaaacccaggaggtggaggttgcagtgagctgatatctcgccactgcactccagcctgggagacagagcgagactccatctcaaaaacaaaaaaaaggaatataggctgggtgcagtggctcacgcctgtaatcccagcactttaggaggccaaagtgggagaattgcttaaggccaggagttggagactaacataatgagaccatgtctgtacaaaagtaaaaaaataaaaattaactgggtgtggtggcacacttctgtagtcccagctactcaaggggctgaggcaggaggattgcttgagcccaggaagtcgaggctgaggtgagccatgatcatgccactgaactctagcctgggtgacagagtaagaccctgctgcttttaattttttaaattatttattttatttacttagtttgtttttgtttttgtttttttgagacaaaggctccctctgtagcccaggctggagtgcagtggcgtgatgtcggctcactgcaacctccacttcctgggttcaagtgattctcctgtctctgcctcccgattagctgggattacaggcgtgcaccaccacatccggctaatttttgtatttttagtagagacggggttttgccatgttggccaggctggtcttgaacccctgacctcaggtgatccgcctgcctcggcctcccaaagtgctggaattacaggcatgagccgctgcgcccagccagaccctgtctcttttaaaagaaaggcaaaagaaatataaagcacttaatcagtgccttgcactaatgggcaatcaataaagtgatgctgtatcatcatcatcaattctacgatcaattctcaggctttggaggctttagaatctttctatgtctttggatgttgtggcctttattcaacatacaagtttgtttggagctggtggtcagggatatggtattttcactaagttagggatggagctttgtaagaaatcagtataaaggaggaaaaaagaaacaagcgtcctaaagacagaacatttacagctgagcaagtgctgatggctgccttcaccacgttctgctgcagcggttctcagcatttatgtgcatttctgaaagattcccactcttttctccccagagtctgaatggagaaggtctggaacaacctgagattcagcatttttaggagtgtctctggagattttgaaacacgtggttcaaggactctctgtctcttctccctcccccaaacgagaaactgctgcttgtgtctgagagtcaatacgagatttaaaaacagcaacaaaaccactgctcctggaatggcccagttcccatggccacgaccagcaaagtgggcctgatttccttaggaggggaagaagtgacggctgcagagcccttgaccatctcggtgtctgggctcgagtgtcccgccacccccagcgtctgcaggtcacccccacactgacgccgtctcagtgagctaatgccagtgtctgccccgcgccggctcattcagcagccactggaatgatcaatgaggccggccgcccagccctccaccggctgttggtgaatcagctgcctcggccattcccatctccactgagcaggaagcactcgagctgagcccagccagggctgactggcgtctggctaatggcttttctgtgtcatgcactgaccttgatcccatatgtttttcatacgtgagtgggttggagtgcctgaagatggtccagtggtggaaatagctcttctgccaagccccttaccgaggtcctgggcagtactttggtttagaggtgtctgcttctgaagcaggatcggtgcttttgtttaaattgaggtgaaattcacataacataaaatcaaccaggttaaagggaacaatcagtggcatctagtgcattctcaacgttgtgcaaaaccacctctatccaaaaacacttccatcgctccagaaggaacccctgcacctgttgcatgagttgactagggctgctgtaacaaagtgccacaaactgggtggcttcaacaacagaaatttggggccaggagcaagtggctcatgcctgtaatcccagcactttgggaggctgaggtgggtggatcatttgaggtcaggagttcaagaccagcctggccaacatggtgaaaccccgtctctactaaaaatataaaaattagtcgggtcgtagcggcgtgcgcctgtaatcccagctgcttgggaggctgaggcaggagaatcacttgagcctggtaggcggaggttgtggtgagccaagatcgcaccactgcactccagtctgggcgacagaatgataccctgtctcaaaacaaacaaacaaacagaaatttactgtctcacaattctggaggctagaagtttgaaatcaaagtgtcagcaggcttggttccttctggaggctgtggggtgagggaaggatccggttcggacctcaacccttggcttttttttttttttttttttttttgagatggggtctcgctctgtcatccagactagagagcagtggtgtgatctctgctcactgcaagctccgcctcctgggttcacgccattctcctgcctcagacttccaagtagctggaccacaggcacccgccaccacacctggctaatttttttgtattttcagtagaggtggggattcaccgtgatcgccaggatggtctctatctcctgaccttgtgatctgcccacctcagcctcccaaagtgctgggattgcaggcgtgagccactgtgcctgaccaacccttggctttatagatggccatttttctctccacatcatcttcctctatgcctgcctgtgtccctgtctaagtttccctttattataaggacaccaggcattttggataagggcctaccctaatgacctcattgtaacatgattacttctgtaaagaccctatctccaaataaggtcacattctgggttactaggggtcaggacttcacagtatgtattttgcggggacacaattcaacctttaacaacattaggcagtatcagtactttgttccattctatggctgaataatatcccattgcatgtaaacatttattttttgagccccaagtacaaagcaactgtcagtgaaatctccaccccctgggtagtgtgtgcccatctgtataaggtggcatattgatctcacaggtagagctcacaaatctgcaatgtgtaaactttttcttattgtcttcctccttgaaagagtgttagcctttacgagcaaaagtcaaagcagtactggactaagggaagagaagtcaagcttctgatcctaaaattaattttaaaaattgatttcaggctgggcactgtggctcatgcctgtaatcccagcactttgagaggctgaaatgggcaaattgcttgagcccaggagttcaagaccagcctgggcaacatggtgagaccctgtctctacaaaaaatacaaaaattagctgggcgtgctggtgcgcacctgtagtcccagctgctcaagaggctgaagtgggaggattgcttgagcctgggaggcggaggttgcaatgatctgagatcacaccactgtagtcccgcccgtgtgacagagtgagaccctgtctcaaacaaacaaaaaaaagaggatttcatctttaaattttatttttccttttcctggtcttatccccagtgctgcccacttcctgcaagcacaggtgcacacacacaggtacgtgcacacatacgctcacgttaaaagcgttttcatgtgaccgttctggagaggggcgtggcacagataggagacacagtccttcgagaagacccagacggcagcttgcttccattgtcatggttactgggctcggtccccagggctggctgcagaccagagcctttcagagcttcttcacactcccgtccctgctcctgcctcagaatgaaagagaaaccttcgggcacatgtgtcttctcagctgtgaaactaactgcactgttgacttgtgcatttcatctgcccccttaatttaaaatctatttctgtctcttatgcagacagacaggggacccgcatccctgcagattgttggggaataaccccgagtcctcattagtttgttgcagactcaggccccactcccccatcccagaggcgtcggtggtaatgacccagggtctgtctctaggaaggatggcagcagggtcgcatcgtcctgcgtcctgactctgagcagggttgtacctcatgcaaaagttgtttaatttcctccttcctctctccccctcccctctctcttttccatcaaattcgttttgccacttcgaaagtccactgggggaagaaatgcctgctggtcccagggttttcagagaggcaggaaggcagatggaacagctcatacatgaaaaaaggacagaaaatgttcatatagtatgttgctccacatgattattttagggtaagacaggtgacttttgggtccttggactggaaggctccacactcttcatggaattggatgaaaaggagttaaaagtactgtaggtggtcctcggagaggagcggccttcaggggctcagattatgagccttggctccactcatgggggagccggggcctctggagctttgaaaagctttcaggtgattctaatatccagccacctttgagaaccattgttctaggggacagaggcctccaggagagttgagcattttgagagagggaggatagaagaaatagatgatatctaatgctccctgttcagcaattttgctaattaggcagaaagcaggggcagaaatcacacaccctcggctgtcttgggccaaaccaagcaggactttagctccatttaaccctgtagaatgcaaagggagactccagtgtcccccttcccaaggtttggtcagctgccaaagcttacagactgccagccacccggccgagcatttgccaaggtgatgtaaaatattcacgggaacacgccgtctcgatgttctactcacaactggttctctccctagctcccgaggaaaagtaacatgaggcccatgtggctgccttctcttctcagcagaaggtgctgatgttattagtggcttgccaagctatggttggagggggatgtcaggggcacgctgtggggctgacctttctgtctctgactctgttttgtagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacaggtgagtcatggcagcctgcgttctgcacagaagccccctcccacctgaccccatggtgtgacagtggaggcagtgggtgtctgggatgaaaaggtcacttggaaagtaactacgtccaccgtctacgaccaccaatctcattgtttttgaaaacagaatctgcccgagcgaggtggctcatgcctgtaatcccaatgtttttaggaggccaaggtgggaggatggcttgaggccaggagtttgaggctacagtgagctatactcacagtactgcactccagcctggggtgacagagcaagaccctgactgtaaaaaatattactacataaaataaaataaacgaaatgaatctccccctccccaccttgcattctgcaaaatcgtcctcaactgcgtttccattaagaggagctttcggctcatctttcccacggctttgatgacgtgttacagcgaaatgtgatcttaagaattcaagagcctggaaggtggaggctgcagtgagccatgatcatgccactgctctccagcctggccaacagagtgaggcccttgaaaaaaagagaattaaaggactttgtctcatcccttggttcagtgttagctgtaggaaagagacggtgctgcctatatgctgtggacaagtaagtgctggaggtggcaatgcaccttttggtctcagtaagattttcatttactactggtgaccacttgggtgtccgaaaagggaatgacaaaacaaacagtcacctgtgaccaaagtggttaagatggcttccacttctcaagtggacccatccttcccaaggtggaggttgtcactctccttttggaagggaaacacatcaaggatgacaaaatagcactagtcaagcgtgccgtttctgctttgcaaaatatattctttaatctcttgcttttttctttttcttttcttttctttctttttttgttttttttaaagacagagtctcactctattgcccagacgggagtgtaatggcatgatctctgctcactgcaacctccgcctcctgggttcaagtgatactcctgcttcagcctcccgagtagctgggattacaggtatctaccaccactcctggctaatttttgtatttttagtagagacgggattccaccatgttggccaggctgatcttgaactcctgacctcaagtgatctgcctgcttcagcctctcaaagtgctgggattacgggcatgagccaccacacccggcctttcttgctattttcttactatgaatggcgtaatggattattagggcttgtctgatcttctccccatcctatactcctatccagcccatttcttcctttcagttcctttctgaaaccttcggaatatttgtggttagatgccatatgaaatatatcttattggcaaagtgtggtggctcacacctataatcccagcactttgggaggctgaaggtggtagatcactttaggtcaggagttcaaaaccagcctgggtaacatggcgaaaccccatctctactaaaaatgcaaaaattagctgggcatggtggtgcgcacctacagccccagctacttggaaggctgaggtgggaggatcgcttgagcctgggaggttgagggctgcagtgagctgagatcatgccactgtactccagcttgggtgacacagtgagaccttgtctcaaaaaaaaagaaaagaaaagaaaagaaaagaataaagaaaaaaaagaaatatattttattgaaattaactgtccattccagcaaacaagtcttacgtcagccatttcatgaatacttttacccctacctgtggcctctccgattggcccatatgtgattatccagaaagtatttccaacaccctagctgggcagtgccccagtttattcactgacaccagtgactgtccattctcagggcctcggacgtggttagacatctctgagaggaaccatatttagattcccattctcgccttgaccccactccccagcagcttgaattggactattccttcttgatgggagactttgcttcctgtcactagggtggatggaattctcccagacccgtgtcctgacagtgaagggcatgagctgattaaactgatgttttaatttgcccagagatgcagtaccagggaattcctgagtcatgatgaaatgcaaatgagattgatcccattcatctattagtagctgtgaattcccaggctttggaaccagttcagtgtccagccagctgttgatttgcaggggcagctgagctctgggtctgtcctgagcatggcttttttacagagacaggtttctcaacatgctgctttggcattcttagcgtggagggtgtaaatcaaatactgagcaagtttctcctcggggatcacctctgcagggcaaagagaagtgaggaagatgccagaaaatagaaacctatggaaaattccatttcttggcatacaattgcattctctcaagttattacctggagaatgttccttatatatgaaaatcaggaagaattttaggaactttgtaagttttgctgaaacacaataagaggcatccagctctccctgtcatgtctgttttgtcatatcatatttatatcatatttatttaaaagaagagtaataaacattagtaagagggaaatttgttataaatagatgtggacttccagtaatagtaaggaaaaagattaatggggaccctccaccacttcccatgacaaacacaggatgaaatataactatgtaaagaagctgagctcaaaacaaagaaagggaaatcctccgaggctagaaataaacaggcaaactgaaaccagagtggaaagcagacccgttaatgctaaggaagggcatcggggggacatcagaacagagtgtgggttctgacatctagggactgggcatgtcatgcccatggggaacaggaattagggcctcaggcccacataaatggaaagttggaactgagaataggatataaaaataatttttgacaatcaaggtctgagagagtttactaactctgagactcatattgaaagaactactaaaggatgtgctgtaagaaagaggaaactgagcccaggaaggagagggagttctagaagtaataataatgaagaaattgataaacaactaggtaaatctttgaatggatgtaggatgttttaaaaacagtaataataagacaacaatcaataacacagaagatgggagggtaataattacagtaaaaagcactttaaggtgctaatattgtttaggaattagaaaaaaatattgattaattttagattttctgtttttctttttttgagacagccagctccgtcacccaggctggagtgcagtggtgcaatctcgtgccttagcctcccgagtagctgggactacaagtgtgcaccaccacaatgcccgactaatttttgtatttttagtagagacagagtttcaccatgttggccaggctggtcttgaactcctgacctcaaatgatccaccagcctcggcctcccaaagtgccgggattacaggcatgagccaccgtgcccagcctaattttagattttctaagacaagtatgcatattcaaaatataaaggtaatctctgaagaggtggtaaaacaatccataacctccaagagaaaacttgatcaatccacagagggcctgggaacacaaaagagaagcctacaaaaagcatgataaatagaaaacacaaatttggatggtaaaataaaatgaaatgtcagatactcacttttctagccaccctcgcagctagagatggccatgtggacctagttctggccaatgagacatgagatttttcctccttgataaaaagagggacgttcaaggagctatctatgctattcaaagagaatctgttctgatgtctccccacttcatgatttgtgtgtaagaaagtggggaggatgggggctgactgctggaaggaacactaatagtgcctaccaagtgaaccttgataacaacactggataataaccataccaaaaagacacttataggccaatctcagttgagaacatagacatgaaaatactatataaaacattagcgaataaaatacctcagagaaaaatgtatcatgacctaatcagatttacccctgaaattgatgaaattaacatttaataaatctgtgtacttattcagagtaaagtcaggaacacattaaggatgcttgttattaccatgtctatccaacattatgtaaaggcctagccaatgcaataaaacaagagagaaataaagaggaaaggaagaaacaaaatgatcatttgcagataatatgattgtctgatagaaatttcagacatttctacagctgttaacatcaatatgagaattcagcaagattgttgggtacaatccatatagaaaaatccacagcattattatacagcaggaaaaataatagcgaaaatataatttaaaaaattttttgtttataatagaaaaagaaacaaagttacccagtaatcagtctataagatatacaaaatcattttggagaaaaacataaaacatttgtggaagacgttttaaaagccctagacaaatagtgaaacataccatattcatggacgggaaatgttacaaagttggcatcaaatctcaaatcaatctataaatttaataaaaatctaacttaaaatgccaacatgttgttttttaaaaaatagaactggtgctgggtgcagtggctcacctctataatcctagttctttgggaggtcgaggtgggcgatcatgaggtcaggagattgagaccatcctggctaatatggtggaaccccgtctctactaaaaatacaaaaaaattagccaggcatggtggcgggtgcctgtaatcccagctactctggaggctgaggcaggagaatcacttgaacccgctaggtggtggttgcagtgacccaagatcgcgccagtgcactccagcctgggcgactgagcgagactccatctcaaaaagaaaaaaaaaaaagaactggaggagatatttgtaaaattcatatgaacaatttggaaagttgaaggaggggcttgacctactagatatcattataaagctaattcagtaattacataagtaattaaggcagtggggtactagagcagagttaaactcatggaacaaagtagcccccagacagatccaagccattattagtgctttgtatttaatagagctggcataagaaattattgaggggaagatgaactcttcggtatatgatgttgagatgactgggcttctaattggaagaatgactagagccctccttcacactacacacacaaataaactccatggctgggcgtggtggctcatgcctgtaatcccaacaatttgagaggccaaggagggaggatcgattgagcctaggagttcaagaccagactgggcaacctgacgaaaccgcatctccacaaaaaatacaaaaattagccaggtgtggtggcacacagctgtggtcccagctgttcaggaggctgaagtgggaggattgtttgagccctagaggtggaggttgcaatgagccaagatcgtgccactgcactccagcctgggcaacagagcaagaccctgtctctaaataaataaataaatagatagataaattccagattgattaaaaacctaaatgtgaaaaaatcagaagaaaatatatgtaaatagctatattatttggagagtagactagaactaattaaataaaaaataaataaatggaatcattaatattacaacactaaaatgaagagcctttgcatagcaaaagacacacacataaaaagtaaaaaacaaaaacaaaaaaaacctttgcatagtgaaagacaccaaaattaaaagaaccatccctgcctggaggtaagtatttcaaaatgcacatatagaccaagaccaaggactagtatttaatttaaaaaaaaaagaaaaactcttatagatcctttttttttaatttgaaaaaaaagacaataatccaatcaaaagatgggcaaaggattgaacatgcaattcagaaaagaggaaatgagaatggctaatataaacatgaaaaaaattcccaccttattggaaaacacaaaataaaaaagcaatagcatcctcttttacacacatcagatagacaaaaattttaaaaatctgataatgccaggtgttcacaaagatatgtgaaaataactcacttccaatgctagtaagagatataaactgataccacctctttagagagcaatggacagcaactggaaaagttgaaaacatatatacattccacttaacaattatatttctaggtagagccctagaaaaattcttgcactgtacacaaggagacatttaccaggagattagtcctaatgctgtatgcaatagaaaagaaatggaagcgattcaagtatctgtgaatgggaatacattatggcacattcacgtaatggaaaattccacagcagttcaacttaatgaactagacatactttgataaatttcaaatgcacatcgtaacgtgcaatatatcagctgcaaaaaacaaaaacaagtcccggcacgatggctcacgcctgtaatcccagcactttgggaggccgaggcgggtggatcacgaggtcaggagatcgagaccatcctggctaacacggtgaaaccccgtctctactaaaaatattaaaaattggccgggcgtggtggcgggcacctggagtcccagctactcgggaggctgaggcaggagaatggcgtgaacccgggaggtggaggttgccgtgagccgagatcgcgccactgcactcgagcctgggtgacagaacgagacgccgtctcaaacaaacaaacaaacaaatgtatatatacacatatagtatgatgccatttatatctactattaagatatacaatatgcataatattactacatttatatatattgtttacagacaaccgcatatgtaataaaagcaccaaaacatggagaaaccaccctcaggttgtggttacctttgaggagggagaggaatgagttggcatgagaggaaactttacctgtatctactacattttattttattttattttattttattttattttattttatttattttttcgagatggagtcttgctctgtcacccaggctggagtgcagtggcatgatcttggctcattgcaatctctgccttccgggctcaagagatactcgtgcctcagcctcctgagtagctgggattacaggcacatgctcccacgcctggctaatttgtgtatgttttagtagagacggtgtttcaccatgttgggcaggctggtttctaactccttacctcaaatgatcctcccaccttggcctcccaaagtgctgggattacaggtgtgagccatcgcacctggcctattcctttttttaaaagaagaaagttcatcacaaatatggggaaatgttagtttgttaaatctgaatggtaatgttaaaattcagaagtgtacaccaacaatggtctattttactgtaatttaaaaataaaatcgaaaatataaattctgggtggcagatacatgcatgtctgttacctttctctcgattttttatatattttttatgtaagtgaaattctccacaattaaacataatattttaaaagtaaattaggtggagaaatgaaacctggttactgtcaaaactggatggattagtgactgattgaataacaaaaggtacagatgatggatagtggcaaccaagagagaaaattctatgtgtaacttaaaaataatgtgatttagtaatgtgactcagaagtctgaatttggtcctattggattttttaagccaacatctggctaaatatctagaagatatcctttccatacccttgagaaacccacagccaggaaggatgataactctaaaagactgagtgagggctggacgcaatggctcacacctgtaattcgagcactttgggaggctgaggcagatggatcacttgaggtcaggagttcgagaccagcctggccaacatggtgaaaccctgcctgctaaaaatgcaaaaattcgccaggagcggtgtcagacgcctgtaatcccagctactcgggaggctgagccgtgaaaatcacttgagcctgggaggcagatgttgcagagagccaagactgcaccactgcactccagcccgggtgacggagtcagactccatctcaaaaaataataataaaaataaaaataaataaaataaaagactgagtgaggatccagaaaaacttcagtagtttggaattacaggccattttctatcaagatgaaattaaataggggcaagtatatggtcttatctttggatcccaaaatacaaattatataagtatgggatgaaacactgataactttgcaatggcctgtttgaaagaaatacagtgggtttagttgacaattcaatatgaagcaattatacatacacacacacacacacacacacaataatttagtgtgtgtgtaatagattatacagctgcaaaaattattcttcaactgaatcaataaaagtaacgtaaaatatctaaaaccatgtacttgataatcttgcccaattttccactagtcagaacatacttggaatatttttatctgttcctaaatggcacactttaaaatggatatagacaaactatatctagaaactcaagtgatagaaagaatgactgaagaaaccaaggatatttaacccggaaaagctagacttgagtgtatcatggtgccattagatggagaagactcagaactgtgtatgccacaagacctcacttagcaggaccaatgggaccaagaccagtgggtaggaatgccaggagaaagacttcggctcaggttaaggaagaaatttccaagcacacaaaccatctcagaatgccttatagtggattttgctattgctggaggtgtttcagcaagagtgagaccctgttcatcagggtgtcctgaagcagattcaaatatctaataggcggttgaacatattgggtggctggttaagttggacagcctggaagatccttttcaaccctaactttctacactcaaactatctatcagtcattgattgtcctgattctcctccagcatacatatgtaaccaatgaggcacaagaaaagaagtatttttagttatgcttgcaccattctaaaccaggtccaccatttcataattttaaaaagttcttgggcgtatttggtagagtatggatgcatattttggaaccagggagattatgagttagcaagagagaaagaaaaaaattgacagaatatgaattaattagataaatccccatcatcataaaagaaaaccaaatccattgtttaatcatcacaacgtagagccacctcaaggtgactcaagtcctccatgcataagtcatgtgactgccttgtgggttgggctgcttcagagtcataattcattaaacgagtatttgctgaaatgtacgacgtacaacacattgtgcaggcattggagagaatcccttaagaaataagccatggtcatggttcttgcctcctgatcaaggtagggtccaaggcattttcataagtccacagggcagtgggtcctgattgttggaccggccgtaactaagatgttcccagtgcccatttaataatgtacacagacaattatcattgacctatggacctgaacgcatgagccggcatagtgagtggattctcttccttacatcaatctgtatgggaagtcaaaccacattcagaaactgccttattgattacctaaagtaattattagaggcactggaaatattcaaagcctgtgtaatcacagcctactctccagttaatgtggaaatgagaaagttgctcaaaggggagttagagtccacaataattattatcactaagcaaagatagtgtaaacatccatctatcgaccactggtgtgctttggctggtggttatgttgtctgtgggggatgagtggcagacaggccaaaaaggaggcgtgaggctttagcagttaaggtccacagttgccagcaagagaaactgagtctcttgagcagaaaggacatttcatggaaagatgttaggagccctcaggatcatctggaggcttaagagtgggcagaaatcaacagccccatgatgacagccatctttaagtagagccagatggcgtcattctgccctcatcaccccctacctctgctgcctgcagccatcagcaccgcagctgccctgagtagatctgaattgtcctgtttttctttccaccacttgttccaaaatcccaaacacaagtgtcccattgggttcccagaccaagccctgggctaccagtgaatgggagaaaggaactgctaaaccgttttccaaagtggctgcactgttttatattcccaccaggaatgcaatagggctccaatttctccacataatcactgacgcttgctattgttgtctttttgatgatagccatcctagtgggtgtgaagtggtatctcgctgtagttttcatttgcttttctctagtgactaatgttgaccgtctcttcatgtgttcattggccatttgtatatcttctttggagaaatgtctattcctttgccaattttttaattgggtccaatgtccgttgaaaatgccatttatccttttaatacatgcctctcatttcccagagattgtggggttgcttcatcttctggccccctcctacagcatctgacatactgttgatatatagtacattatgatggttgcctaatatatttggtatatgagtactaatgcattagtacatttacattagtactaatacaataatacattgggtaattaagagggaatctcgctctgtcacccaggcaggagtgcggtgctgtaatcttggctcactgcaacctccgcctcccaggttcaagcgattctcccgcctcagcctcctgagtagctgggattatagacacctgctaccacgccgggctaatttttgtgtttttagtagagacggggttttgccatgttggccaggctggtctcgaactcctgacctcaggtgatccgcccaccttggcctcccaaagtgctgggattacaggcatgagccaccacacccggcgtgtgcttgggcttttgatccagttcagttaaccaagtaagtagtatgccttgacacgtcttcaaaaatcctggttacaactggcatccaaggaatgggggcatgatactaatcaaattctagaatagtgattctaaataaaacctgtcacccagaaacatatgaaggtggacttttcttttgtcaccttttcttttcacttcgtcgctagcatctctcggatcccttcccactgaagcccaggaggggagggaatgggggtgggggtggaggggcactggagaaaagatggaggctatttttaggcttgtttttcaaccatgaagtgtcatgttcttcaccaccctggctgctggattaattaggctgtgctggcagctgccagtcagggagggttgccagcttctaacggtgattccgcctaatgcctgaattgattttcagggagagaacatttttcccgctacatggcccttgccttccacggcaatgtctcctggcctctgatggctttgggtaggagaggataaagctttcataagtcatgaactcttttttaactgatgggcttgcaaagctaccagctggtccttttacctaacagcttgttgatagaaccttgtggtcatggcttgggtctctctttcccatttctgcttcctgttctcccagatcttccccaaaataagctcagtgcccagaacttgtgtggctttgggatattccactgcccgggcaacaggcaatagagacagcatcagagacatagactctgaccaaatagctcattttcatgctatttttccaagaatctctatggtgattgttaacttctagatatacaaagacaatatttagtcattaaaaaaatacttattgaggccgggtgtggtggttcacgcctgtaatcccagcactttgggaggctgaggcaggaggatcccttgaggccaggagttcgagacaagcctgggcaacatagtgggactctgtctctacaaaaactttaagatataggcaggcgtggtagcacactcttgtagtcctagctactcaggaggctgaggcaggaggactgcttgagcccaagggttcagggttgcagtgagctatgatggcaccgctgcactccagcctgggtgacaaagtgagaccctgcttctaaaatatgggtctcccagcactttgggaggccaagcaggcagatcacttgaggtcaggcgtttgagaccagcctggccaacaaggtgaaaccctagctctactaaaaatacaaaaattaaccaggtgtggtggcatgcctgtagtcccagctactctggaggctgaggcatgagaattgcttgaacccaggaggtggaggttgcagcgagctgagattgcatcactgcattccagcctgggtgacagagcaagactctgtctcaaaataaataacataaaatatgggtctctctatccatttattcatttatttttatttttttaccaaaatatataagctgctgcccatgctatgtttgaaagatggctccttatctagtaatagctggtcaagttacttgactatgtgaatattagactgtatacatagtctatacatatatatatacacacacatacacagacggagagacagaaacacctgctgggcatcacacaccgttctaggtgctggggttgcaatagtgaacagagcaaacatccctgccctggtgggacttgcattccactcgggagtgacagtgcacaatagccataataaagaacagtatattggccaggtgcggtggctcacccctataatcccagcactttgggagcccgaggtgggtggatcaagaccatcctggctaacatgatgaaacgccatctctaggaaaaatacaaaaaattaaccgggagtggtgtcccgcgcctgtagtcccagctactcgggaggctgaggcaggagaatcacttgaacctgggaggtggaggtcatgccactgcactccagcctgggtgacaaagtgagactccatctcaaaaacaaaaacaaaaacaaaaacaaaaacaaaacagtatatcgtctagaatatatacttttatatagtctgtatacttatgtatattacatattatttatatagggagactatatatgtatatatatatatatatatatttagaaggtgataagtgttatggaaaataatagagcacatggggtgcttccttccaacctttcagtccatgctatcctattctgtccccatctgagtacttaaggacttgtgagggactctcatgctaccgggcccctcttccctgtgctcctgtaggaactcatagaaacagaatgtttaggcctggttgggatctcagaggttttccaggaggctttccacctgggttctgcctcactgctgatggatgatggtgtgtcctgtgtcgccttgccaggggcttctcagcacactgtccacataaccctgatgctgtccaagctgagccttccaggaacctgcaggaggcaggctccttttcccagaatcctgacacaaactgtcttgttaagcagggaggtcgggggtggggcccgtgagtccaagttcaaggaacttggtttctggccagtccctgccggggaggccccggcagccttgcctcccacagctgataactctggtcccgaaactgctcacttccctactgccatataaacaattacattaagagcacaagtaaaagaccagccagaacaatcacttagaagagtaactaaatgaatcagagcagctggagaagatattttaagaccccagaaatcactgcacatagaactggatgggggcaattgattatgaatcaaacagatgtcaattgccagttttagtacaagaaggaaacaaaaggtcagtatattcctcctggactatcttgtgagaaatgaggatatgaaggtagcagagttctatttaaaatgagctgcagtcatttcagcataatctcagtgcagaacatggcaggttttaggtacgctgttgagaagaaaattccaggactgtcttttctgctgggaatgttcaagttctggtaaaggccaggtgcactggctcatgcctgtaatcccagcatttcaggaggccgagatgggaggattgcttgagcccaggagtttgattccagtctgggcaacatagtgagaccccatctctaccagaaaatttaaaaattagctgggtgtggtggtgcatgcctttagtcgcaactaccagggaggccaaggcaggaggatcacttaagcccaggaagtcaaggctgcagtgagatacgatcatgccactgtactccagcctgggcaacagagcgagaccctgtctcaaaagagaaaaagaacaaaataaaatttctagttaagaccaccgtaattctgacccctgttgagaaaatgaaattagactctatttagacacgtttggcctaatgatgttcaaaacctcctggagccaaagcccaagtgagcatacattgcaatgtgagatcaggtaccagggggagttttgaattttgtgatcatagggatcgtaaagtaccagaagcttctaatggagggatgatttaggttctgctccagaagctctttatgaagtaggtaaacacccataacctgagaccagttcagattatgcctgcccctgaaccttcttattaaatcagttgtgatttcgggaaccttggggaatttatgacatgagagatgatctgccagggttcaaaaccttgttgctgctgatgctttgggctggatctttatttgctgtggtggtggggggcggctatcctgtgcatcataggaggctgagccgcaccctgggcctctctctgctcagtagatgccagtagcactgcccaccccacctcgcctctgttgagacaaccgaaaatgtccagacattgccaggtgtctcctgcaggaggcaaaatctccctctagtgagaactcctgttctagggtgaccaaccatcccagtttgcctggaactgagggattttctggcaggtgggactttcagtgttaaaaccagggaagtcccaggcaaaccagatgagttgtccacttggctgtgtcattgatatgttctattttataccaacgtttaaaagtaagaacccgggctggccatggtagctcatgcctgtaatcccaacactttgggaggccaaggcgggtggatcacttgaggtcaagagttcgagaccagcctggccaacatggtgaaactttgtctctactaaaaatacaaaaataagcctggcgtggtggcatgcacctgtaatcccagctacatggtaggctgaggctggagaatcgcttggacctgggagatggaggttgcagtgagccgagattgtgccactgccctccagcctgggcgacagagcaagcctctgtctcaaataaataaataaagtgagtaagaaaccaaagcttttgaaaagtctgtctttgggaggcattgacaaggcatctgggggaatatgatgctgcttgtggtatcattttgcccctctttttcctcaatgtctctaaagcctgagccctggtgagatgggccattggaggtttgatcctagcccatagaccaaggagactcgattcaaacttgctgcctttctaatagagaggctcttgtttgacacttagagtgagcatgagtgacagactttttcttggaattgtaggctgtgtgacagtatacatcatgaaagtgacagcaacagtggggactaatttaattccattttcctttgcaggccctgataaatcattgctgcagggaaaaataaattttactttctcagacaaatgattggaataatgatgtgctgtgaggaaatcgggggctgagagaagatctgttggtgggcttaaaagtatttaaatagcgcatcatggaacttgttgcaaatacctctcgcgtctggcctggaaaataccagaaggaacctcctttccagactgattagaagagttcaggccgggcgcggtggttcatgccagtaatcccagcactttaggaggccgaggcgggcggatcacctgaggtcaggagttcaagaccagcctggtcaacatggcgaaaccctgtctctatagcttgaacccaggagacggaggttgcagtgagccaagattgcgccactgcactctcgtgtggggatagagcgagacgtctcccaaaaaaggaagaagagttccataaaatatcagctatcttgactaaatgatcgtggttttttaggccatctcaatggaaaaggtcattgattatcgtgctgcatatcctatataagttggtggctgaaacagctaaaatagattctagaatctggggtcctgagggaccatttacaaatagaaaaagtctcgacttggatggaaaattgccaataattttcacctcccttccagaaaatgactgtggctcaggagtatagttctgctgggaggcttttaaattgctataggaaatgaattacggggcgaggaggtacttgggccccggactactactatgcatgaggattggagtgaatttgaggaggggtgcaatgtagatggaacccctgcccacaagaggacagtggagaaggggctttaataccgtagggagacatatgcgctttgtctaagctaaacaatgcctggcttacgtgagggagattctccaaccctgagtcagtccattaaaagcacaagaaaatcacctgcctgcaaccagaatccacatcttcccacactaccattggcatattgcgctagggtgtgggggcaaacaggaaggaaccaggggaagttttgctcatgaccatttcctgcacgcgagccagtgtaattttcccactgtcagcgtcacctgagttgcactccaacttcggtgatggatggaatacatcatcagcgaaagctataaaaaccccatccttttgagcagcgtgaacgtaagggaaatgagcagttactgcagagaggattttataggagtgaaaaattctgcatcagagcagcaagaaggattgttatgtgaatgatcaaactgcttctgctgactcctcagagcccgcctaagagcaggggccttcatctgacactcactccacttccggggaactttgctttcctatttgttttaaccctgattaacagcgcagagctatgggttaggtccggccagccactgagagtccatctttgtgttttcaaaagccaggcctggttactgtcagaaataagagaaacaactggaaaagacaggcaaggtacgcagtattttacgggctctgattgtcatttagatttcgcatccaagaggggtttgagacttggggttctgttagctccatgtcccttccagcctcctggttctatcagcttggaattcaaaaccgcttcttgatgtttcttatttccaacatgtagctaagttgctgagagtatacgtcgtcttcctggatccgatcgactgctaggcatgagtggcccagacacttagctataggccccagagtagaaaagtagcaaatggtagcctctggaaggacagaaacacttggttatcgggctggaataaaaatgaaatcatgggccgggcgcagtcgctcacacctgtaatcccagcacttttggaggccgaggcgggtggatcatgaggtcaggagatcgagaccatcctggctaatacggtgaaaccccgtctctactaaaaatacaaaaaattagccgggcgtggtggctggcgcctgtagtcccagctactcaggaggctgaggcaggagaatggcgtgaacctgggaggcggagcttgcagtgagccgagactgcaccagtgcactccagcctgggtgacagagcgagactccgtgtcaaaacaaaacaaaacaaaacaaacaaaaaagtgaaatcatgcagatgtatcttaaggaatagaaatattacatatttcaatataatatttaaggaattagctggggctgcactgttctctaagttttgcctctgaagaaaaacaaaacattgctttctggtttgcaaaagaccctgggacctgtgccttttgagaatttgttttctgcaaatgactgctccagaggaacagctgtgtcattttattggctttctaataactttccgaaacaaattgctgcaaattaggtggattaaaacaacacagatttatcctctagcagttctgggggccggaaacccaaaatcaaagtgttgttttcttctggggaaactgagagagaatctgtcccgggcctctgtcccagcttcttgtgttctttggcttgcagcaacatcatttccatgtctgcctctgtccttgcatggctgtcccctcggtgtgtctctgagtctcaaatctctttctcctttctcttataaggataccagtcattggagttagggcttaccctaaatccaggatgatttcatcttgtgatctttaaattaattacatctgcgaagagcctattttcaaatcaggtcatattcacagttactggagattaagatgtggatccatcttttggggcagacacaattcaacccactacaactgtattttgttgctcttcctatctctaagttgctgctctctgttggttttgtccattttcaaaatgtcacttgtatgagttgcttaggctgacatctatctctaagattagcttcctctccctgccagtgtttgggcttaaacattccgtgataccactcctaggaggcaaaggtcaggctggccaaccctccaaacatggaacccttcaggccctgaattctcatgtctttgcaaatccaaagaggacaggctgacagtctgatggagtcccccaccaggctgtagccttctgtctttacacattttgagagcacttgaatatgcacgggaaaaagttaactatgacaaagaccgaagagatggggaaagggcagctgtggagaaaagagatgccccagaatccccctgatttctccagcattttatccagaaagatgtggtagtgtggtgagactctgaacagactccaattgtcttttttctttctttcctcttagcaaactgcctagttgggctagagctgttgtccccaaaatattttatgtgacagagaaggcttggaactattatccctacacaattacaggtaagtccttagtacaaccatatggcacatgtagtgagtgcaaggacatagcatagttgaatttcactgatttacagtggattatccaagcagggccttgtgggagccccgtagtatccctctttttttttttggtttcttacttgtaggttatcaacacttctaacacagacacagagatggcaggtgacaggggggttaagctaagccattccatcttcgttcttagagttacaataaatagtttacggagggccaggcgcagtggctcactcctgtaatcccagcactttgggaggccgaggcaggtggattacgtgaggtcaggagttcgagaccagcctgcccaacatggtgaaaccccgtctctactaaaaatacaaaaccaggaggtggaggttgcagtgagccaagattgtgccactgcacgccagcctgggcaacacagcgagactccgtcaaaaaaaaaaaaaaaaaaagcttatggagaaggaaggtgaagatctttatagagacatttccagaggttttatgattcttatttccctgtttcctcaataattcccaagtaatttaggggtataatttgtctgtaaacaagttgcttattatgacttgtttgtttttaccactccaaattttgactatactttgtataaaagattctattggatctctctttgcccccagatgacttcctttgctattagataatatgaaaatatttaaggtcagtctccctctcacttgcaatgcgatgacaataaactctttgtactgaatactgtcctagaaactttggccaaaaaaactcagaaggtttggttcctgccctcaaacacaccaaaatttgaaatcccacctcaacgtcatcaataacaagctcttcttattggttacaaaagctgcttttccacttaaaagatttcctttgtggttaatgaaatactctactggaattattagtctttcatttgcttttataatgccaactctttggtttttaattagccacaagcctataggctaattgaatcttgtcttactgttcttatctgcccaaccacataagtatcatgaaagaatttcagtgcaacacggagacattcagtatttatgaaagtttcattaggacatcttttgtaattatagttcgtcagtatttgttagttctgtggtttttatattgcatataagcatgatctaaatcatcttttgtctcttttttctttcctctcttcttcaaatgaacatgtggaaacagaatacacagtaagttccatttaattatttttaaacattctgtctatgatcagtggagtaattggaatgtctcttgtattacttgtcttatcaatgtaataattaaaaaggggaataattccaagtcagaaatatttaaatgtaggctattgcatcgttatatataatgcaataatttgaatgttctcatttgttcaagaatgtgaatcctaattgaaatcgccttgatagtcactttacgtaatcagcctttgcttgtaatttttaaatagcttgactgctttgttggtgatagttcactataataaaagaacagtttctagcaacgtgatattaaagagatgatggtagttatcgatggaaggtggggcttttactcatggactgtgtcctgattccttgttggagaagcttgaaagtgaagaggcacatgtgcaaactattttgcacaacagagatctgggttgggcagtcgctgtggcttgataaaatttcttcttctcctaagagcctctagggttattacttagactgaaagaaaaaaagacagaacctataatatcattgtgttgtggtattttcatttagatcattttcccaagcagctaacaggtcaacctatcacaacaagaaaatagtttatgatttttttttttttttttttttgagatggagtctcgctccatcacccaggttggagtgcagtggcacaatcttggctcaacagaaactttcacctaccgggttcaagcaattctcctgcctcagcctcccaagtagctgggattacaggtgtgcaccaccacgcccggctaatttttttatttttggtagagatggggtttcaccatgttggccaggctggtctcgaactcctgaccttaggcgatccgcccaccttggcttcccaaagtgttgggattacaggtgtgagccaccacacctggctaatagttatgattttctgagctgtgttaagagttgagtttttgggttcaatccaaatagccaaaggatagagaggtggtgagagaaatggaagaaaatgatttgtcatgccctgggcaggagcatagtacccaacgcatcgtaggtgctcaatcaatagttattgaatgacagaatgaacacacaaattctagatagataaatggtcccagcacaggctttggcgtcagaaaggcttggctgtcctctggttttgccactcactgccagaattcctaagcgactggctcccaactgccagttcttgaattcacactggtcctcgactatgttctcaccagtcctctgcagaatgaagaaaaaacaggaatagtattcagagattttcataacattaaatttatttcatccaaagtactgttggtaattatatcccatcatactcggatattaaaatatcttttcttttttgaaatgataggaatatatatagtatttccccccgcaatgtccctaactttgaaaaaagaggcaattttatggcaaaatgcaaatgtaaaattttagaagcaggggaacctttgctctagaatgaacatcttaacttttctgaacctgtttcctcttttctgaaattagaataatccctccttcctagagatgttagcggaaggattcagtggtctacccttggattggaaaacattgtctttagagggtcatattgtaaatgttttctgttttgtgagtcatatagtctctgacactgcaagagcagccttagatagtatgtaaacaaattagcatggtcatatatgcccaggcagcgggtcaaatttgtcccccaggctactttgccaacgctaaatataaagctgttagcacactgcctgtatacagcaggtaattaaatgattccctaccaccaacactaccccctagttccattgcttctggcaactgcataatcatcaagaggtagactttgggccgggtgcagtggctcacacctgtaatcccagcactttgggaggccgaggcaggtggatcacttgaagtcaggagttccagaccagcctggccaacatggtgaaaccctgtctctactaaaaatacaaaaaaaaaaaaaaaaaaaaaggtagttgggtgtggtggcgggcgcctataatcccagctacttgggaggctgagacaggagaatcatttgaacccaggaggcagaggttgcagtgagctgagatcacaccactgcactccagcctgggcaacagagtgagagtccatctcaaaaataaaaaattaaaaaattaagtcaacggtcatttattaggcatcagtgaggtacaaaacatcatgctagatggcataactgagcaattatctctgtcatttggggtcacaatctggttggaaatagctggacattccagtcaaagcctggcagtcatcagcaagtgctgggcttttctggaggcaagaggggacttagccaaggaaacaagctggcctcagacctgtccactgggctggataagctctgaactgagctgccagcagagattcagacctcagcagagggcagaatcaatgactctggggaatccaaccagataaagcagttgcaatgtgaaaagaagggtgctggcctctgcattggggccttgagttttggggacagggctacagtccccaatgtgggagacaggaagaaaagtacacagcactcaaggaggttactcagtatcatggtgctggggagataaggttgtcaaccttagtaagtgaaaatacagaatgtccaggtaactttgaattttcagataaacagtaaataatatttagtataagagtgtcccacatgttgcatgggacataattatgccaaaagattgttgtctcatattttgtctggcaaatttatgggagagagatggtggtgtggaagaactggtctcagagactcaagtacaaaaatcagttatgagaacagggcacactgatgggccaagggaagggaggggtccagaagtatgtaatgtgggaacccatcctgcaattgacatgccataggaactctaaggtcagaccagagattcagccatctggtctgaatctctgctggcagctcagctcagagcttgtccagctcaatggacaggtctgagactaacagtcaaatgcactgatgggaccactccaagagccttcctgcctcagttaggattggctcaggaggtggaatggaaggagctaggcagagttcgggaaaattaagtggtagcagatgaatacataactgtcagcattttaaggaagaactgtgttgcatgtaagtgttagagctgaagtgcagacagaggattgtaggaaggagagagggattctgccagggagaaatatgaggaggtttctcagagaaggtcgcatttgggctggacctgaagggacagtacaactccccctgcagaggcctgttctgtgttagctcatgttgctctaatgaaacaccacagacttgggggcttgagcagcagacatttatttctcacagttgcagaagctgaaagtgcgactgggttcctggtgagggctgtcttcctggtaagcacgtggccatcttcttgctatgccctcacatggcagagacagagcaagttctctggtctcatctttgaagggcactaatcccatcatgagggccccaccctcgtgacctcatccctacctgattagtcccaaaatcccatctccaaacaccattgcactggggattacagcttcaacataggaatttgggggagacacagttcggcccatagtatgctccttccaggaccagtgggcaagtgatggaggtggatcctggccacctggacacatggatggagggcaggtcgtggtgttttcaatgtcaggtcaaggtctagatttaattctctgtgaggaggtcacattgttcctggctagttcacttttattttccatcccaaatataggacagcttttctttccatctccctggtgacaaggggatccggatttttctctctggctctagtgcagtcctccgggcccacagtgtgcggtttgaagctgccacctcttgactcagattcagccgtgttctcacgctctctgtccacgacagccctggtggcagaacccacccttgactctgactacagagtctgcacccaggatttatgacagatgctttcagttgccttagtcttttttcctgttttaaatgcttttgaattgtgctctttatcccctgatcctttaatcctaaatacctcttcttgctgtctttcccaagctccatagttcctgttcggtgcctcaaagcaaaacttccccaaggtcagagccccagttaggatcacggtgcccttcctttcctcagagaggcagcccggagggctcagaaacctccaaaccaatgtctcttcttggaaagcattagtccagagcacgaggatgtctatactaggatcccctaggtcttatatctgactgtttagcctattactcagacctcatgctgccctcattcgtgacaaagcccaggcaaagaaacctatttagagtcatctagggcttcagcactatcacaattatcaagacataagagctttttcatcactgtgagtgactgcgtgtgtttagaattatgtggaaatgccatttgcccaggaagtgggaaaaacatctttagcttgcttatgggaaaaaaaaaacacttaattatacagtaaacaacaacacaatgacagtttcacagaggacagaccattcaaccagttcttccaaactggtgggttcttctgaagttggtaaagtctgcaaagaaaggtgcctgaggagactggctgccttccaaaggagttgattttgtttttctagagctaaaaaaaaaaaaaagtctgcgctttcagatgagcataaatcagcagtatcaattcagccttggtactaatgaagaacaaaggattttcttcttgtttgtaggaatttgaaaacttaagttacaggaaatggatagcagggacctagagtaatacagttggcgtatatattttgcgaccgtgatcacccctctccaccggcatctctcttaataagaatccacaaaagaggagaaatgggatgcacctttgtgttagttagaatgacagaagcaaaggcagatgggttgtcaatgttacccaacattttaaattatttagatgagagaggtggaaaaataaaattgcaacagaccagggaggatgaaatgactctttcatgagaacctcaaatcgtattgagccactatgagagagagattactcagggctggtttagaagagccaagaaagagaggaaaggctgctcacagctgagagtctgtcatcagtcaccccaggtgaacccgggttatctgcccaggagtggccatggggagaatgaggtatgtttctgaaagccactaaactatctgggataggaattgccctcacagtctgggccttatcaagctcccccagtaatccaaagagctgataggtgctgtgtttagagaccagtgacccccattcctcccaagccccgtctcctttcttaagcctttcttccccgcaccttcccctgagtcccagccaaggggcagtacaaaccactgtatttcataactaggaacacaggaacaagtccagggaagattatgtttattataccagacctctaggattgggcttgttaggaaattaaagaaaaaaaatctggctatctcatctacgatgtaagctaagagggtgaaagtccctaagagtcccttctttgaggccatggagtcaggagttagcgggttaggaaataacttttatctatgtatcacaattaaccctcgatatttagtgcagtacataattttttttagacaaagggaaatatcctttttttagggaccaggccaaagaaacagtcctccagttgggggcactgatgagcaaggcagcaattaggcacgggcctgaaaagcacccttgtggagaagaggacagtaaggccaggtgtggtggctgatgccagtaatcccagcatttcaggaggctgagataggcggatcacttgaggtcaggagtttgagaccagcctggccaacatggtgaaaccttgtctcgactaaaaatacaaacattagctgtgcatggtgacgcatgcctgtaatcccagctcctcgggaggctgaccttgaacccaggaagtggaggttgcagtgagccgggatcatgccactgcactccagcctgggtgacagagcaagaccctgtctcaaaaacaaaaaataaacaaacaaaaaaacccaaaaacaaagaagattatgtgagaccggtgtcatcacagagccagaacgaccaagctcaaaaatcgtcacagttctagagaatttagatggaagcagtctagaaccatttataactaccattcaagatggtacacagcccattaagtaagggatgggctatacagagctaaacagattttataattataggacttctcagagcctttcttattctaatgtacattgtgaatctccaaagggagctgtggcatgcaacgtttcccgagctgatttgtccaagggatcttggattttgcaaggccaatcttttaagacttagaggtgttccagaaacttctctttaggtcagagccattatgtgcccactaactatgccagtggatcaattctatttcagtaaatgttatttttttctaaatttcagtgagctaatgtgttgcctgaagatgactattactcagataccaaagttttttgaagaatgcccaacagtaatggaagtgttttatttttagaatcaggtgacacagaacccgtaagttccttttcaagcaaagtcagttctgttcaaccacacagcaaagtcagcagtacgttgggatggcagtgggtttgtgcatttggatttgtttccatttagaaaatgaactggttgtatggacgagccagttgcaaaccagcctattcacagatgtaccgctgcccttgtgtgggaccagagctcgcctctacatctcagcaccccaattagtgcctggtgaagcaggagctttggaacagccagttttgtttgttcagattatcccgtttccacttgctctagctgttcccaagctcttctttggacttcagagaaaattaattcagccattttgaggggaaagagcaggtgatagaacacgtggctctactgtaacaaaacataacattttaaaattgtttgcatttttttaacaccactcgaaatgactttacagagggcaatcagcagagaatacagagttgtttaagggaatgtttggtagaagattttactaagaaattctccttttcttcttttttgtttattttccacttgcagtactgaaaaatttgatttcccttctgcagtttacaaatgtctgtggagttgtgttcagctcagttgttgagatctgcagaatacaactggaaagattttgtgagcagatttctttctgtaaaaataaaacagtatgactatgggtataccaacatagtatatttcagggattaaagtgaatgcaaaggccgggtgtggtggctcatgcctgtaatctcaacactctgggaggccgaggcaggtggatcacttgaggtcaggagttcaaggcaagcctggccaacatggcgaaaccccacctctactaaaaatacaaaaattagctgggcgtggtggtgtgtgcctgtaatcccagctactcaggaggctaaggcaggagaatcacttgaacctgggatgcggaggttgcaatgagccgatatctcaccattgcactccagcctgggtgacaatgtaagactctgtctcaaaaaaaaaaaaagggaatgcagaattgccctgaggtctttgatctttttgatcagtaagataatgtgaactacacgatagtgtgtatttctttactgtctagacaagtgttgatacatcttttcagttcagaattttaaacatcgattctactttcttaagtgagaatttgctaggttggtgaagggggatgattcttaaccctttttaactgagaaggcttgccgtctgaaagtttcttacctggccatatgctcacctgtatttgggaagtcacactgatccattcccatctctgttattattatttttaattataaattagaggcaggttttcgctatgttgcccaggctaattttgacctcctgggctcaagcaatcctcctgcctcagcctcccaaagtgctgggattacaggcgtgagccatcacgcctggccctatctctgttatttacatgcaattctttttatttgatgtggtctccctgtctctttaaattcttgtcttgccattatagtatgtagatatcagtattcatgagcatcctctgcttatttctgccttgacaagtccagccctagatcgtatgagcctgaatttcgtttccctgcatgattatcctagaagtgcaagtgagtagcaaaccatcccccattcagaaaacatgctttcattcatgtcttcggctctgtctcccttctggccttgctttcctagtgagttgctattactcagcatgtcagaggacgggaagaggatccatgagtgaatgaactaatgaatgaacagaagcctctgtgtagggtgcgggctggtgaggagcagcggagaggcccgcgtgcatttccatgctgtagctggaatacaagcagctgttttccggctgtgtttcggagctctgccttccacacagtcccttcctctcaccctcctccacatctctttcaggtcccaccattcctcttggccacatttttcttcctatgcagcatatatttaggaagtcactctgattcatcctcatctctattatttacatgcaattccttttcttcctttcctctttccttgaaaagtctactttttttttccccacttgagttcttcttctcacttttgtggaactatcttctttgcaatttttttctccaactaccctgtcaccataaccacccaccttatttgtatctaaagtcatacgtaaccctcacaaggcagaagggcgaagggagctcaaatatctccccttatttcctttgcatctttgcctgtatgataactaaggttctgagtagagggtgacggccagacatttacctttttgaaattgatgtgtgtattaaagatcttctgtgcacaaaacagaaatttatattttgccttccaagcgtggggtaaaatttctatcaaaatggggagataaaaattttttaatgaataaaggaagctgaaaggtattttaagatctaggttctaccaactgtctgtatacacatttatcatccactttcttctacttttcaagcaacacaggcttttctcatttattttccagtagctccagcctcagagtcctggaagataataagccctaaactctatgcctgccctcattagcactgtggaacattctggatgtgagtctcctgttggtgaacagaggaaacacttgcaaatctagttttattaatgatcccatcttaagttgcaattcccagtgtggctttggagcacagttaatatgacaatatagaatacagtaccagagaatcgatgtcatctacaggggaactccattagagagaaagtcaagtctgtatagagtttcgtgcttgtggatagcagggaacacgttctacatactgttggaacaagatggcaagagaagaatgcattgaattccagataaaagctaaaaggaaattgtcttttaaaagcctataaatacttcatcaaccccaagccagctcctcaactcttccatttaactttcttgatgttaggcccgttgtaaagtgctgctctcagacatggaagaatttgggctggtaaacaagaataaagcgttgagttactgggctgagggttcttctcaatgagtggttttcaaactgtcctcctttaggtccaggagattccatggacaggtctcagtggccattctgtccctaatattttatttaaagaaaaactctgatgccagttaaaatggtttgaaaactactgaactgtaatatctctcagctcctgccctactctaaagaccatgaataagtgtgatgtatgtgggacaggaaccacttgaagcagcagttcccaaatttaacagatttgcaactcctctgtctacttagtggtgcttatattagtcaaggttctccagagagacagaaccaatggtgggggagatgtggggagagagagaaatgggtggatggatagatagattagatagctagattagatatgtagattagatagatggatgaatagatagatgattgatagatattaatagataagagagatggatagatagattagctagattaagtagatagatagatgatagatattaatagatagattgattagataggtagattggatggatggatggattgatagatattaacagatagatggatagattagataggtagacagattagataaaaagatagattagataggtagattgggtggatggatggatggatggatggatggatggatggatggatgagaggggatttgctagggaaattggctcacatgattagggaagctgagaagtcccacaacagcccacctgcaagttggagaccctggggtgccagtagtgtggctgagtccaagtcagaaggcttagaaccaggggagccgcgagtgtaggtcctggagtccaaaggctgaggagcctggagtcgttatccaaggacaggaggggaggagtgtgtccccactccagcagatagatccatacatttgcctttcctctgtattggtcctctccagcccctcagcaggttggatggtgcccacccacattgaggatggatcttcctcacctagtgcataccaactcacatgacagtctctggaaacaccctcacagacacacctaaaataaggctttactaggcttctaggtattccttaatctagtcaagttgacgcctaaaattaaccatcatagtgttctttataacataatcctctttaagttaaagtagattaaattataagaatttttggaaaaccttgtgacttcctgtaagataatatagttactctgggatgccattgatgtattcactcatttttaaattggatttaaattttttctgcttactaaaatagtagatatttattgtaacatccaagcattataaaaatctataccacagaaaataaaagaacttcataatttccactactctcctccatgagaatattttcccatgtttttcggtgggtatactagtttttcaatgtttttcagtgtgtatactcgtttgccatgtttttcagtggatatactagtttttcaatgtttttcagtgtgtatactcgtttgccatgtttttcagtggatatactagtttttcaatgtttttcagtgtgtatacttgtttcccatgtttttcagtgtgtatactagtttttccatatttttcagtgtgtatactcatttgccatgttttccagtgtgtatactagttttccatgtttttcagtgtgtgtactagttttctgtgtttttcagtgtgtatactaattttccatggttttcggtgtgtatactcattttccatggtttttgatgtgtatattagttttccatgtttttcagtgtgtatactagtttttccatgttttttcagtgtgtatacttgttttccatgttttccagtgtgtatactagttttccatgtttttcagtgtgtgtactagtaattttccatggttttcggtgtgtatactcattttccatggtttttggtgtgtatattagttttccatgtttttcggtgtgtatgctagtttttccatgttttttggtgtgtatacttgttttccatgtttttcggtgtgtatgctagtttttccatgttttttcggtgtgtatacttgtttcccatgttttccagtgtgtatacttgttttccatgttttgcagagtgtgtactagttttccgtgtttttcagtgtgtatactagttttccatggttttcagtgtgtatactcattttccatgtttttcagtgtgtgtactagttttctgtgtttttcagtgtgtatactagttttccatggttttcagtgtgtatactcattttccatggtttttggtgtgtatattagttttccatgtttttcggtgtgtatgctagtttttccatgttttttcggtgtgtatacttgttttccatgtttttcagtgtgtatactcgttttccatgtttttcgatgtgtatactagtttttccatgtatttcagtgtggatactagtctactttctttttgtttttacaaaaatggggctatcctgttttacactttgtttttttaatggttttagagtcgatcccaatgtacttaaccagccttctactggtgaactttgacttgtttccaagtttttttataggaccaacaatacagttaatgaacatgtgtttttttgtaatattttttcacatctcagaattcatgctggagttctgggcagggttttttgtttgtttgttgttttttgatacaggggcttgctctgtcacccaggctggagtgcagtggcgcgatcttggctcactgcaacctctgcctcccaggttcaagcgattctcctgcctcagcttccctagtagctgggatgacaggcgtgcaccaccatgcccagctaatttttgtatttttagtagagacagggttttgccatgttggccaggctggtcacaaactcctggcctcaagtgatccacccgtgtcagcctcccaaagtgctgggattacaggcatgagccacccacagggcctggacctgtttttaaaagcactttcataataagaattaacctaagccattatatttcaattcagtttttgaaaattattgtgttttcaaggtactagggtaatttggcatctaaaggaataccaatgaatttctgaaatgaataattatttccctaatatatcttttgagtaactcctgcttttcctgatttgggtttgtttgaagcaaggcacgtctatcatatgacagattcacacacacatattttctctgctgttagtggccacagcacatactgagaagcaaagcctgtgctttcaacctctgcttccctggaagcacttccatgatttcctgatacttaagaatcagcatgagatcacaagcatgcatgtcagagctagacagcctggcttgaatcccatctcctctatgcatttgttgtgtgacttacagcacactgttggacctttccgtgcctttgtttcttcatctgtaaaatggggatgtatgagggttaatgagttaatagatgaactaatatatatcaaatactcggaccagtgcctgttgacaggaaggacggtataacactattgtcattataacctctgtattgggttgtgtctgtccctcactggacatgtggaatgttggccaggtctcctttggattgtcattttgacccagaacctcccagagttaagaaatacctggacaggccaggcgcggtggctcacgcctgtaatcccagcactttgggaggccaaggcaggcggatcatgaggtcaggagatcgagaccatcctggctaacatggtaaaccccgtttctactaaaaatacaaaaaattagccaggcgtggtggcaggtgcctatagtcccagctagtcaggaggctgaagcaggagaatggcatgaacctgggaggcagagcgtgcagtgagccaaaattgcgccactgcaatccagcctgggcgacagagtgagactccatctccaaaaaaaaaagaaatacctgggcgacgagacgtgctatcaaggaggtggggaagttggaactctcctacactgttcatgggaatgtacaagggtgcagccactttggaatggggtagccgtctggaagttcctcagaaggttaaacatagagttacagtgtgatcagcaattccactctaggtatacactcaagagaaatgaaaacatggccgggcgcagtggctcacacctgtaatcccagcactttgggaggccgaggtgggtggatcacgaggtcaggagtttgagaccagcctggccaacatggtgaaaccccatctctaccaaaaatacaaaaattagctaggtatggtggcaggtgcctgtaatcccagctagtctggaggctgaggcaggagaatcgcttgaacccagggggtggaattgcaatgagccaagatcacaccactgcactccagcctgggcaacagagtgagactccatttcaaaaagaaagaaagaaaggagaagagaagagaaaagaagaaagaagaaagaaagatagaaatccacacaaaaactcgcacaagaatagctgtggcagtattgttcatagtagccaaaaaatagaaacaaatgttcatcaactgataaatggagaaatcagatgtagtatgtccgtacaatggactatcattcggccagaaaaaggaatggagtacccatacatgctagaacatggatgagccttgaaaacatgctaagggaaagaagccaggaacaaaagaccacatatgatacacttccatttgtaggaaatgtatagaatagacaaatcttagagtagattaggagttgcgtacattgtggtgctgcaggtaggcgggaatggggacgtgactgctgatggatacagggcttctttgggaggtaatggaaatgttctaaaattagattgtcctaatggttgtataactctgaatatactgaacaccattaacttgtatacttgaaatgggtgaattatatggtatgtgaataaagctattttttatttattttattttatttttttagagatgggatcttgcttgctctgtcacccaggctggaatgcagtagtgtgatcatagctcactgcagcctcaaactcctgggctcaagtgatcctcctgcctctgcctgctgaatagtaaagctatattttggggggaaaagggggaaacagctcctgagtttgggggtgggctcccagaatataccagcttactgaaagcgaggcatcgggagagaggcctggaatctgtttttaacaagcccagcaaatgaggcatcattaagtaggtcttagaaatacactgtcatagagaatacttttatttttcttttacattgtaaagtgggatagggtaggattaatacattttagcttacgtttttgccacaggctaggtgctgtggaaatacagtatcctttgatgacaataatgacagtcttcaaagtgagcggtgtacattcttccagaagtttcgcacttcctgcttctgaagtgcagtgccctagagagcctcagacccatccccagggcccccattcactgcagccactatcgtctctctccctatgcaggtgctgagacagaaataagggctgccagcaccacccagaaactgactatgaaatccccaatgtgtctgaccctttctctttaagactttggtttgcttacatttcattttgttcctgtaagtgtttcttattgccatagcaaccctaatcgatcactggaccaaaaatagctctttcatgttttccaaagcatgtctgtagtgaattggaaattcagttctgccgtgcattttgcatatgctgctttcatttcccgacactgaacctgggagggcttgtgtctggaaattattcttgcagagacccagaaacctcacttgtctttcctggcgttcttcttccccactgcagatccacccgtcacttccaaaagctacaagtagctgcatttaaatgttccaccatcacttttctgcacattgagttttgggtgctggaggttttacaggtaccagaatatcacttttcaataagaggttcatcctggtggattccgttgggtttggaaggccaattatagatgcttagacaccagataaaaggaagagggtcatggcagggagcagatggcagcaacacctataagattcctctggcttacgtggatctaagctagaaaatcaaagatgagatgacaggagagctcctgccttgactccctgacttcttcctaacactgctactgtttttagggggttggggcaaaataaacactggatgtaattaagtgaatattttctatgatgctttctctgctttattctccctgccaagctgtgcctttagtcaagaagagggagagagagataaaaaagaaaagatttttcatgagaaagaggattcgagacctggagtgagcccagaggaggaagaagaggtggagagggacagaaatgactcactgatttcccccaggctccagggacaggcgtgcttttttgcctccccctctgcctgtaagcagagtcatctctgtggcctcaagggttcccaacttctgttttatgcttctgtttcttaacttctttgagccttggttttggcgattgggttgagtgaaccagcggacgtgcaccctttagatctaggaaagaaaagagttcacggagatcctggtagagtttttgttccctgcatgaagtcagcagggggccaagggaaagctcagagaagaggccagtggaaggggcacctgcccagaagaaggagctgccaaggatggagcctgggacacgtggtgacatttcctcagcagcagagcaggtcagggattcagagtgagtctggaagagcccagatctgctctgtggtttggctgccttccttgccatgggaagaagccatcaggtgtcctgtggatgcctttccggaagcctctgcatccttgcatcttcatagtggaggatctgcctttgaccccagctcagctttctcgtccacattgcctaggagggtacaatggagtggaccaacatctctccagcatctgccaggcgctgcctggccctggacattcgttatctcttttcattctcaccccacagctttgaggttgcaattgtctccatttgatagatgaggaaactgaagctcagagggaatcgtgaatttgccccaagtcacacagtttgttggaaaagaagctgcggtttgaactgaagtctgttttactccaaaaatctgtattttttttttttttcctactaaatcatcatcctccctctctgtgggttaggtgcctgctgctgcatctggacaccagataatgacaagcttgctgacatcagttactagtaaatatcaccctgggcaataagcagtggccattgattgacaaagcaggtggcatcataggtggaactaataagtcagaaaaagcaccaattcccccttcccttgcacttgcttgaacctcagagtcggtgatgctttactcagatgaaaaccagatgggtgatttggaagaaggcagccagcaggctgagtgttgtgttggttttctcttgctgtgtagcaaatctcccacaaatttagcaacttaaaacaacacaagtggctgggtgcaatggctcatgcctataataccagcactttaggaggctgaggttggaggatcgcttgagctcaggagtttgagaccaacctgggcaacacagtgagagctcatctctactaaaagtaaaaaaaattagctgggtgtggtggtgcatgcctgtgatcccagctgttcaggaggctgaggcgggaggattgcttaagcccaggaggtcaaggctgcggcgagctgagctatactgcattcaagcctgggcaacagaatgaggctctgtctcaaaaaagaaaagaaaagagaagagaagaaaaataacacaagtttgttatcttgcagtttccatgggtcaggagttggaacccaggctagctgggtccttggctcaggcaactcaccaggtagaaatcaaggcatcaaccaaggttctagtttcaccagaaatgcagggtcctcttccacgctcactggtggttggcaggattcattccttgtggttgaaggacgaaggtcgcgttttctagctggttcttctccggctgtcactctcagttcccagtagacctctcttgggtcctatccacgtggctatctcacaacttcaaagccaacaaaagaatctctgctttttctaaagtgaagtcttgtatacactctcaggagtgactgactgtcttgtctttttgctatcaatcaaaagctgtgctccctctgaaggttctggggggcaaccaggggagtgacagcccatcatatccccaggttctgctcacacccgaagggaaggattacacaggatgtgtgcaccagtggctgggactctggaggccatctcagaattctgtctgccgtgggtttttcagtctttccttcatatgctgtgggccaaatgggactttagacattcagcatttccaaatgactgttccttagagagcacgggatgcttcagcagcccttagacatctttttctgttttagccaatggctgacgaccctagtgtctctcttcttggagcaagttcaggtgtggttacatcagggttcccaacgttttttccacccccacactcctgacagatccctcggtgatatagaatccctccacccaaggacatttatcaggatctttagggaacagcgcatattttgagaaaaagtccagggttggaaagtggggttcccgtctccccattgacattgagaatgactaggttagatggtatattcctagtggaagcaaaagtcttagttacagaaagcattatttgagcaaacctaaactaaaggagatgctttaacacctgaagaagctgggtaaagcggggggggggggtaaagaagaaggggggtgactttgatgaccaccattcctagtggtgctggtattaggggggcaccctcctgttagagtgtgagcttaccacatggttggtgagcctgggacacagatagctaatggtaatggtgacaaaggagatacgcgctgtgataaagggacaaacagaatgctgccagcatgcatgggataatcattccgaagtggtacttgagatggtctttgagtaagatttaggaaagaaatttcgggctgagagtaccatggccaaaaaaaaaaaaaaagacctgacagcaggaagttttccagggaagggggagtggacctacctagatttagggtgggtccaaatccaatgacttttgtccttgtaagaagagaagagagcacagagacccagagggaagaaggggatgtaaagacggaggcagagactggagtgatgcacccactcccggtgccaccaacagctggaagagacaaggacagattctctcccagagtcttcagaggtagtatggctctgccaacaccttggtttcaggcttctggcctccagaactgtgagagaataaattgctgctgttttaagccacgcagtttgtggaattggctacgataattctagagtaccagtacagtcagggagaacattcgcgttcattctggacctttcaagtttgatgaacctgtagggtctttgttggggatggccagtgggcacctggaaatgtgagaggagttggaatttgcgatgttgatttgggaggcatctgccaaaaaagaaaaaaatcatgaaaagtcagaagcagatgagatcaccaggggagagggtttggatcaagaaaagaggctgtaggtagggtaggacctgagggatctcctgtagggaaggagtggaggagggaggaaagggtgaactgctgctcaggatggaggagttgctcagtcatattgcagtgtagagaggtctccagggtgcaaatggaagagtgatgctgctttggaaatcctttgatgatcaggtgggaggtggaaaaagtagagacaggaagcactgaaactgaatactcttttttttttttttttttttttttgagatggaggcttgctctgtcgcccaggctggagtgcagtggcgcaacctcagctcactacaacccccgcctcccgggttcaagcgattcttcccgctcagcctcccgagtagctgggattacaggcatctgccatcatgcccagttaattcttgtatttttgtagagatgggggtctcaccattggccagcctggtcttgaactcctgacctcaggtgatccacacacctcggcctcccaaagtgctgggattacaggcatgagccaccatgcccggctactgactactcttttaataagtttttttatgaagacagaaagagatacggaattgattatagatgggggaagaaataggatcaagggaactttgtgcttatttattttttaagactgtgtctcttttcattatatttttaggctgtgggaaggaagcagggaaaagatgcaaataatcaatgaaacaaggttccagagaagagcttacaaataatttgtactgtgcacctactatgtgccagtcactgtgctggggtttagctgtgtgatctcattgatcttctgaacactcctacagagcggaaaaggattgtccccattctccacctggggcaactggggctgagaacagtaaaataacttgcccaggttgatacatcttggatttgagcccaagtcagctggctctgatgtctcagtgcttttcattatattatttctccactgaaaaagaggaggatatatctttctcggattcacaaagaataagaaacgtaaagaaataagcagatttgtaatggaggaaagggatgtgtcagtgtttctatcatgcagttcatgtcctcattaaactatgactcaaagtgatcagctgcaagggagaggggagaaagggtgaagccaggcaagggaccttgagagggtaagggatgtaggatagatcagtggatgagatataacagggagccaatcaggaagaaataaaagaccttgctttaaagctaagcttccgctaggattagtgggctggatttttggagaaaccagcctgcatgggggaggcagaaggttatcttaacatggacatcacccctgagagatttcagtgacggcactgaagaagcccagagccacagataattctgattttaactcaagacacccgcacaccccaggactctgagaacgagtcatcagacatcccaaggggattatcagccccaaccacctgccgaaggagaaagtactgacccgcttggagttaccaggagctgttctctggccaccctgctgaagccaggtgcactactcctagcctcgtggcaaggttgccattctgatatgaaaataaccaaagtccccactcaaaaataacaacatctgctaatttgcatgggagttttgcatttcataattgggtttaatacgcaaatgctaaaattcatgtgttgggctagctaagtggtttagaggttcagtgggtaaaaactcctcacagtgttccactctggtgcaccgagacccacacccacgctccacaactctgtactctccccactccttggtttgactctcatatgaattatgggataaaaaatacaaaatcgatttacctaaaggcttgtcgtgtctaagagggtctcagccagggcatccccccacgttctcatgtctgctttggggctctgagtcctccagcgtcttcatttgagatgagcagctgctccttggtgctacctgaacccggatataagggcagcggttatggagtgagaagtttgagaggagacagcagagagggtgttaatgaataatcgcagggccttgttctccataaaggcaattactgggattgattgtttccgtgtttccttagtcacggttcagatcccttgtttcactcagattaagacagatgcgtgctgaacgcgtcctggcatgtgatgtcaggagaattatcgatggcacgtcccaggcctctgtcttctcgtgcaggtgccaccaggggtctcagctgggctgaaaggggagcgtggtcattgtgcggctgaagcatgtgtgtgctatagccaggtggttttccaggttgagcatgcctcagcatacactggagggcttggtaaacagattgctgaaccccacctccagagtttctgatttagttggtctgctgaagaatttgcctttctttctttctttcttttctttctttccttctttctttctttctttctttctttccttccttccttccttccttctttctttctttctttccttccttctttctttctttcctttttttttttttttgagactgagtctcactctgttgcccagactggagtgcaatggcatgatctcagctcactgcaacctccacgtcccaggttcaagcgattctcgtgcctcagcctcccaagtagctggaattacaggggtacaccactacacctggctaattcttgtatttttagtaaagacggggtttcgccatggtggccaggctggtctcaaacccctgacctcaggtgatatgcctgccttggtctcccaaagtgctgggattacaggcatgagccaccgtgcctggccaagtatttgcatttctaacaattctgggctgctggagctggtccagaaactcctctttgagaaccactcagtatggtgaagagtatggacactgagacctggccacctggctgcatgagactgtaggccatttacttaccctctctgcacctccatctcctcatctttaaagcagggggggatggtaatagtacctccttcacgggattgttgccaggaataaatgagtgagagcatcagagcatttgtagcagtgtctggtatagacagtatgtgagtactggaatcatgtataagggatccagcctcttgggactgtgatgctatcaggccaagtctggtttccccaacacccacagatcccaatgcaggtgctgggtcattttgcccattagccgtcaatcccatctctggtggccaagaaagttaatgcccagcttagggctagctagagcgtggttacaccaacatccatcaaaattctcttcttaagccaccttaacccttcacatctactgaatgcataggacttgactcagcgagactggggctgtagggctgggttgcatttggggtttctgtccctcgtgtggacaaagacaaagacaggggctgccttttctggttcagtttctacccatggatgctgtctgctgaatgcattcttgctgcccagtattatacatttttaaaacatcattttattaatatttaaccctcacagtgttgctcttaggtaataattattactcctgttttaactctgttggggttcagagaagttaaatgacttatccaaattacatattaaaagccaggtctcgcccggatgcagtggctcatggctgtaatcccagcactttgggaggccgaggcgggagaatcgcataaggccgggaatttgagaccagcctgggcaacagagagagacccttgcctttaccaaaaaaattttaaaaatccgccaggcatggtgtcacacacctatagctgtagtcccagctacctgggaggctgaggtgggaggatcgcttgagcccataggtcaaggttacagtgagctgtgactgcaccactgcaccccagcctgggtgacaaagtaagactctgtctcaaaaataaaaataaaaagaaggccgggcgcctgtaatctgtaatcccagcactatgggaggccaaggtgggcagatcttttgagctcaggagttcgagaccagcctggctaacatggagaaaccctatctctactaaaaatacaaaaattagccgggctacacggaaggctaaggcatgagaatcacttgaacctgggaggtggaggttgcagtgagccgagaccacaccactgcactccagcctgggcgacagagcaagaccctgtctcaaaacaataaaaaataataaaatttaaaaattaaaaataaaatttaaaatttaaaataaatttaaaaattttttttattttactttaaaaataaatttatgttttaaaaattaaaaataaatttatgttttaaaaattaaaaataaaagccaggtctgtctgacttcaataatctatgactttaaagttctactatatccccttgctaatgttatatgagcatttatataaagattaaggctgggtccccaggaatccagcaatggtagctgctccccaaaagtaagctcaccagaactggaactggcgtgatttaggggtttgcttttctaaagcttatgctaggagtcacagaacatattccttttggaaatgttctcttcagggacttgccctctactgctggttattctctgtggcctgacctctgtctggatgaaactgtgttcattgtcctaaaggcggctttcctttgtctgaatttggatattgacttagtatcttaacatttctgttccgggacggtgcttgcaaccaaatggccaggaaagtattcagaagctctgctgaatataggaagagagaaaaaatgttatgctaatgaaaatttgcttttctcccacagtgttcctttctgccgaaattctccattcatatagaaaccaagtatgaggacaacaaaggaagcaatgacaccgtgagtagcccctccttccatgctgcgctcgcctcgtgggctctgaatatcacagcacttctcacagcccctctgtgaccagggccagcagtgggacctgtgcctgggacctcagagatgttctggcctttggcttctgagggttatttccctgggacttttccctggaattcttttgttgtctagcttttctttcttctcatttttatgtactttccctgggcctctgagcagaagcctctgacctggggtgattgtcatggaggtggagaggatgacagggcacttggaactccaagatttggtttttgatcattggacagagtacacatcttctcaatgcctattaatatctacttcggaaagggaatacaatcaaagatatgtgtacacagaaaaggaaatacagtcagatgtatgtgtgaacagaaaaggaaatacaggcctggtgcagtggctcacgcctgtaatcccagcactctgggaggctgaggcaggcacatcacctgagatcaggagttcaagaccagcctggccaacatggcgaaaccctgtctcgactaaaaatacaaaaattagctgggcgtggtggtgcacaccagtaatcccagctacttgggaggctgaggtaggaggattgcttgaacctgggaggcagaggttacagtgagccgaggttgcaccactgcacttcagcctgggccacagagcgagactccatctcaaaaaaataaaaaaagagaaaaggaaatagaatcagatatgtgtgtgcatactgcatgcatgcttacttacacacatgcggtgtatgtatacacccacacatcctaccttaaaatcagggggtacccccacaaaatatttacctcctgaggcattctgacttttactaaatttcagccaagtattttgcttattagtgttgggtaaaacccatcttctgacctggcttttacccccaggctctttctgtttgggcagtaaatttctaacttctcttttctttgggggtgactgttttgacctaccaaaagcctcacctgggattaggctgtgggttccctcaggacccgttgaaaggaagaacctggatctagaagcttcggggcttccccagagttcatggaacttcccagaggagagaaaaatacagctggcagcagtactatcctaccactctgttcaggaaccccatcgttagtgtctccttgaagtggcagcccaatgggaaatgtttagggccattttcctgtcacagcctgaaatcacaggcgcgttgctggccaaattcatcaaaaccaccatgcctaaaacagtgtcacactgtgtttcaacttgaatccttgtaaaatagtgattttttttttttttttttttttttttttctgattagaaagcagcctgggcgcggtagctcacgcctgtaatcctagcatgttgggaggccaaggtgggcagattgtctgagctcaggggttcaagaccagcctgggtaacatggcaaaaccccatctctactaaaaatacaaaaaattagccgggcgtggtggcgcatgcctgtaatcccagctactcaggaggctgaggcaggagaattacttgagcctgggaggcagaggttgcagtgagcgcagatcgcgccactgcactccagcctggcaacagagcgagactctgtctcaaaaaaaaaaaaagttaatacatggctattcaaacttggagaatgcaaaaagaaagtattgaaaaaagaaaggaaaaaccaatagcaatcccacaatttagagatgacttctgttagcaatttggttcatgttgcagattatggacaaatttattttttaaccaattcctcctgaattgaatcatatagtatgttatttttaacatgccctgaagtatgcttccctataatgatttttcctggctgtaccaccttccatatttcagtgtacttctttaaacaattgctggtcactggatattgaagtaagcttgactcttttcacgtagctgtggactctcatgaaaaggataataaagttcagttgcttgaattgcttttcctggcataatatgaaaatatgggggaattttttttttctttataagacagggtctcgctctgtcacccaggctggagtgcagtagcacgatctcaggtcactgcagcctccacctcctgggctcaagcaatcctcccacctcagcccccctactgggactacggcacacacaaccgtgcccagctaatttttgtgttttttttagagacgtggttgtaccatgttgcctaggctggtctcaaactcctggactcaagcaatctgcctgtcttggcctcccaaagtgctgggattacaagcgtgagccaccatgcctggctggaaaaaaattttttaaatatcttttagtctttccaaacaaatttccttgctttctctctttttctctatgcctctatctccatgagtttattcaaaacagctctccatttgaagaggtgtagagaggccaggtgctatggctcacacctataatcccagcactctggtaggctgtggtggacggatcacctgatgtcaggagtttgagaccagcctaggcagcatggtgaaaccccatctctgcaaaattaaaaaattagccaggcgtggtggcacacacacctgtggttgcagctacctgggaggctgcagtgggagaatcgcttgagcccaagaggtcaagcctgcagtgaaccatgtttgcacctctacactccagcttgggtgacagagtgccacctaaaaataaaaaagaggtgcagaggggacacgtggcctcactgtgatccctatagattggtgggaccactgtaatctggtttatcctctgcccagttcaaatcatccccaaaattcatatggttattgtgtattattatacatccttttttggcaggtgctcaggttttttgactactctcctaggaatttaaaataacaggttatccaccttacaatcaggatccaggcccatgccaagggccaggcccctttgagacttaggctgggctgcaagagaagcacctatcacctattcactctgtgcagtccttggacacagtttgcttcctctaggagaaatctcagctgttgtagcctggcttgcctccctctccccagaatgtggactctggaactgcccaggggacctgctgcttgtctgcctgtcatggcacccaacttgcccaagccccagtcctgccatcttgttacactaaagaggccctaaatgtgtttttggcccagttgccaccccctgccccccaggctctgcttgaccctgctccacggaccccaggtcttgctcctgaggccattggaccacacggcccagccccacttcattagacttctttgccaatttgccctcctctgttttacatattcagcggctgttggttgtccagcagattcaaagttggtcccagaaaggcagaaaaggagcgttgcgccgaggcacggtggctcacgcctgtaatcccagcactttgggaggctgaggtgggtggatacctgaggtcaggagtttgagaccagcctggccaacatggcgaaacctcgtctctactaaaaatagaaaaattagctgggcatggtggcgtgcacctgtaatcccagctactcaggaggctgaggttggagaattgcttgaacccgggaggcagaggttgccgtgagcagagattgcgccactgcactccagcctgggtgacaagagtgaaactctgtctcaaaaaaaaagaaaagaaaagaaaaggagggctgcatccgtttccattcatacttgttaatacttcaaaatctgaacataagaagtatatatttatctaacaattctttaattactaaacgctagctttatctagccagggattcaaaactggtgttttaagccaaggagtgtgctggtgtgctctttttctgtcctgggttgagtgtggagtttttggtgggaggcagagttgctaaggaaagcagtgcagtagtggataattctcttgtctcaccgcgtttccaaactatttaataaactcagttcatttctttgcactttctgggtgtacactcttatcattcagctaccatccttcatactgctatctgcactgtttcctcccctacctgccaaaaatttaatgaaattgatgacgataagaagcaataattaaattgaaagaggctgctgatagtcatattgatgatagtggttgaatcgagtacatgttgttatcctattatcaattaccatataagtaattttttgacgtgacccaatatctagtaaaaaaaaaaaaaatagtggcagtatgagtaaatatcttccttgttaaaaataaaaccagtatacgtatgattgtgaaaacctgcaaactgtgattacattaaccaggatgcaatggggaagttgtcttaaactgaggcccatttattttatgcacatacttatgagaattacttgggccttcattcgtgctagggaggacggcaccgtgccaaggtaaggttccgttgtttatccaaggccataaatctaggcctgtgagagtccgtgcttagcactgcctggttcagctgaatgagaggctgcccatgtggtgacggctgccaggttactggtgttcaatggggttaatgggggcagccttgctactttacttcctcttccaaacaaagcaggcaccatttaaagcagtggttcccagccttggctgcacattggattcacctgagaagttttaacaactcatgcctgggtcccagcccctgggattttatttaatgggtcctgggcgcaggctggtctaaaccagccaataagcatgaaggacagaacactcacttccagaacaccaaattctccagctggcagtgtgtgcagttttagagtctaccctgaggctgaacctgatatgttccctcaggagacattggctatgctgtccccacccctgagagggtctagaccagcagttctcaatcacagctgcctattaaaatcacctgggccaggcggggtggctcacacctgtaatcccagcactttgggaggccgaggcgggaggatggcttgagctcaggagtttgagaccagcctgtccaacatggtgaaacctcgtctctactaaaaatacaaaaattagctgggtgtggtggtgcatgcctgtaatcccagctactagggaggctgaggcaggagaattgtttgaatctgggaggcggaggttgcagggagccgagatcacaccactgcactccagcatgggcaacagagcgagactccttctcaaaaaaaaaaaaaaaaatcacctgggaagatttagccatcactgatgctgctgtcccagccctggggattctgatttcattggtctgaggtggggttgaggcattgggattctttttttttttttgagatggagtctcactctgtcacccaggctggagtgcagtggcgcgatctcagctcactgcaagctccggccttccaggttcacgctattctcctgcctcagcctccagagtagctgggagtacaggcgcccgccaccacgcctggctaattttgtgtgtgtgtgtgtgtgtgtgtgtgtgtgtttgtgtgtgtgtgtgtttgtgtttagtagagatggagtgtcactgtgttagccaggatggtctcgatctcccgacctcatgatccgcccgcctcggcttcccaaattgctgggattacaggtgtgagccaccatgcccggccggcattgggatttttacagttcccccaggtgaatctaaggggcaacaagactgagaactatagatttaaagaaatagtaagtgctatttaaaaccaacacttaggaaaacaaatgttttcactcctttatactcctggaaaataggacagtttacaaaaggcatatgtaaaccccactccattccactcccactcacacaataaaaagacctgggtaacatatgtgttctcattagccacatatcaccaaggacattatttcttggcaaagaaactcctctgataaaatgaagagaatgtccagtttagttcctggaaacatgaagctctgtctttcacaggggtctccttggaagctgcctaaaagaagtgtctggaatgtatttcatttctagctcctctgtgtggtaatgaaagaacacaaagttgttctttgtgaaacagaaagatcagtattgaagttccagttatcaccataagcctaaggcttggtttctttatttaaaaaaaaaataggataaataatgcttccatcagggtgtagaggatgcatagaggttcatttacatggaagcacttcataaactgtgaagtgccatgcaaataagagacatgattactgtgatggccacacctcgggattaactgcactcatgatgatttcccaatgagactctgattttgtctcaagtgtcaatgaaccatttgctgttcaacaagttttgagcacctactatgtcccaggcattaggagaaggatcggggatacagcattaagacaaaccagccctccaggccggttgcagtggctcacgcctgtaatcccagcactttgggaggcagaagcagccagatcacctgaggtcgggagttcgagatcagcctgaccaacatagagaaaccccatctgtactaaaaatacaaaaaattagctgggcatggtggcgcatgcctgtaattccaggtactcagcaggctgaggcaggagaatcacttgaacctgggaggcagagattgcagtgagctgagatcgtgccattgcactccagactgagcaacaagagtgaaactccatctcagaaaaaaaaaaaaaaaaaaccagacaaaccagccctccattaatcatggagtaggggaagcagataataggcaagtaaacaaacaaaagaattgcagctgtgctaagtgctaggaaagctataaacagactagagggagctcagcctgaggccatgtggtcagaaaggcccctcagaagacacaagtccacttgaggcttgagtatgggaaggagccagccctatgagatatatgttcccccaccccaggttcatacgtggaagctttagaatgtgactgtgcatggagacaggacctttaaagaggggattaagttaaaatgaggccattagagtgggtcctaatccagtctgactggtgttcagataagaagagaacacttgggcacataaagagactctaggctgggtgtggtggctcacagctggaatcccagcactttgggaggctgaggcgggcggatcgcttaagctcaagagttcaagaccagcctgagcaacgtggcaaaaccccatctgtacataagaaatgcaaaaactagccagatgtggtggcacacacctgtagtcccagctactcaggaggctgagatggaaggatcacttgaacccaggaagcagaggtttcggtgagccaagatcgtgccactgcactccagcctgggtgatagagagagacgctgtctcaaaaacaaacaagcagactctttgggtgcaacacgtgaagacgtagggagaaggcagccatccgcaagtcaaggaggaggtctctgaagaaatcaaccctgcaggcacattgatcttggactttcagcctccagagctgtgagacaattaattagattttgttgtttacaccacccaatctgtggtgttctgttatggctgaccccacaaactaatgcagggagcaaaggccctggaccctaacacagcctcacatattccaggaactgttggaaaaccactggctagagcattaggagtgagaataagtagactggcaggaactgaggttgaaaatgtagtaaaagctagatcacgcaagagctatggggccatggcagagtgtggatttcagtgcagtgggaacttattcaaggattttaaacaaaggaataacaagatactgttcgtggagttttttaaaattttttatttggggataattttaaatttatactaaagttggctgggtacagtggcttattttccagcactttgggaggctgaagcgggcagattacctgaggtcaggagtttgagaagaccagcctggccaacatggtgaaaccctgtttctacttcaaaaaaaaaaaaaaaaaaaattagctgggcgtggtggtgcatgcctgtaatccctgctactcaggaggctgaggcagaagaatcacttgaacctgggagacagaggttgcagtgagccgaaattgtgccaccgcactccagccggggtgacaagagcaaaactccatctcaggaaaaaaaaaaatgtatactaaacttgcgaagattgtgcacagggttctcaaataccctctacccagtttccccttacctaaccatgattccactgccaaaactacagacttcattcagatttcaccagttttcccaataatgtacttttgcttctgttccagaatccagattaggacaccccattacattggttgatttatgttttaaaatgtttgctctggctgttctgtggagaattagtgaaaggcaagactggaagcagggagtccagttggtaggctattggaatgatccagaccaagatggtggtttgagctggaaagatggcagaggataaagaggggaggaagggatctattttgaaaacagagtgactttctgttagaattgatgcggggcatgagaggggaacaaaatagggatgatctcaggctttctagctctgcctagtgggcctgggtaagtggtggtgccattgccatcatgggaaacagtggaggagaagcaggttctgagaagaaaagcaagagcgccatttagtcatgatgactttcagataccaatgagactgccaagtggaaatgaggggtaagaagttggatattggccaggtgttgtggctctcacctgtaatcccagtgctctgggaggtcaaagcaggaggatcgcttgcacccaagagttcaaggccagcctgggcaacatgttgagacccccatctctacaaaaaaaaaaaaaaatttaattagctggacatggtggcacacacctgtcatcccagctactcaggaggctgaggtgggaggatcgcttgagcccaggcagtcaaggctgcagtgaaccatgatcaagccaccatactccagcctgggcaacagagcgagactctgtctcaaaagaagaagaagaagaagttgcatatgcatatgaatctggcattcagagagggatgtgggtcatgatttttatctagggagaggagtgacagaaaagagaagtttctagatgctccgagatagagattgcccaggtcctaagaaggaccttctgatggcttccaggtccagcttctcgttgttatctttattccttggttaagactaattttcaatcactgggctgtgcttggttttaggaaataaacgatctcattaatttaaccacaaagatttacttagagagatctaatttctccccctgggtgcctccttcgggtaaattgcataaacatctcaatgtcttgactgggctcaacttgcatggctttggagagaaatgttctcttcctgactacaagtagcttcccctggaagttaccagctgacaaagagggaattttagcatttcaggagagctgtatttattgaggcttgctatgacaatagccatcgtgaagtttgttttctttcttttttattttttgaaacggagtctcactttgtcacccaggctggagtgcagtggcgtgatctcacctcactacaatctctacctctcaggttcaaacgattctattgcctcagcctccagagtagctgggactacaggtgcgcgccaccacacccagctaatgtttatatttttagtagagacgggatttcaccatgttggccacgctgatcttgaactcctgacctcaagtgatctgcccacctcggcctcccaaagtgctgggattacaggcgtgagccaccgtgcccagccgtgaagtctgttttctaattagcacagtagtccctgcttctccgaggtttcactttctgcagttttagttccctgcagtcaaatgcagtccaaaaatattaaatggaaaattccagaaaagaataattcctaagttttaaattgcatgctgttttgaggagcaacatgaaatctcataccgtcctgccccaccccacccagggcacgaagcctccctttgtccgtcaactctgctctgtatatgctacacgcctgttagttacttagtagctgtctcggttatcacatcaaaagaaaaaaaatagagcgtgtatagagtttggtactatctgaggtctcacacatccagtgggagtctcagaatatatccccctcggccaaggtcggggacaactgcatttgtatttgtaactccaagaggacaacatagatggatggatgttaacacatttcaaaatgtactaaaattaatttgtaaagcaggagtgccagtgggaactgcagaatccatatttacaggtctctggagctgattatctcttccttaaatggcttctaattgaggattacagaaagaaaaaaagcatttgctttatttttagacgtgatctctgatgtcttcaacttttatcgttctgtttttaaccttagattattataaccagccacctacaaaatctgcaattttctctaataagtcagcacctgttaaaaaggaggttgcacaaaacactcccatttgcagtttggaaggattattatctgctttggtctgtgaagtggaaagtcaatgttcttattcaatctgtgtctaatggtgtcattttgaggacaatggaaaacagatcatgtttgattccttaagatgtggccactgctatttgtggtacaatttgtgatctgagagctgcatgtaaaaaacacatgagcaaaaagaatatccagcacacaagggctggctttctgattctcagaggtatagtgacaacacagcttacctctgcattcaaagaagctagaacttaccgcggataatcattagtagaagacagcttaaagtagtgtctgctttctggctaggcctgattcacaggtgctgtgataaattcaaaaagacctgcctcctctgatgtgctagtatcaagggtgagggagacagttaaccaaactggtcaaaagcattgtcagcaaagacctggtgctgaatcatgttgggaaactggagtttggagctagagaggcaataccaagtatcaaggtctgaatgtccactttgtaaccactgtagtaataattgactcaaaaaaaaaaaaaaaagccatcaatggatgctaagaccgttgagcaaaacaagtattgggtacaggatatatcaccaccaatgctgggtgtgttagctcacacctataatctcagtactttgggaagccaaagtaggtggatcatctgagttcaggagttcgagaccagcctggccaacatggtgaaaccccatctctactaaaaatataaaaaatagccagacgtcatggcacatgcctgtaatcccagctactcgggaggctgaagcaggagaatctcttgaacccaggaggtggaggttgcagtgagctgagatcataccactgcactccagcctgggtgacagagtgagactctgtctcaaaaggaaaggaaaggaaaggaagaacaggaaaaaaaagacatgcagagaggacaaaccagaaaataatgagattggctacctacagtgggggtgtgtggaaacggggtagagatggtgagagaagcactacctctgggagtatacctttttgaatcattcaacttttgaaatcatgttaatgttttccccactcaaaaataatgaaaccaaatcaacagggattaggcagggggttggtggggtggaagatactaaaatagaattaaaacgaaataaatgaacctaactgtattttaaaagaaataaaatagccacactgaaaaggagagaaaaagacctttcccaaggaattctcaattacacagcactctgactatgtatcctcagtcggaagacaataagaattgtaaacaaatactgaattctaagtaataagtttgtttcttactgtagtatgggctaatactactgaaactattttttgtgtaatttaagtttgagcaaatacacaaccctagggcctacctgtagaagaaaatcaccatttgcaactatcataatagtaattgatttagtagtaaacatcattgaatgctaaaactagtatgtgaaaagtttgatgaggaacaggatatttacatggactaagagtatttctctgcaagtgacttactaatggaaaatggaaatagaaataattttacaatagacagccaggcacagtggctcacacctgtaatcccagcactttagcaggccgaggtgggtggatcacctgaggtcaggagttggagaccacggtgaaaccccatctctactaaaaatacaaaaagattagccgggcgtggtggtgggcacctgtaatcccagctactggggaggctgaggcaggagaatcacttgaacctgggagatggaggttgcactgagccaagaatgtgccattgcactccagcctgggcaacaagagcgaaactctgtctcaaaaaaaaaaaaagaaagaaagaaagaaagaattttacaatagacatacctggtgtataccaccttaaccaaatgtctgtaacgttatcaatcctggaacaaactagcatcagaaatgatatgatgtgctgaaaaagacgcatcacctctttagtgttcttgtcaaaaacaaacaaacaaacaaacaaacaaaaaacccataagctaaatctaatcataaggaaactttacacaaactcagattgatgggattctataaaatagctggcctgtactctccaaaattgttgaggtcatgaaagacaaagaaaggctgatgaattattttagattaaagaagactaaagagatgagactactaaatgcagtatgatcctggactggaacctaaactggagaaaaagagcccaaaggatattactgggtaatcggcaaaatttaagtagggactgaggattagataatagtattatatcaatgttaaacttcctaattttgatcgttgttttgtaatcaggtgagagactgtctttattcttaggaaattcaccctgaaatatctagaggtcaagggacatatctgcaatgttttctcaaatgtgaaagacaaagcaaaagaagcaaatgttaacggctggagaatctgggtaaagggtgttcagggattttctgatatttcttgattttttttatattcttgcaattttttgacatgtttgacattatattaagatttaaagtcacaattatttattgatttaaaaatttttttgggagacagggtcttgctgtgtcacccaggctggagtgcagtggcaccatcacggcgtactgcagcctcaacctcctgggctgaagcaatcctcccacctcagccttcttagtagctgggactacaggagcacatcaccatgcccagctaattttttttttttttttgtagagatgggcatctcgctgtgttgcccatgctggtcttgaactcctgggctcgaatgatcctcccaccccagcctcccaaagtgctggcattataggagtgagtcaccacacccagcgcaatgattttttaaaattaaaattgaaagagcaaaaaatggtataaggaatgtaactaaagataaaagaattttgttataggcagacagtgtgtctaaactgaaaacctaagagaatttacaaattatcttaaatagaatactaaatagttaaaatgatagcaaaatgattatgttcagaagggttactggctatcagatcaacttacaaatatcaatgatattccatatatgagtaataattagaaaatattaatcccatcatcaatagcaacataacattaaggtacccaagaacaaatctaacttttctagacgaaattattatcaaaggacctaacaaagacctgaacaaattataaatactccatgtgcatggagcaaaagactaaatactgtaaagaaataagtgatttcctaaatcagtctccaaattaaatgtaattccaatcaacatctcaacaggattgtcataaattgtaaaatcagatggaaaaataaaagtcaaaagatagctgagacaaattttgaacaaagaacaaggaggcgaagttcatcatatctgataacaaaatcatatgaaagaatgtggtatttgcacaaagatagaaataaacgtaagctgatcatgtgaatttgatacataatagataatgtgtctccaatcagtgggaaggaaagataactttctcagtaaatgacattaagtgagttgacatttcatagggaaaactaaaataataggctggacacagtggctcatgcctgtaatcccagcactttgggaggccaaggcaagaggatcacttgagtccaggagttcaaggccagcctgggcaacatagctagaccccatctctgcaaacaataaaaataattagccaggcatggtgatgtaggcctgtagctccagctacttgtgagactgaggcaggaggatcacttgagcctgggaggtcaaaactgcagtgagtcatgatggcgctactacacttccatctgggcaacagagaaagaccctgtctcaagaaaaaaagaaagaaaagaatggatccctacctcactccatattcaaaaataaattccaaaagtgtttacaaacctgaccatggaaaccattaaaatcatttaagaatatcttatttatggatgcagatgcatttatatgttacataaaatacaaagtttattttaaaatgtggactaagttcacaataaatttatgatagctgtcagccaggtgtggaagaggaagggatttcaactataagtgtgaaattttctcttttttttttttttaagtagggacagaatcggaatcaaatatgacaaaataattacatatgtttgactggtgggtagtggctgttttttggctttttgattttttgttttgttttcttttttagatggagtcaccctttgtcacccaggctggagtgcagtggtgtgatcttggctcactgaacctctgcctccagggttcaagcgactctcctgcctcagcctcccaagtagctgggattataggtgcatgccaccacactatgctaatttttacatttttagtagagacgaggtttcaccgtgttggccaggctggtctcaaactcctgggctcaagcaatctgccctccttgaccttctaaagtgctgagattacaggcgtgagccatgttttttatatgattttttatattcttgatattgatcttttgagttttgaaaaagaaaatattcatctgagtcttctgttccatgaaactcaaacctctttaattctttgtgatccactgttagcctcagtcactggctctgcagttgtttcccaaatgtttggctccttttccccctcataattactgtgggaatacagtgtacgtcacttaaaaaaaataaggcacagctttgctgtttatttacctagagctttgtgtttatgtttgttgagtccagtggatggtgccttggtgggtggattgctcatgacagaggatggacagcaatcttgggtcgtggagcattttggtggagaacacttgaggaatctgccaaaagctagcagctggtcaggcccagttagtaggattctgtactagaatcagagaaatcaccagccttcgaccaaatagggtccaaagcagggctctgcagccaagtgataacgggacttcgctgttctgaacttccccagctgtgtaaaggggaaaatggcacccacttcagagagaattgagaggatgcagtgagatgctgcatgtcaaatgcttcataaaccatagttctcttttctctttcacttcagttatacctcatgggaaccacttcagagtggactcttggagatccacaaatggggaagtcagtgtaacttggggagtccaagttctcacgtttctgaagtctgcagtccctattcctttttcaccacccagaggcatcctcagacatgagttgataagtcacgtctccagggacttttgagttcactttttcaaagtggagaaaggagtggttactggtgcaagcagcagaccctctgccttgtggcctcctgcttggaggttggggattctggtttcagacacagtccttccttgggttttactcatctgtaagggatcctgcttggcacagctctgttccaagaggtgagagccatctatgctgttgttcccagttaatcatcaacagaaccgtggcagaatggagacaggatgaagactgtaggcactagagtcaaaccaggtgtctttgaatcccaagtcaactccttagcagctagttaagtcatgttacttcacttccgtgtgcccctgtcaaatgagtatcatgatagttcccactcatagggtacttgtgaggattaaatgtgttaagcctgaaaagtgcacagaatagagctttgtacacattttagacattcagcatgttttaacacggccattgtttttcatgttttaacaactttacaaatgaaacgcatattagagttgatggcatgttacaattacaagtggcagcattttttctttttcggtggtatagttggtggcatcttagaatcaatgaattaattcagcatgatatctccttttgcataggatattgagatgtacatcatgagtgcatttcagtactgaatagtgtttgcatatcaaatgtgaacactgaactgaattctgccaaagtcaagtcattgaataataagctattcagttgttcaggcctggaaggttgtttgttaactttttccagggcactggctggcttcctaataatgcaaatgacttgatagaactctgaaaagggaaccattgaatcttcttccccttggacatccagagccatcatctttataaaatggatttcttactaaaaatccctggatgccatctatctgatacaccttcaaggacaaagtctcagctagtattttagtttttttttttttttaatgtggggcaaggggataataggagctgagcttacagaaaagaagttaatgatttccaatggacatgatttcaaagcaatttctgccttttgatgcgctgaaatcattgcttccatctgctcccctacttgtacacagggctctgctttttaaccatgcagtgtgtcagctgttgcccaccaaattctgcacttgatcttctgagactgatggcgattctctatgaataatattaagctattaaatcacatttaaatcctatttctccactaatacctattgaaggcctgtttatattccatcagatttttatggccatttggtacataaatttgttaaatataaacttcatggagcttcatctgaaaatgtttcatcttgttcccagtcctgtaaagacatggtcataaatacctttggactatgcaaaccattatctagagtaattttaattatctttagctatgccgatcagatgataataaatagatgttgaaaagcatcagcaaaatgccatcatggaagagatactcaggggtaaaaccaaataattgaccatttggtgctgaaacattttattatcattcctacaaaggttcagaaatctatcatgagattgggtttgttatgaactcaacatcaccttggttgggatgtcaaaactagagtaaattattgaaatgaaatatgaaacatattaaggaacgtcctcgggaatgaaggacactggaaagactgaattttctagtaacttaatttcgatctatgggtgaagctttgttttcagcacccagctatatttgcttggaaccatctgggtctcttggaatagataatgttaaaccagatacactagttgtacacgtggtatgtctttattgggggcttttggtaacagtttaagatagaaaaaaaagtattgctttaaaaaaaaagtgatccttggtactcacgggtaacaacattctgctttggctaagagtttacgtaactgcatactgttccctatttctttgttgttgttgttgttttgtatttttgttgttattgtttttcttttgagatagagtctcgctctgtcgtccaggctggagtgcagtggcccgatctcggctcactgcaacctctgcctcctaggttcaatcgattctcctgcctcggcctcctgagtagctgggattacaggtgtgagccaccacgcctggcttgagagatggaagatcagactcgatttgctcatgttgttcctaacctttattctaaactgataaaaatgtaaagtcatctgatttcaagactgattgttcccttgggtgttccttaattccctagaggccgagtaaattcttatggtttaaaggctcttcccccttgcttttctatactcccttgggtttgtttttaaaatgatagtgttctgaaccaatttttttttttctttttgagacagagtcttcctctatcacccaggccgtagagcagtggcacaatttcagctcactgcaacctccacctcctgggctcaagtgatcttctcacctcagcctcccaagtaactgggactataggcacttgccaccatgctcgcctaattttttaattttttgtagagatgaagtcttcctatattacccaggctgatcttgaacccctgggctcaagtgatgcccccaccttggcctcccaaactgctgggattataggcatgagccaccatgcctggccccaaataatttatataagccatttatcatagttcctgacatatcatagatgttcagtaaatatcaattatcttcctcaggctgagcatggtggctcacgcctgtaatccccgcactttgggaggccaaagtgggtatcttacttgaagtcaggaattcgagaccagcctggccaacatggcaaaaccccatctccactaaaaatacaaaaattagccaggcgcggtggcacacacctgtaatcacagctactcaggaggctgaggcaggagaatcacttgaatacgggaggtggaggttgcagtgagctgagatcatgctgctgtactccagcctaggcgacagagtgattgagactccatctcaacaaaaaaaggaaagaaaaaaacagttatcttcctcaatccctttgtgttaagttcctagtggaaatttgagaagtcctttattttacatttaaaagataggatgcttttaatggtgccttaattcatcgtacaagaaacatttgttaaacatctattcggcaccaggggttgttaggctggtggaagggacaggtactctcattgcaaggcagtggggtaggctctatggagaacacatgctagagggtgagaatgggtagacaggcaagatcgtgatgcagggagagactggtagagaacacaggagatttttgcagtagatcagatgatagagaatgcagcccgagatttaaagcagtgacagtagaaatagagaggagacgctgggtgcggtggctcatgcctgtaatcccagcactttgggaggccgaggcaggcggatcacgaggtcaggagatcaagaccatcctggccaacgtggtgaaaccccgtctctactaaaaatacaaaaattagctgggagtagtggtgcgtgcccgtaattccagctacttgggaggctgaggcaggagaatcgcttgaaccagggagtcggaggttgcagtgagccaagatcacgccactgcactccagcctgagagtgatctccagcactccagagtgagactccgtctcaaaaaaagaaaagaaaagaaaagaaatatagaggagagaattaggaagacagagagagattggtgcctagttaggatggagcaattagctcagtggtctgagataattcaggtttttgtaacgaatgggtgttcgtgctaccaactaaggcgaggaattttttttaagtggtttaggagatgccatggtgcccctcacccccaaattcctatgttaaaatcctaatcaccgcaaggtgatggcattaggaggtgaggcctttgaaggtgcttaggtcttaagggccccagagagaccccttaggttttaagggccccagatagaccccttgtcccttctaccatgtgaggacacaactagaagttgctatctgcccaggcatggtggcttatacctgtaatcctagcactttgggaggccaaggcaggcagatcatctgaggtcaggagttcatgaccagcctggccaacatggtgaaaccccgtctctacaaaaaaatacaaaaaaattagctgggcatggtggtgggcacctgtaatcccagctacttgggaagctgaggcaggagaattgcttgaacctgagaggtggaggttgcagtgagccgagatcacgccattgcactccagcctgggtgacaagagtgaaactccatctcaaaaaaacagaaagaaggtgctatctatgatccaggaagtgggtcctcacctgatgccaaatctgcctcgatcttggacttctcagcccccaaaactataagaaatacatatatatatatatatatatatatatatatatattttttttttttttttttttaccatgttggccaggctggtcttgaactcctgacttcaggtgatccatccaccttggcctcccagagtgctgggattacaggcaagagccactgtgcctggctaagaaataaatttcttttgttcacacactacccagtttatggcattttttaatagcagcccaaacagactgagacacgtgaggttgatgaattcagtttttgtccagttgagtttgaagtagtcacggaaaacttagtgaaataaccggtagggaatttggtatataaatccaaagccgagacctagagatacagatttggaagtcataaacgtagttttgaaagcatgagaacagaggatattacccaaaggatacatgagggataaaatgaaaagaagggcaaggatggaacctgggggaatattgacgtttaatgggagggaaatggaagagcatctcatagagatggatgagaaaggagcactctgagagttaggagaatcgggatgcctgggagtcacaaaggcccaggaaagtgagaacaccaaggaagaaattgtcaccagtaacagcaacagagttccgtgaacacagaatttaaaaggtcctgtgagaatgagcaataaggtcactggtgacctttatgaaaacgagagacatggtggagttagaagccagcttgtagtatcctttgatgcttggctgtagaaggaaggaaaagaattggatcagaaggggacttagagtggaagggagaagcctttgcaagatttcccatctctgtggaaaagaagttcatgttcgggtgtatctcctctgttccaaacgcatagcagtgacagataaaatacaaagagagaaagccaaagtgatattgctggactcgtggatcaaaaactcggaaggatgagggtagcctggattgactggaatctgggtcttggggtcaggcaggtattgatgtaggtcttttatggcaataggactaaaagtactcaatgcaagctgggccaccagagccagggtcactgtttgaaaaaagaggctggaggtaggcctccccaccctcttttcattctttcaggtgaaaggaacctgaaaagaatcccctgtgtctgatgcctgggccatggcttacagtagtagttctgctcttagaaggcaactgtaaaacctagagattggtgtgaggagtcagggagtggaggtggagaaaaaaaagcagcaacagtgacaataacaacaaagcctcccactcaaaaacgaccccgcaaatctaacattaatgaagacagccaaggtatcaacagtcagaatgtaaatctactgccgaagaaaataactttgtagacagacctgattaaaatagtatattcgggctgctcagagggaaaagtaaaggaataatgttcattttaaaagaatgagaaattaggaaccaaaaaagaaacaagaacagaggatttgaaaaagaaccagtttgaaattcagggactgaatcattgaaatgaaatctaagtggatcagataaactaggctagatacaactgaagagataattagtgaattggaagatattaatagtattgagaaatacaacccatttcatagcacagaaatacaaagaattttttaaatacatagttaaattagggagaaagaatgagaattgccatatagctaactcataggagcagaaaaatattaggttggtgcaaaagtaattgcgatttttgccattagttttaatgcaattacttttgcaccaaccatacaatggaggaaataacagaaaagcaatatttgaaacaataaaggctgagaattttctagaattgaagagagacataaatccttacatcaacgtatatttgagtaataacaataatggtaaacacttatttagcccttatgttccagaccctcttctatatgctttctatgtattaactcattaatcctctaatatcccttggataagagtaatttacatgtgagtaaactggaaaagagagaatgtgtgtagtttgcccaaggtcacacaactgggtggtgggatttcaccccaagcagcctggataccctctaatacttctctaaatcctaaagggattaaaaataaatctatacctggacacattgtcatgaaactgcagattatcaaagatttttttttaagagctcctctagaggaaagacagatcacgtacaaagggacaatcctcatcctaatagtggacttctcattagcaacagctggtcaatgaagacaatgaaaggagagattctaaaacccagggcaaggcatagaacacaagaaacaaatgtgggcctatcaaatgatacaatgttatacattaacttaactgtgaaatactgaggaaggagctggtaggccagtgagtttggagttacaagaggaagagcagctgggcaccccgtggctcatccctgtaatctcagcactgtgggaggctggagaaggaggatcactttatcccaggaactcaagaccagcctggacaacatagtgagaccccatctctacaaaaaaaaaattaaaaaatttggcaagcatggtggtgcgtgcctatagtcccagctacttgggaggctgaggtgggaggatcacttgagcccaagaggttgaggctgcagtgagccatgattgcgccactgcactctagtctgggtgacagagcaagaccctgtctcaaaaagaaaaaggagggaaagaaaataagaggaagagcctgcccccgggaagccagaaagtgaatggtcttcgtgaacctctgaaatagaaggaaaagcagggcaggcaaggagggggagaaggggcagagagtgacgagcacacgcagaaggtctctagtttccagtaatatgggaagaaaggtcatctcctgtaaaggaaggggtcaggaaagagggggctgaaggagggtaataaaggtcaaagataacctttatgggaaatggatgagaagcgtcaaaggattgcttgaaagtcttggcagtgtggtgatttgggaaatgttgaatgagtggtaccatcagcctacataattgtggcgttttcccagctgtgctttgcagcctgcgtgtaggagcacaggaaatggttgaattgattcaggatttgtcttcagggtaggttcagcaaagtatggaaaaattgagcaagtgaaggtcaaaatgagctttggagtccagtgaagactcttgggaattggagagcttggtgaggtcaaggagaaagtgtcctgggagtgagagtaagagaatacaggttggggttggagcaaaagtaactagagctttcagatttcagaagtggaataattccaggagattcaagaccccagtggagcttgaagggaagtggttagaggtggaatggaggtgaaggtcgttggaggagaaggaaaggaaaaggaatgaggaggctgggcctatagtgttgatgggctgcccatgtggacactgaaatcataaagatgtggatataaagtagggtaaagtggaatcctgggcatggtccagagagttcatgaagccaggggtcaggtggtctgtaaataacagcagtcatcatcaatcaccaatgaggcgtgtggctagaaagcaggggcctggaggaggagggccctggaaaagtgccactcattctacaagtgaccactaaccttgggaatttttttttggtggttggggggatggatcttgctctgtcgcccaggttagagtgcagtggtacaaccttggttcactgcaacctcgacctcctggactcaggtgatcctcctacctcagtctcccaagtagctggaactacaggtgcataccaccatgcccagctaattttgatattttttttttgtagagatggggttttgccatgtttcccaggctggtctccaactcctgggctcaagtgatcctcttgcctcaccctcccgtagtgctgggattacaagcatgagctaccacaccaggcccctgggtcacctcttacaccagagccagtgggttcatttgatcaatctgagcagtactcacaggattcaattgtcttctcacaccttttccccaggtttcaaagtcagagccacttgctgacttgagtgattatggcagggccccatctaatggcctttttgcaaagtacagctggagcaagcaggctcgcctgtgccccttttctcatcaaaagcaaggcaaagagggtatagattagactagcaggccccggctaggaagtaacatcttcaagagtaagaagtaatcatgatggcagccatgtggatattgactcataataatggtgatggtcagacggatattggcaggaatatttacatgagcccagcatcttgccaacctgtctttagatagccacagtctcatgaaatcttcacagatattaatatccccattttacaactgacactgaggcttagtgagagccagcggtctgcacagcctcacagctagcaagtgtcagatctaggactcaattctaggttagtttagccttggagcacgtgctctcatgtaactaatctgctgtctttggctctaaaaatgaaataagactgtaggtagagccaggcgcggtggctcacacctgtaatcccaacactttgggaggctgaggcggacgaatcatttgaggtcaggagtttgagaccagcctggccaacaaggtgaaaccctgtctctactaaaaatacaaaaattagctgggcttggtggtgcatgcttgtaatcccagctgcttgggaggctgaggcaggagaatcacttgaaccagggaggcagaggctgcagtaagccaagatccaagatggtgccactgctccaacctgggcaacagaacgagactctgtctcatagatttaaaaaaaaaaaaaaaactgtacatggagtcagctgctctaaagtctggttgaaagtttaaattttcacagtgaggaaagggaaataagtcactcccatcttaaagaagcattgtcaaaggaatatttttctccttccaagttttacagggaggcaaatattctgaaaggaattatcgtggtaataacatcccttacctgatttttttcaaaaacttttattactaggaattttctcagatgtaatgccatataatgggtgtttatcaactggaatagtgagggaaaatggctttccagccatgtgtctagtttttacacatcttcagacatggatggaaggcagagctgggttgcctcaattctgggtcaagtcagcttcccctggattagaaggggaggctggtaggctaatagcaggatgctggtgacatatgaaggaggggttgtttcttatgaaagcagattctcagagaaagaggatctgcgtaggaacaccagagagattggcctcaaagacccaaaagcaaaagaaataagttaaaaataaaacagtcctaggccaggcacggtcactcacgcctgtaatcccaacactttgggaggcccaggcgggtggatagcttgaggtcaggagttcgagaccagccttgccaacatggtgaaaccccatttttactgaaaatacaaaaattagccaggcgtgaaagcatgtacctgtagtcccagctacttgggaagctgaggcacaagaatcacttgaacccaggaggcggaggttgcagtgtgctgagaacttgccactgcactccagcctggacaacagagtgagactccctctccaaaaaaaattaaaatatgactgggcatggctcacatctgtaatcccagcactttgggaggctgaggcggacggatcacctgaggccaggagtttgagaccagcctggccaacatcatgaagccccatctctactaaaaataaaaaattagctgggtgcgttgggatgcgcctgtagtcccagttactcaggaggctgaggcaggagaatcgtttgaaaccgggaagcagaggttgcagtgagccgaaatcgcgccattgcactccagccagggcaacagggtgagattctgtctcaaaataaaataaaataaaacaaaacaataaaataaaataaaacaaggctaatgataaacccaggggctccttggcaggagcaaagctgaaccgagagctctattcctagagccctatgtctgaataatttatttttcctatctcatagtccctatgtgccttcctcagctgagatcaagtgccaaaggacatctcaaaatacccacagccaaaacttctcagcatagctccctgcatggagaaggagacagctctgcaagtctttgtcctgaaccgtttacggattttccatggtctgcaagaccttggactcacgccgcctgccagctggcagccgctgtccagcctgggaacagagcttgctccggcctgtggcgagtcctcccggggcttatcgtgaatttccccggttttgcatcttcatcctgaaaacctcccgacctttccttaatgaagattttagctgggggaaattgcattagtggctcgtgtttttctgtcaaccttctaaattatgttagttgtaagtaaaaagagtacagtaagtccttttatccgttgtgggctgttcctgggaatcataatggacaataaaataataagtaatggacaggaagatgctcttagaaccagttcggaaaactcttccagtgccagacagaaaccagccacctgcgccgttatcaggacatcaagtgaagccagtaaacacttgtggagctccttttaagtcccagcaccaaagaataatacctaacacttctagttaagagagcatcgtactgagtattatctcagttaatattcataacagcacataagttcaatgctcagtttgcagatgagggaactgtggttgagagatgtttttaatacactgcccaaggccacacaatgaatagctgacaaaactgagatctggggtcttttgattgtgtgtctttctctctccacactccacctcagctgctcagaagcagatcctggggccagaatggacctctgtaggaagcctcagagatggaagctttctgccctcaactggctgactgaattgatggaacagtgggtgataagcgagggaattatttcgtagtttggttgaaaaaaagtcttcagcatgtaaatatgtcttacataagtcatgaaaaatgggactgaaagaaatgagagacaagagggaaaagacagaagtattttctttatcaaaccttggggaaaagcatcttttcctcaaatacccaatgcagtatgtatggtttttgttgttattattaagacaagggaccctttttttacccagacccaaattcaactgccttcaaagagatgggacaatgttcttagagagtgaagtttcgcactgaaaaccagcttttccaaagagctccaaagagcacgtttaaattcggctaagtcggagacgtttgcagatgcaggcctgagacccctggcccacacttggatgacgaggcgtaaagtgaggaccctttgcctgtaaggctgtgtctccatctcagaaacctatttaaagccgaactttataatggaaacacagccacaacctgctatcagcaaccacgatattaaacaggcatagagccaatagcagtggcgtgaagccagcgaggaaagattagcatcacaagtaagagattttaggctcagggccagaagagggtttttttttttcttcttccctttttattaaaaaataataataaaaagggagagagaaagaaataaaaagaggtggaaaggtgcaaaagaattcctgtttagccaccctccctgagattgttctccttggttatccagataagtacagaaacaaaccactgcctgtctgaaaacctggcagtcgcttgaccttaaaatggtctctgcaataacccttccaacctgctccgctctcctgtccttggctggcccatgtgcagaatggagcgtgtgacctccagcacggggaaagtaataatcagtaaggttcatattttccacttggagttagaggaaagaccatgtgagcacaactttgggttgctatctttttgccctgcgctgctgtaggaagagacatgcagtggttggaagtctccctactggcagagcgtcgttccagcacccagtttgactttgtgcaagatggtgcttttctgactacctcctccctttaagctgcagccttctgaaatctcagctttcaggaaaggatgccagccccaggagttataggatgcagcagagcaaaggtggcattttccaggtgagcttcgggactgccccccttgggctctcccatccaggccatgcagtgctgactgcccatagcttgaccgctgcagatggacagggggtgctctgttgtaagcaactctcagaggctaagtgacgtgctcaatcttgctgcttgctccaaaccagcacaagattttttgtagccttcttttacacttcttatttggaaaatttcaaacctacagagaagtttgtaagaagagtgcagtgattctggattcaccaattgttaacatttttctccatttgctttgtctcttcctctccatacatatttacatcatttcccccaaccccccagaaccctttgagagtcatatacagacatcatgactccttaacttttttttctttcttttttttttttttgagatggagtttcactcttgttgctcaggctggagtgcaatgctgtgacctcggctcactgcaacctctgcctcccgggttcaagcgattctcctgcctcagcttcccgagtacctgggattataggcgcccgccaccatgcccagctaaatttttgtatttttagtagagatggggtttcaccctgttggccaggctagtctcaaactcttgacctcaggcgattcacccacctcggcctcccaaattgctgggattacaggcatgagccaccggccccggcctgaccctttacccttgaatacttcattgcgccctaagaacaagggctttcccttacgtaaccatcgtgcagtgcttaggttctggaagcttaacattgatacaatactattatctgatagagaggcatatttacatcttgccgattatcgcaaaatgttttttcaatagcaaataaaaactttaagaaattactaaatgtcaattaaaaaaaaaaaacaaaaaaaaacaaaaaaaaaaaaccacttcctaacttgcctagctactcaggaggctgaggcaggagaatggcctgagcccatgtgttcaagtccaacctgagcaacatagtgagattctatctcttaaaagttaaatcagtaaataaataaacattcatgattcatgttccagtagaggctcacacattgcatttaattgtcactttctttagtctcctctttaatctggagctgtttctcagcttttttttttttttttgagacagagtttcactcctgttgcccagtctggagtgcaatggtgcgatctgagctcactgcaacctccacctcttgagctccagcaatcctcccacctcagcctcccgagcagctgggactacaggcatgcaccgtcacacctgtctagtttttctagttttttttttttttttttgtagaaatgaagtcttgctatgttgcccaggctggtctcaaactcctgggctcaagtgatgtgcctttctcagcctcccaaagcgttgggaggcatgaaccatcacgcccggcctgtttctcagcttttctttgtctctcgtgacactgacattttgcagaacactggctggttttgtgcatgtccttgttgctgggttttccccattgtgttctcatgattagattcagactgtgcatctttggcaggaattctgtattagcaatactgagtcattgtggactttcagaatatcctttccccaacatgcatggcttccctgtgattttatttatttatttatttatttttattttttgtagagacagggtcttcctatgttgcccaggctggtctcgaactcttgggctcaaactatcctcctgcctcagcctcccgaagtgctgggaacacaggcatgagccactgtgcacagccttccctgtattttattttctggcctttgagaagactttagcctcccctggtttcccaagctgtgttcatcacagagctggtgtcggaggcctggtgggagagttggtcatgttcttcttcttcttcctttttttttttttttttttgagacagagtctcactcttgttgcccaggccgggtgcaatggcgcaatctcggcttactgcaacctctgcctcccgggttcaagtgattctcctgcctcagcctcccaagtagctgggattacaggcatgcgccaccatgcccggctaacttttgtattcttaatagagacgggatttcaccatgttggccaggctggtctcgaactcatgacctcaggtaatccgcccacctcagactcccaaagtcctgggtttataggcgtgaaccaccgcacccagccagtcatgttcttctaagcactggagaaaaaaggacagctgcctgtgctgaaaagtcaccccaagagagagcaggaagaatcccaaagcagaggcgacagtggactctttctatcctgtgctctgagtccggcaaactgttgatgaagccctcacggggtcattcacagcagaattggatctggttagatccaattccaaaaaaaaaaaaagccacatcccttggatccaggtttgctttttgtacccaagcttgggcattccatttggatggttttacctcttaaatattacatccatcctacttctccattccggctaccatggccctagttaaggtgtttatttcttttctagagcaatctcacactaaacccatatctcccacagagctatctgcccagggaatccacgtagacttcaaatctgatcattttcacagtgactggcacccaagaccttctgtcgcccggccactactttcctctgtcgttccgctattccatgctccctgcctcaaacataatatgcccaaaatatcaggtcaggatacgagagtgttaagtgccagcattacctgggagcttgttaggatctcaggccccaccctagacccactgaatcggaacctgaatctaagcaagcaagatttcccaggtgttgtgtgcgcatgaaagcaccggaggcactatctagaacctgctggaagggcctgttctgtgcaaggaacttaagctgcccctcaggctctgtggtccttggcactgaggcaagattctcaaaataatctctgattcaagggattccgctccgaaaattacattggaaattgtttttcctaatttgcataaataaataaacttagtaaatgggcttcatctgatttttacttttttctcttacaaattcttttctaaactttgggccaggcgtggtgccggcacacatcagcattttgggaggctgaagccagcagatcaccttgaggtcaggagttaaagaccagcctggtcaacatggcaagaccctgtctctactaaaaatacaaacattagccgggcgtggtggctcacgcctgtaatcacagcactttgggaggccgaggtgggcagatcacaaggtcaagagattgagaccatcctggccaacatggtgaaaccctatctctaccaaaaatacaaaaattagctgggcactggggcatgcgcctgtagtcccagctactcgggaggctgaggcaggagaatcgtttgaacccgaggggcggaggttgcagtgagccgagattgcgccactgcactccagcctggcgacagggtgagactctgtctcaaaaaaaaaaaaaaaagaaaaagaaaagaaaaaaatattattttctaaactttgacatctgctgctacttgttggctaacaagatgtcatctgctggcaaacaaaatgagtaaactactaggaaataaatggtaatgttaaaattcaacatacctggtgttcagtctaacagttcagttcaacaacagcaaaaaataaaaattaaaactttgagtgttaagcttctattaatgtatgagatactagaagaaggtctgagggatgcatagatgaatgagatatattgtatagcttattccccatgactgtaaggccacatgtgcctgtagtactggggcactgaatggtacttcagcaatgaccatccttttattagaatccttgggatgctactagtctggatttgcagaattcaccaaaatgaatgacttttgctattacctgtcaagttgatttcatcttctgtgtccagacagctatccaaaccaatataaccaggaaatttactctggattcctcagatcaatagatgaatggttttgttgttgttttgttgttgtttgagacggagttttgttcttgttgccctggttgcccaggctggagtgcagtggcgtgacctcagctcaccgcaacctccgcctcctgggttcaagcaattctcctgcctcagcctcccgagtagctgggattacaggcatgtgccaccaccacacccagctaattttgtatttttagtagagacggggtttctccatgttgatcaggctggtcttgaacccccgacctcaggtgttccacccacctcagccttccaaagtgctgggattacaggcatgagccacccggccaatgaatggtttttaaaacaaaaatcacaatgagcctgttgccttttattggctttggttttaggaggagaaactttaaaagcttggagttgaaggataatggttcaacctttcttggcgtgtaagtgatttatgacctcctaatttaacgaaagtaacaacagcgaagacaagccacttattagcgtttcctggcaattccatcagggagataggggttggggccttgagagcccaagaattaaacaacagctgaatgttattcaaaatctaaattcattatacacattgttgctttactaaaatctttactaaaatgtgatcaagaaagccttggcagggcacggtcttgaaagatgagtaccaactcatcttgggcaggcagatatcttgccaggcagatagggtggggagagccttcagggcaagggaggagcaagggcaagagtcttgaaggctgaagagtgagcaggatgtggagaggaagtttcaggctccacagggtcatgggggcaggcccagagcaaggaagagagaaaggagggtgatccagggaggtgagttgatgagaggaggcagatgtactaagtccatacatgagtgcagtatttgacagtttgcaaagcaccttcatacccactatctcaccaggtcctgctagctcagtgatgaggtgggacacctaacgtcctcacttccaggtgatgaaatggaggcctggaggagtttctaaagtcgtacaactcctaagtggtggagccaggattagaatgagatattttgacctctggacactgctctttccaccataaactgatatgttccaggagcattgaagaaagcttcctagcatattgggaagaaaactcatggttggggtgtggctgggtggatggatgggcggatggatggatggatggatggatggatggatggatggatggatggatggatggatcaatgggtggatgtggagatcagagtctcaagagaaaaagagttaagagtccagcagttgtgcaggtgagatgggggattcaaacgtctatcaggaaggtggatttgtgagatacagaggcagtggagtgaatagaacttcatgtctgaccacatgtgagaatgagaaagaaataagagtgtaatggccggacacagtggttcaggcctataatcacagcacttcgggaggctgaggtgggcagatcacctgaggtcgggagtttgagactagcctgaccaatgtggagaaaccctgtctctactaaaaatacaaaaaattagctgggagtggtggcgcatgcctgtaatcccagctactcaggatgctgaggcaggagaatcacttgaacccaggaggcagtggttgcggtgagccgagatcacgccattgcactccagcctgggcagcaagagcgatcaaaaaaagaaataagaatgtaggataacacccaagttttgaccttggatgattaaaggaccacaaaggaaaacaaacttaaaccttacagccaaagtggtaaaggtagagatgatgaatgttaacttcgaatatgtctaatagtcagttgatatcaatggatctggaattcaggaaaagtgtctgagatatccaggagattcattaggtcatcagcgatcaaaggttagcattttattatagatgttcactgtgttattataaataacgttaaaaaagagaaaaataaaaaggaaaggtcttaaacatgtaacagttgcagattggctcatttatgttacagccatatattgaaatgcaattcagaccttaaaaatgagtgctggctttgggaggccaaagtgggcagattacttgaggtcaagagtttgaggccagcctggtcaacatggtgaaacctcatctctaccaaaatacaaaaattaaccaggtgtagtggcatgtgtctgtaatcccagctgcttaggaggctgagtgaggcaggagaattgcttgaacccaagaggcagaggttgcagtgagctgagatggtaccactgcactccagcctgggcaacagagtgagactccgtctcaaaaaaaaaaaaaaaggagtgctggtttaggaggtcaatgctggaggatcacttgagcccaggagttcgaaaccagtctgggcaacatggcaaaaccctatctctacaaaaaaaaaaaaaaaaaaaaaaaaaagtagcctatattcccagcaactcaggagaccgaggtgggaggatcacctgagcctagggaggttgaggctacagtgacccatgatcgcgccactgcactccagcctgagcaacagaacaagactctgtctcaaaaaaaaagaaaagaaaagaaaaagaaaaaagagcgctaggcttgtgggtgctttcccttccttggtgatactaacatctgtcgctggcagggtacttcccagcccagatcaaaatgaagtgggctttccctactttatgtcctcagatcttctctactacccagtgagggacgaactgacactttattacggaatcacagatgagattccagaataaagattctttattctttccaaaataaagaagtagtatgattgtgataagaaaaaaggagaaaagaaaatgttattaaaaaaattggccaggcacggtggttcacgcctataatcccagcactttgggaggccaaggtggggagttttgcttgagctcatgagctcgagatcagcctgagcaacatagtgaaaccgcatctctactaagaatacaaaaattagccaggtgtggtggcacatggctgtagtcccagctactcgggaggctgagggaggagaatcgcttgaacctgggaggcagaggctggagtgagctgagattgccccactgcactccagcctgggcaacagagtgagactccgtctcaaaaaaaaaaaaaataaatatataaaataaataaaaataaattaaaaatgacatcacagcccaggcacaatggctcatacctgtaatcccaggactttgggaggttgaggcaggaggacagcttgagccccaggagtttgagagcagcctggggaatatagtgggaccccgtctctactaaaaaaaaaaaagtttttaatgacatcacagacgccagaattgattcacgagagtatatgtgagagctggtctatgaaggcaagagtggcgggtttctccccattggggaaaaatagaaacaacaggcccacccaggggcctcatacctaattctaccacaaccctgggaagggctctggaagccaaaccctccccacatgctagccccagcctgtcttacccgtgcctggagggttccttctggagtcttctgggcagctgccctggggagcaggggcccgtggagctcagccaggaggccttgcgtagtttgccttgggaggttattacagccaatccacatagatgcgaaaaccaaaccaaacacagcctaccaggaacaagtaacgatttgttcctttcttttgctttttctgacagtagatgcaatctatcgtgattcttaagtgtttttgggctagtgcccattccattgtttttgcccagagaggctcaccaggaatgagctggaaggagacacaagcccctaagtacctcgggacgcttgcttggtgaacaagaggaggaaactcagagagcagggctgccggcctccttgtctttcgatgcctcgtgtggccaccccaccgcacgagccatagccagccatctgtctcagtatttcattctcttgaggctgagctagtgtagtggctgtgtcaggaaccctgcctgtttgtgcaaagaattcattcttccaagaaggatgaggatcaaattcacctccacatggcacacaccgaacaccgaggctgtgaaaggctggcccgtgagtgtctccaggttcaatatcgatttgtcaattgtagagaaaaccagcagttctagttcccagagaccaccctgtgaattgaaataagaaggaacggggagaaattggagctatttttaagctcagcttctgaggcttattttaggaggcattattgatcatacttcggggaaaccgttctgcgtcgctggtgccagtgtctacatgtgcacatgtgaagtgttggcctagactcctgagaccatctgtgtgcccaagggaggctgcagcccagaggagaattcggactgaggctactttgcaccaaaattaggccaaactcatgaaagggccattgttgcagctgccctgggaactgtaacttagaagtgattttgtgcccttacagcctctttagtaaatgaattgagtcatagcatttgtgatccttccgcatgtactttggtacttttctgtacttttctgtcctcttttttgtttgtttgtttgtttgttgagatggagtttcattcttgtcgcccaggctggagtgcaatggcacgatctcagctcactgcagcctcagcctcccgggttcaagcaattctcctgcctcagcctcccgggtacctgggattacaggggtgcactaccacgcccagcaaatttttgtatttttagtacaaaatgggttttaccatgttggctaggctggtctcgaactcctgacctgaggtgatccaccagccttggcctcccaaagtgctggggttacaggcatgagccaccgtgcccagcctctgtcctcttaatgagttaccatgatctagggcacctgattagaacgttgtttttccaaacagcatctttttctcatcggtcactgtatcactctgatcactgccccttgaatcttcttcctcaccctttatttcacccagatgagccagggtttaccgtatgtgggacttcaggtcatggcacaaaatggttctcaacccttttgttgagcaccggtttgctggtgctctttttagacacaaaccctggaataaacgtgccctttccctcaaagggaccccactgtggattcctatccactttgttatcctttttactcttagatctctgcctcaccactttcccaggcagcctctgctttttcatcttactgttctcattttcgcctggtgcgttcgtcagcggctttttatgttaaacttcgcagatgagccacgcctgaagttattcctgtccttctttctctccggtgtattgttgttgacaggtttttatctgttgttttgaattttctgtgacctttggggtgggcagagaaaaaaaaggacaaatgtccaccatcggccggtctgaacgccacatttaatgtgttctttttgagtgttctaacccttccttcttcctgcacacatttaataacagagaaccaaaaaaagcctagttgccttcattcatgaatatttgggacagtgaggcctcagggaaggccagcttttctggctacagggacggtcttaatctggagaatggaagaaagaggtcctttaaaaaccagagagttggctgggcacagtggctcatgcctgtaatcccagcacttcgggaggccgaggtgggtggatcacttgaggtcaggagtttgagactagcctggccaccatagtgagaacctgcctctaataaaaatataaaaattagccaggcatagtggtgcacacctgtaacccagctatttgggaggctgaggcaggagaatcacttgaacccagctgcagagtttgcagtaagctgagattgcaccactgcactccagcctgggtgacagagcaagactctgtctcaaaacaaacaaacaaaattaaacccagagagttgtaatagtttcccagggccgccaaaacaaatcatcacaaattgggtggtttgagacaacagaaattgattctcttgcagttctggaggccagaagtcccaggtcaaggtcaggctcttggggatgatccctccttgcctcttccagcctctggtggctccaggcgtttcttggctcagggctgcaacactctaatctctgcctctgtctttacatgactttcatccccctgtgtgaactgccctgtgccttaatcgtatctgtgtcctctcctcttcacataaggataccagtcgtcagatttaggagccaccctaaatccaggatgacttcatctcaagatccttaactaattacatctgcaaagaccctatttccaaacaaggtcacattctgaggttcctgggagacatgagattcggggggacactcttcaacttactataggagtattgatgcctctgcctatagaggagaatcaatatataccatacaacccagcagtcctactcctgactattgaccctatgaaaatgaaaaccaggccaggtgcagtggctcatgcttataatcccagcactttgggagaccaaggcggggggtggatcacttaaggtcaggaattcgagaccagcctggccagcatggtgaaaccctatctctacctaaaaatacaaaaattagctgggcgtgatggtgcacacctgtaatcccagctactagggaggctgaggcacgagaatcacttgagcctgggaggcagaggttgcagtgagctgacatcgcgccactgcactccagcctgggtgagagagcgagactccgtctcaaaaaaaaaaaaaaaaaaaaaagatatgtataacttttattggtggttgccagtttcttccttgtatttgactgcatttttcgaattaaaaacatcttgttcctggctgggcatagtggctcacgcctgtaatcccagtactttgggaggctgaggcaggtgaatcacctgaggtcaggagttaaagaccagcctggccaacatggtgaaaccccggctctactaaaaatacaaaacttagctgggtgtgttggccagccccccataaacccagctactcaggagactgaggcaggagaatcacttgaacccaggaggtggaggttgcagtgagccaagatcatgccactacactccagcctgggtgacagaacaaaactccgtctcagaaaaaaataaaaataaaaacactggccgggcgcggtggctcatgcctgtaatcccagcactttgggaggccgagacgggcaggatcacgaggttaggagatcgagaccatcctggctaacatagtaaaaccccatctctactaaaaatacaaaaaagtagccgggcatggtggcaggtgcttgtagtcccagctactcgggaggctgaggccgaagaatggcgtgaacccgggaggtggatcttgcagtgagccgagattgcgccactgcactccagcctgggcgacagagtgagactctgtctcaaaaaaataaaaaataaaaataaaaaataaaaacatctagttcctgagaaactttttaaaaaagaaagaaaagcaaccaaccctagaggatatgctttatgccttctaacaggcatgtccatgaaggggccagattgaacagtttaggagtccaccacttatttctgtgtgctcaaactgggaatgaccatgatgctgaatttccctaaactcctatcttgccagccttcttggcaaagagttctatctggaagtttaagtagtttaatttaatagagagaaatattattcagtgactcggaaaagaatcaggcaagcctcccttcccgacaccatgaatacccacgttttttaatcggctccctcaaggtgacccaagatccaggggctcttttctacttgtgcttcttggccccccaaggacccccacaggcattctcactctactgccaatcactccaccaggggctcaacatccctctctggagccctagccaactctgtgtgtgccagcgtcctcgcttactgccggggatccaaggacaacatgcacagtgcccgcagatgatgctgagggcagccgccttactccaccccaccttcatctctgatcaaagcttttccaccatcaggtgctcctctgagagctttctcctcccctccccgctcccagctcaccccccacccccacccagtgccatctgcagtgccatctgcccccagtgccatctgcaggcttgtgggtgtgtgtcaatatttcacccagcttgtctgcagcggtgtgccactcttagcctcagaggagtcctcacatcgccagctcacacccctgagagcttgaccatgtcctcatgaactcaccgtccttcccaaaatcccataactaaaacagcctggaagtgtcaccaaggcccaaagacagccttctgaagattacttctcagtctcttagcctcccttttcctctcctctgcttcaagccctttatttatttgtttttgttgttgttttttgagacagggtctcactccgtcttccagactggagtgcagtggctctgtcacagctcactgcaatcttaacctcccagactcaaaaggtcctcctgcctcagcctcccaagtagctgggatcatagatgcttgccaccacacctgacgaatttttaaaatttttgtagagacagggtctcactatgttgccccggctggtctcgaactgctgcacgtaagcaatcctcctgcctctgcctcccaaagtcctgggattacaggcgtgagccactgcacctggccttagaaccctttaaaactcacacccagtacactggagggtaactgagctgtcactgaaaggacacaggacagtgtgaggaaaacagaagggcacagcaagccagtctcgcggagatctgcagaggtgttctctggagctccccttccaacccctcacccttctctatccctgctgcataggcttgtcgccacctcactggggacagaattttctcagacactctcaggcctgaaacctttgccttcagtttgctttacaactccctgctggctctggaaaaacaattttcccctctgcgccaaaggcctaatgatattgtccaccagaaagggttctccagagaagcactgaagtttacccagcagctaagacgatccggcctaaccctgatggatgagtttcctttactcagccttaatacccctgaaatcctgtggcaagtggagcgtttgatggggattaaataaaagcagtttacctcccactgtattaccaaatggggtttcaattccattctaagaccaaggtcagtacgggagtggatctggggtcatcactgccctagagccccggcaccagtaggcagttctctggggcccccacatggaaacctcagcagccctgagctatattcctggcctggcgtctctggaccacactgcaggcacgatgtggggttggattctttcttcacgacaccaattggccagtctcttgtatcacccctgctggccaaataatcatcttggaccccgaccattatggacctatattgagttccctccttgctgaatttggactactagagtactcttgtctgaagcacattttattttattttattttattttattttattttattttattttaagacaaagtttcactctgtcacccaggctggagtgcaatggcgcgatctcaggtcactgtaacctctgcctcccaggttcaagcgattctcctgcctcaacctccctagtagctggtactataggtgtgtgctgccacacctggctaatttttgtattttttgtagagacggggtttcgccatgttggccaggctggtctcaaactcctgacctcaagtgatccacgtgccttggcctcccaaagtgtttggattacaggtgtgagccactgcagctggcctgaaacatatcttttagtactttagtaatatatggattatatgtcatataatatcgattaaattgtgtattaaatctagtctccacaaaatcatagcccctttgagagtggaccttctcttacacatttttccaaggcacagtgttgaacacacagtaggtgcttaaccaatatttgccaattcattgaatggtgggcattcggcctcttcatctctagagtgctgtccttaagtacagtaattctatcttaagaacaaataacagttacccaactctgtcttctgcaaaacagaaaaaagaatagagaccaaaaatggttctgaggccaggtgcagtggctcacacccgtaatcctaacaacactttgggaggccatgacaggaggatcactttagccaggagtttgagacgcacctgggcaatgtagcaagaccctgtatctatttgcaaaaactatgattacttttgcaccaacctaatatttaaaaaaagactcactcctgtaatcccagcactttgggaggccaaggcaggcggatcacgaggtcaggagatcgagaccacggtgaaaccccgtctctactaaaaatacaaaaaattagctgggcgcggtggtgggcgcctgtagtcccagctactcgggaagctgaggcaggagaatggcaggaacccgggaggcggagcttgcagtgagccgagattgcgccactgcactccagcctgggtgacagagcgagactgcatctcaaaaaaaaaaaaaaaaagaaaagatagtggttttgaagagacccataaagagtatcttttttattcctatcttaatgaccatgtagaagacaagttgaaatactcttgggttggattgtatattcatatatatatatatattcataaatagtcatgtatatatttatgaaacagtcaccactgaattgtgtagctgggataatgttctcagtgagatgacccatagagatggttttcatcattggtggtagcctggacttttttttttttttttttttacagccattagtgcttttcaggctctctccaactgaatatgctgctattagataataatcaataaaccatgaactggccaggtgtggttaattccagccctttgagaggctgaggcagttggatcacttgaggtcagaagttcgagaccaggccaacatggtgaaaccccatctctactaaaaatacaaaaattagccaggtgtggtggcgcatgcctgtagtcccagctacttgggaggctcaggcaggagaatcacttgaacccaggaggcagaggttgcagtcacgccaatgcattccagcctgggtgacagagcaagactctgtctttaaaaaaaaaatagcgataataataataaaccatgaaccaacactagacccatatgcttaaagtattaactagcagccagtataccctccctccaccaaaccagtagccactttgccggtgcagagcatgagcgggacaacattgttaaaacatgaattctgcttccagtgttcctgctggctgaacctgtactttgttggcgtgtcttcctcaattgcttcctccagcgagctcccaaaagccaaaaaaaaaaaaaaaaaaaaaaagttatagtagagaggatcagtggtttggctaggcttctctgtctctttaatcgtatctgaagcataaaacaagatgactggtagacttttctcaaaatccctcctaatcagccacctctaccttgtatcctcagtagcttgtacagatggcaggaagataaaaatctacacagctactaggcttgcaccttccccaccacctgcccagcccttcaatttttagaggataatagattttcttttcttttcttttcttttttcttctgagatggagtcttgctgtgttgccctggctgtagtacaatggcgtgatcttggctcactgcaatctccacctcccgggttcaaacgattctcctgcctcactgagccttcccgagcagctgggactacaggcatacgccaccatgcccagctaatttctgtatttttgtagagacggggtttcatcatgttgaccaggctggtctggaactcctgacctcaggtgatccacctgccttggcctcccaaagtgctgggattacaggcatgagccaccttgcccaccttagattttattttctagagcagtttaggtttacagaaaaattgtgcagaaagtacagacatttttcatctaagcctggatcttaaaccatcaaagtttctgttgtagagaaaagagctgcagaattcatgattcccaaaattgtggatttatgaagagccaccctacatcgtgatcttggtggattttatctagagaaatcaccaaatctagaaacaaatctagaaatgaagcaagagcaattgcaaaatttagaaaaacacttctgttcaaagagaaatctaggctgataagacacattccatgcttatcagtgtacctgtccctactcaattatcaccacacagcacgtaatagttcatgaaatggatttaccttaatttatttggcaattctcccatagtaggatatttaaactgttttcttcctttttcaatcttatttttcttgacattataataatgttgcaataaaaatatttgtgcgtaagtcttttcctttaagattattttctttttctttctttcttttcttttttttttttttttcctcagggtttcactctgtcacccaggctggaatgcagtggcacactcacggctcattgcagcctccactgcctaggctcaagcagtcctcccacctcagcctcctgagtagctgagaccacagatccatgccaccacacccagctcatttttaaattatttgtggagacaaggtatcactatgttgtccaggctagtctcaaactcctgggcttaagccatcctcacaaagtgctgggattacgggtgtgagccactgtgccttgccaagattcttttctttctttctgttttgtttttttgtttgttttgttttgttttgttttttatttataccgagtcttgctctgtcatgcaatcttggctcagtgcaacctctgccttctggatttaagtgattctcctgcctcagctcttgagtagctggactacaggcacccgccaatatgcccagctgatttttgtattttttaatagagactgggttttgccatgttgcctaggctggtctcaaactcctgacctcaactgatccacctgtcttggccttccaaaagtgctgggattacaggtgtgagccaccatgcctggccaccaagattcttttcttaagataaattctcaaaatgtaagcttactaggtcaaagtatatcaagatttgtaagacacttgatacttattattcttaatactttacaaaaaagagaaaattactcccttttaattttggaatctataacatggtaattattcagatttgccttccccatgtagcatttctaggttcatatttaaaggaatttttcctactgagcagttattcactctctagtgtgtgtatggcgggggtggccacgggagtcaaccagattgacaccaaaatccactgcagatgatttgtgggtagaaagtagaagggaaagaggataaacacttttccttctccctgtctctgataaatagccaaagacaggaacattattacaggtgatataggaaaagtgcctccgtgacctcccacacccaggtcccatctcaggagacaaattcagcccaaggagcaaacgagaccatgaagttcacagcactccagtgtcaggtgcccccctgtaaagctttggcttgatgcaacaacaaaaggcattcgcatcctaacgtgacctcagcagatctcttcctccacctccaagagccgggagttgtaccagagctctggcagctgcacctgccaccaccggggagcccaaatgaatcattgctgtggctgagtgttttcctttggggcccggtgaagccactgcttgtttttaatggtgttggcttaattctggctcctgccctgaactgagtgtgacgataagaacatttcaccttgtccctgctctccaattacaccacatcaggaccgctgccacttcccactgctccgtggcagcccctctatgtaccacccaagttggctgactgtgggatgataggacagagaaggaacaagccaaggagcaagacagaggagactaacaggacgcagaggccactcttaacaccacaggctttttaactgaaaggaatgttaatggtcacctgggtcacttgatctcagtctccttagggccacagatctctgatgatcagatgaaagtggtcgaactctctttccagaaaaatacgccttctcaaatttcaggatgtctcccagaatccctgaaacccattcatctagactaagttgtggtttgtttgttgtttttttttttggttttggttttttttgagacaggatctcactctgttgcccaggatgaagtgtagtggcgtgatcttggctcactgcaacctctgcctctcggctcaagagattctcatgcctcagcctcctgagtagctgggacaacaggtgcacatcaccacgcccaactaatttttgtaatttttatagagacagggtcttgctatgttgcccaggctggtctcaaactcctgggcttaagccatccttgcactttgacctcccaaagtgctgggattacagggatgagccgctgttcccagttagactaagattttaatttacaaacaaggacatggaggcccaaagaacatgcaggaattagcccaaggttacacagaaaatttactgaatttacttatttatttgagacaaagtcttgccctgtcgcacaggctggagtgcagtggtgtatctcagctcactgcagcctccacctcctgggttcaagcaattctcctgcctcagcctccctagtagctgggattacaggcacatgccaccacacccagctaatttttgtatttttagtagagatggggtttcaccatgttggccaggctggtcttaaacttctgacctcaggtgatctgcccacctggcctctcaaagtactgggattacaggtgtgagccaccatgcccggccagataactgaatttaaactcagctctcctgattgccaatgtaggacccatcagcccatagtaggaggctgtcaccctgcactgagccctgtggcagcaattgtgggaaattagggtgcttacaaccaaggaaacaggatctcagactcatgaaaaaaaaaaaaaaaacctaagatcaatgagtaagcaatattcctgccatagagtcctctttggaaagtagatgctaatgccttctgttagttctccaggcacttattgagcacctatgaacatctcttaagctctaatcactgggagattcattatttattagaaattaaaactcgcctgtaatcccagcactttgggaggccaagatgggtggaccatctgagttctagaccaccctggccaatatggtggtaaaaccccatctctactaaaaatacaaaaattagccgggcgtggtgacaggcgcctgtaatcccagctactcagggggctgaggcaggagaatcgcttgaacccaggtggcagaggttgcagtgagccgagatcgtgccatcgcactccagcccgggggacaagagtgagacttcatctcaaaaagaaaagaaattaaaactcatcatctcaagcctgaagaggatgttgggttcctcaatgtgattttttgtgatttgttcagatggtgggtaccccaccctgaaatatttactacaaagttcaagtaaaggagcttcctcgtgcttgctattccatggactttggcatgagaattaggcacgctgttaatgaaggagaccagtggttggactaaaggatgccttggtggcttctactgcagccttagctattcaacagaggaacagaagactcccatgttgctgggaggttctcagtgacagtttctcaggacacacactttttaagtagcaggagactcagattctgaatttttctttctagaaagatgcaggtagcagttttgattgatgtttatcttagcggttggatgctaagaggcggttttgtttttgtttgtttgttttaatcatggaaggacctggtgaagcctacagacttgccctccagtctgagcttctctgctgactggccatgtgactttgagcaagcctctttacttctttcagccttggttttctcatctgaaaagcaggaataatattaatatgggcataatgttcttaaagcaacattaatagttcccttccctagttttacagcctattcttttctttttcttcttcttcttttttgttttttttttttttgagatggcgtctcactgtgtcgcccaggctggagtgcagtggcacaatctcggctcactgcaatctctgcctcccgagttcaagcgattctcatgcctcagtctcctgagtaccagggttcacaggcatgtgccaccacacccggctggggtttcaccatgtggaccaagctggtctcgaactcctgacctcaagccatccacccgccttggcctccctaagtgctgggattacaggtgtaagccactgcggccagctgacagcctattcttttctttcttttgcagcacatactccattctgccttgtatttttggtgatagctccccagtctgtctctcctactagatggtaacctctcaagggctatctttgtagtccctcaagcccagggcagcactttgtatgcaatgggtgtatcagtcagggcccaatcaggagatagaaaccatgcagtaatttgaataggagaaatgtaatagaaggaattattgatctctgatgggagcaactataaggatgtaaagggaactccaaaggataccctaaggctgagagagaatacccaggaaggacaaacttggcaggggcctctctgcatggctggggttcagacttcattggagaagcaggatggtggggaagttcacgaggttgacctgagccagggctggttcacagtggttgagcagcagagcgccctctggggtgcaggccagaggaggttggtggacaggggtgtgtgtggagagagagtcggggcacgctgccagtgcaaggcctgcagcacgcagtgcctgcagcaggagggccaccgtgaagtggttactgggcccaggctagggctgcaaggtcactgagcaactatgcactccaggcttgcagctggggcagagcatgaccgaaagtccccacaggcacactctgcagcccaacaacatccaaatctgaagaaatccccttcctcttgcagtggccctttagggccccctactgatgaggctcactgtaaaggagaaatgcttacagggtccagtccatgatctcagagcagaggcataagggcgactttggagctaaggcaatactatgaaaactgcaatgggtgcaatgagggatcaataaaatgtttgaattaaatcggagaaagctacataacctgtcatgcccccccttcatccgtgcttagttccctttctttgagtcctgtagattttgccaccaataaatgtcaaacctttttaactacttttgtaatttactctctggaagctcatttccctctggggtattctgtgtgtgtgtgtgtgtgtgtgtgtgtggtttttgttgttgttgttgtttttgagacagagtctcactctgtcgaccaggctggagtgcagtggcacgatctcggctcactgcaatgtccacctcccaggttcaagtgattctcctgcctcaggctcccaagtagctgggattacaggcacatgccaacatgcccagtagggacggggtttctccatctcatcatgttggccaggctggtcttgaactcccagcctcaagtaatccacctcccccaacccgcccgacatcagcctcccgaagtgctgggcttacaggtgtgagccactgtgcctggcctctgtgtgtcttcttaatgaggcatgtgtctctcttctcttagctcatacttaaaagagatttgcagaaagaaagaaggagcgggggggactggctctcgcaaacagtgtgagacccagtattttatttcacaacttatttctccacttgaacttgaacttgtttctccactgtctgtttcatttcgaggcagttcacttgtccctcccaaatgctttaggagtgtcctgaagcacttgacttcaagtagcagtggaaagaatcagagccaatccaagaaccaatctttctctgacttggagaagtcagtggccacctcgggtcagactagggagttaatctccttggacaaatctgaagagtccagtctccaaatatttagaaaagaataggcaagaagagaagaaccaccagccgacttggaggataattacaacacaaatattattcagaaagcatttagaaaggactaatcgtttcaagtaacttgagaatccaaccgagatgagttgagcctataaagagcccttcagatgccctcttgtgggagactgtgttaataggcaccaagtttgggttaggacagtgttcttgggtatcaaccaccctgttcttccaaaatattgcattctctcccgaagagtcagatgtaattagtgttaactgttgattccctccaggaatgagctaaacagtgggatgtggctacagttaagacttcctctaagaatgaagtggttgtccaaacttaaatctgttggccgggcatggtggctcacgcctgtaatcccagcactttgggaggccaaggcggatggatcacttgaggtcaggagttcaagaccagcctggccaccatggtgaaacccccatctctactaaaaatacaaaaattggccgggcttggtggtgggcacctgtagtcccagctactcaggaggctggggcagaagaatggcttgaacccaggaggcggagattgcagtgagctcagatcccaccacttcattccagccttgagactccgtctcaaaaaaagaaagctgtttatcatcctgcagaaggatgattatccctttagaccagaaaaatgacagtgagaagaactagaagaacttaatttttccactgaaatttagacttttttttttttttgagacagtctcactctgtcactcaggctggagtgcagtggcgcaatctcggctcactgcaacctctgcctcctgggttcaagtgattcttctgcctcagcctcccaagtagctgggattacaggtgtgcagcatcacgcccggctaatttttgtatttttggtagagacagggtttcaccatattggccaagctggtctcaaactcctgacctcaagtgatctgcccacctcggcctcccaaagcgctgcgattacaggcatgaaccactgagcccaggccgacatttatatctatatattgcggctgtgttgttgttgttgttattattattattattattattattattattattattattattttgcaagtgatgtgcattctgggccagtgaaacctagagcagattggcaggaaaccatctcagtgtcttaccaagctttaccttgttacctttatgtgtacaaaggaaattgtgcccttaaatgatcaagaaaaacaggtgtgtttcccctggataatgagattgtggtttattttcttatttttgcttatctatattttctgcaatgagcatgttttatttgtgaaactaaatatatataaaaatatatggccgggcgcggtggctcacgcctgtaatcccagcactttgggaggctgaggcgggcggatcacgaggtcaggagatcgagaccatcctggctaacacggtgaaaccccgtctctactaaaaatacaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaccaaaaaaaaaaaaaaaaaaaaaaatatatatatatataaaatatatatttttaacatatatataattttaattttaaaaaacacacacttttctaactcttggcctatatccctgctttttgactcaaatttagccagaccctttccaacctctttactcctcctgttcaggtgaactgccaaaaatcagcagacttcagtttgggaagagattttttttttttggaagagattaatttcctcactcttgaactcctaaaaacagcccagtttttcttctacctctcaccaagcagtgattgatgctacacctgcctctgatgtgacaaaaccaaagccatgaatcaaagccttctatgattcttgcgcattctgaggctggtgaaagcactagccgggggccctgagacgtgtgaagatgctctgtgtgggggttattctgcctcgggcactttggagggtaacacctgctatcactaacctttgatatgttgctctgctttttcagattttcgacaatgaagccaaagacgtggagagagaagtttgctttattgatattgcctgcgatgaaattccagagcgctactacaaagaatctgaggtaagcaacagttgggatgagatgtggaagattcattcattcattcattccacaactatttcttaagtgcctcctaacttgggaggatgccatctctcgtcgtgtggattcaatttgctttcgtatcttgctggttctttttgcaagtctcaaaattaagtctctaactcttcagggaccatcattggccctggctgttactcaatctccacttagttttcctgtctcccaactctgccatcatttttggcaacgtcagtatccatagggctggaccatccaacacactggccttgctgaaaaacaacagtctccccaattacatgcgctcttttttttttttttttcttttttttttttgagatggagtctcgcccaggctggagtgtggtggtgtgatctcactgtggcatctgcctcccaggttcaagccattctcctgcctcagcctcctgagtatgtgggattacaggcgcccaccaccatacctggctaatttttgtatttttagtagagatggggtttcaccctgttggccaggctggtctccaacttctgatctcaaatgatcagcccaccttggcctcccaaagcactgggattacaggcatgagccacctgtgttttatttgtatctgaatcaatccttgaaaactttgatagctcattccagcacagctcctttctctcaaaacagcaagcaccttaatgaggacatctcctttgttcttggctgagaataaatttcagagaacttctttctgtctggttttcaacctaccaggatccatcctttgccttagttctaccttcttgttatacggtttgtgcaagtcaccatttatatcccattagtattttattaatggctgctgacggaacttgggtgacccacttgtaaataacatcccagccctgcaatgacagcagatgcagggctatttttgttggttagcgacatgccaccaatcccaatatgtttggaatcagggccccagactcgtccttgagccgtaacacgtggaccttgaaactcttctcccagagtcatcaaggctgatgggagacacaataaataaacttattcaaaatgaattctgtcgttacgcaaataaaccaggctcccgacgtggttcagatttcttttgcctccacattttggggttcatttcggtataaaagtcttacctgatcttagcaaatgctcggctgcttaattgcaggcgcttatgttcagctgctgtccctgaaagggctggggagaggctgatgtggatcactctgtgttgctcatctccacccaaagggtgagcgttttaacatcatcagctttcattatgctctgtggccaaccacacctatgcattttaagataaagaaagttaaacgctccctacgtaactgtggacccgccgaagagggaaataaacagggccactgaccttccccttgtctcactccacagaaatcctatagtttcatgtcaagtccgccagtgcttaatggggctctgatgatgcgcagagcattgtgcaaagcactcctgtgacgcctcgggcccccccgggctgctgtcctacctggacctcccggcctctttgggagctctgggccttccaggaaagcagggttgccagaaaactctgaactaatttcagcttttcctcccagtgtgctttggcgtggctctgcctggacttcagggagttccctcctgattcagtaggaagtcttgatacaaatatagaatattaatgaagaaatcaagtctcatttctagtcaacgtgcctgactcatttccctgtgctctgtgcccccaaagaacctccactagaaagcttcctttcattcacacagacattcgaggagcttttccttcatgcttcacagggtcactcatgggcacgtccgtacctccttccctgggtcctagagtattcttccctggatgcagcttggccaaggagatgagtggtaaagagtccagtaattattcatccaataaatatttatggagtcctcactgagtgtcacatacaatgttaagatggggatgtctgggcatggtgcctcacgcctgtaatcccagcactttgggaggccaaggcaggcggctcacttgagttcaggagttcgagaccagcctgatcaacatggcaaaaactctactaaaaatacaaaaattagccggcagggtggtcagctactcgggaggctgacgcatgagaatcgcttgaacctgggaagtggaggctgcaatgagctgagatcacaacagagtgagaaactgtctcaaaaaaaaacagcaatgagccaaagagatgcttagggtccctcccttcaggacacttccaatctaacaaataccacgcagagagtatttggcgaacagtagagaaatagtcacacagatacatatggagttcagagtcacacgtgcaggaaggcaggtacggggagagactgtgataaggaaactgaatttaagaggataggatcaggagacatgctatggaaaaaatgacatttcaggccgggcgcagtgcctcacgcctgtaatcccagcattttgggaggccgaggcaggcagatcacctgaggtcaggagtttgagaccagcctggccaacagaatgaaaccccaactctactaaaaatataaaaattgcccgggcatggtggcatgcgcctttagtcccggctactcagaagactgaggcaggagaatcacttgaagtcccagcgactcaggaggctgaggttgaacccaggaggcggtggttacagtgagccgagatggcaccactgcaatccagcctgggcaacagagactcggtctcaaaaaaaataataataaataataaatgaagctgaggtgtcataggatctaaattatgcttttaaaatattgttctggatggagaatggactggagaagaacagagtcaggagaccaccaaggtcactattgtgatttatattgtcggttacttaggttctgtcgtggcttgcgctagagggctggtggcagagatggacaggagcagatggtttggaggtatattttgaagatgagttgacagggattgctcatggattggatgtggggatgaggttgaaggaggaattgggatggccttaaggattctggcttgggcaactgatagatgggggtgctgcttactgaaatgggaaggtgagaagagaggtatacgttggagaaagatgagtggattttgtgatgtcagtgaggcatctaacacagacagaaatgagtctggagcttaggtgagagatctgggagaccaatttgagagtatttggcgaataggagatttaaaaatcctggggatggatgagaggaagaaagcatgaaatataaatgggaaaggggttcaagtctgagccttcaaggatggcagcatatggagatcaggttgaatctaaaagaatcaggagtctaaaagaattggccagaaagttaggaggaaaacacagaaatgcaccaaggaatgcaagtttcaagaggaggagagtgaccagaggtgctgaatgctgccaagagatcgagtaggaagagaatggaaaactgtccgctggagcagttctcaactgggggtgattattgcctcacgaggatgcttggcaatgcctatagacattcttggttgtcaaaacataggaggtgctactggtatctagagtgtagaggccagggatactgctaaaatcctctacagcacagaaagcccctcacaacaaagaattatctggctccagctgggcgcggtggctcacgcctataatcccagcactttgggaggccgaggcaggtgaatcacaaggtcaggagttcaagaccagcctggccaacatggtgaaacctcgtttcttctaaaaattcaaaaaattagccggccatggtggtaggtgcctgtaattccatctactcgtgaggctgaggcaggagaatcacttgaacccaggaggccgagattgcgctactgcactccagcccaggcgacagtgcgagactccgtttcaaaaaaaaaaaaaaaaaaaaaagcattatctggctccaaatgtccatagtgccaaggctgggaagccttgttctacaggaagaggtgattgaagatggatggaactctggattcagctttgacgctcagggccacccctggcccgccctggagtcttacggttactaaatggatgcgggagaaggggccccatagggctgagccctgcacattcatcatccattgtgtgacctcccaggggatctgctggcatctggaacaggtggaattcctcctccgtggacctggcagccggaccacaaagggctataggtaccactgggagcctgcaataaaatcttagaaaaagcattcccccaggggcgactccctcgtaaccccagccccatcaccttcaacaggccagaatacagactgcagtctgaacccacccaaaggaagaggggtgagtttcctgggctgttttggtggttgtgtctactgtaaacacaccagggactgggaataagaggaacaaccgattcagaaggcaaaccatttccaaacaaatgtctaactggcacactgtagataattaacaccctccaccccaccacaggagtttccttctaaaatgaaatctgaccttgttctttgcttgaaacccctcactggccctcctttagagttcagctcacacaggactccccctttctgagttttcctgggcatgcccccaccactgctggtctggaggcagcaaagttctggtccgtggcttctagatcatgctaggttatgctagctcatcactatggcatgagctctgcgaagacaagagctggctctttcccagccgctgccacagcaccagtgcttagcaggcgctcactcaatggttgctgaatgaatgagtgaaggcaagggactttgctttttttcttccagcagtgacaatttcagagcaaccgctatcaaagaaaatgaattcgttgccattaagcaagcagttgtgaatcagagttcctttttttttttaatcggaggcatccagctccatgggccttttcttcccatccatctttgtaagttgacgatgtcagcgtcctaaatagaaacgctctttatgtgaggaagccggatgctgatgggccgaatctgttcctggatttttttgatgctgatgaacccagaccagggttatctgggttgctcctctccactcagctactgttgcacacacacacggccatccaggccaaaggaggggatgaaagcactttcctttctttttccatttctccctggaaacctttgagccacacaatcaagactgcctctctcatgaaggtgaccagagcttggagttttccactgggtgccctctgcccgatggccctcgtgccatcgccactaaccggggactcagaagcatgctttggggattcaggaccagctgatagcccagctctgtgctttccttattctcatttttgctgtgttgctgtttcctgttagggcctgaacttcagctctcaaaaacctcttagcttcaagtttgttctcatagtcattaatggactctgcagggcagtgccgtattgtggggtgggggtgggggaggaattagtgtgatttttttcaggcagagagagcccctccattagtcacacagaccactgagaccctgcccgcccataagagtcataaagctgtttgcaccatgtcacatgtaaaatgaccatcatcaacaccaaagcaggaaaaggggtgaagccaaaagctgagcaggttggactggttatgtggctgatacatagtgtcttgccgctgccaagattttcatcccagctccttgatgctctgccaagatttcaaggtgaagatcccagcggaggaatgaggaactctgcacgataagttggagcatgcctgcagaggccacaggcagtgcggccatacccgcaaggctgagttggcagttttggggtgcaagaacaaacctcaacttctagcctgcaggactagcccaggctggagaatctgaaagccatgctgggagagatctaacccagaggcctttgatattggcttctagtcaagttcaagtccagtactttctcctccattcactgcagtagttcctgaggtctggcttccatcatgagatggggagtgaccaaagaaaatggcatctatactggcctcctgggggctgccacctgcagcaatctcccctagacacaaatgtgtagggcgcgtgcagcttctcaatcttcagacatacctccagggcaaaggaagggaaagaaaaaggaatgtctttcctagtcaaggaagtagaagtagagggttttgtgtgtgtgtgcttccttttttaaatcttcattgattcatgtaatgaaaagcaaaggagtctctagcccagaggttctcaactacaggcaaatttgtccctcagggccatctggcaatatctggagacatttttgattgatgaaagtggatacggcatgttatgaatccagtcggtagaggtcagggaggctactgaacatccaaaatgggccaggtgcagtggctcacacctgtaatcccagcactttgggggaggctgaggcgggaggatcacttgaggccaggatttcaagaacagccggagccacacagcaagaccctatttctacaaaaaaaaaataaaaataaaaataaattctctgggcatagtagcatgtgcctatagtcctagctactcaggaagctgagatgagaggatcacttgagcccagacgtttgaggctgcagtgagccatgatcatgccactgcactccagcctgggaaacagagcgagaccctgtctctaaaaaagaaaagaaaagaatccaaactgcaccacaacagagaattatccagctccaaaatgtcaagtatgccaagatcaataaaccctgacatggaccaatccaaggaaagaaaacttagtaaaacctactggtatcaagactcattaatgaattcctttagttagcatttactaagcacctactgagtgccagctccacactaagcattgagggtacaaaaacaagattatgtcagccctcaaaggtcctgtcttctactgccttttgaattgatcatcttgttacagatgaagcaatttctcatcccctttattttggaggatataaaggccatcttactagtgataaatacagcatagtaagttgaataggggaaatttgcaattgtttgtactcagatagcaacaaaggagaaagaataacatgaggctgtcctagaagcatgggcccctgacgtggcataattaaatgtttttcagacagaatttgattttgaactttccccttaagttgggtgactaagtctccaggtccctgggtcatagccttcctggaccaagaactccttggcagccagttcattggtccccacagatctaaatatctgttgaattctctgttaagggagagagaacagaacaaaaggagatacatctagcttttccaataactgtcaagggtgagagattaaatgttgtttgctaaggaccggccctcagaaagggaacagagagatcaactaagtaaatattgtcatatttagctgtacccttcggtacaaagagcttcatccaaatcactcggctccctcaaatgaaaaatattttcattctggtctacatcttggcctttgagggtggtaaagattttccgttacctctaatggccagatttaacacagctgcctcatgccggggtacatcgttaagttcacttggttgtgctgttattatctttttttttttcccgtttccctcaagtccatctgtttctttctgagagtaacgcagctgttttgcagtgggttccaacttactggggcctgcatgcttcttggaaaataagaggacttgatgacatcactgggatggggagaagtccctgctgccaaaggggtccctggtgggagcctctaaaactggagggagagggaggaagcctgcaaaggagacacaagagaagggtcctcagcagctgccgcatcgcgggccctgagccctctccccttccagggtctggatgatgccagtgctgttagaaattgagagagaaggccaggcacagtggtccacacctgtaatcccagcactttgggaggccgaggcaggcggatcacttgaggtcaggagttcgagaccagcctggccaacatggtgaaactccatctctactaaaaatacaaaaattagccacgtatggtggcgggcacctgtaatcccagctactcaggaggctgaggcaggagaatcacttgaacccaggaggcgaagcttgcagtgagccaaagatggtgccactgtactccagcctgggtgacagagcgagactctgttgaaaaagaaaaaaaaaaaaaaaaaaaagaggccgggcacagtggctcacacctgtaatcctagcactttgggaggccgaggcaggcagattgcctgagctcaggagttcgagaccagccaggacaacatggtgaaaacccatctctactaaaatacaaaaaattagccgggtgtggtggcacatgcctgtaaccccagctactccggaggctgaggcaggagaatcgtttgaacccggaaggcaaaggttgcagtgagctgagatcacaccattgcagtccaggctgggtgacagggccagaccctgtctcaaaaaaaaaagaaacccatgatctggttgggaggatatggtataatgacacaaatgctaagtgacagtacggagcaaggcagcaagagaaatacattcacacagtcatgtgtgatctactttcctcaaacttgtacacatagtcatcctcagaggattcccaggactagtcagggaagactttacagcagagatggaatctgagctgggccttaaaaacataataggtttatgtttattttttgctcataaattaatacatgatccttgtaaaaaaaattccgacatgatacaaacacaaaacagagcaaatctcctatgatccctcatcacagacatcgctgttaaagttggtgtttatacttaaacataatgcataaatagtattattttataaaactaaactcacactatgcacaccatctcgcaacatgcattatttcactaaccacataagcttgccatttttctgtgcagcacacgcctgtctagtgagttttaggtggccggataatatgccagtgaaggccaggttcagtggctcacgcctgtaatcccagcactttgggaggccaaggcaggcagatcgcttaaggtcagaagttccagacccacctaggcaacatggcaaaaccccatctctataaaaaatacaaaaattagccgggtgtgatggcacatgcctggagtaccagctactctggagactgagggaagaggatcacttgagcccaggagtcggaggctgctgcagtgagctgagatcccgggcagcagagcaagaccctacctcaaaataataataataataataataataataataataataataagcgagtgtacggtggtgccatgtgtacatcattctccatttgatggacatttagggtgtttccattcttattatggtactgcaagaaacagccatagatatattttgagagttgttctaacgtctctgtagaataaatctaaaagtgaaagtgttgagtcaatggacatatgggttgagattttcctagatataacaaaattgcccacaccctgcggctacattaaattgcccctgactcacacttggatgggagcaaactcaggtctgaagatgtgtgagatggaatggacagtgtagtgaatggctgaaaatgaggagtctcagtgcatggtcaagggtcagtgaggcacaagggaaaaacattgagtaccaagtcaatgaatttggactttattctgcaggtcgcagagagtcttcaaagcaggggtcaccaaaaataaaaaattccgttggccaagaaaaaagaaaaagcaggggttatcagcaaccgtgcaaggggactctacctgtgacctcaccagaggggctgactgtcttgtggggatggtgagggcaagctcctgggtgcccagaggtttaggacccttcaaatccatcaacctacatccttccctcttctgctaccccctttcatgaacaaattgccctcagccatcttgacaacaataagattttattaatgaataggaacatttggaaataaaaaggtgttaaacagtagtccagttctcaacaaccctggctgcaccattttcagaccaataattggcatggcaactcacttcccaaggaacaatgaggtgttctttttcagacctcattccttccaaacccgggaaagataagacgccaagtctcgctgaagcaccgtgcctagtgctgattttaaaagccactgctgttctcttggcctaataatgcgaagctacctcagcatttggatcaaaccccatttttactgggattactacaaaaaatgatagtgcccaacttcatcctagagaaagagttttcatttttttttttaatttttcaaggggaaaaaaaccatttaaactgctgcagtaattggcatgaatgatgttccccagaactcagtgttcagagcagcagttgcaaatcctaccaattgaatttggtagtgaaatgccagaccaagtaggtcaaacaaaatcaaggcatatgaattcctaaatgccagatcaaaagcagagaatctaagtctctgccaggagtgcagttgctgattgtggcattgtgggtcattgaatcaatagaaagagcccttgggggccaggtgcagtggctcacgcctgtaatcccagcactttgggacgccaaggcaggcagatcacttgaggtcaggagttcgagaccatggcaaaaccctgtctactaaaaatacgaaaattagctgggcatggcggcacgcacctgtagtcctaggtactagggaggctgaggcacgagaattgcttgaatccgggaggcggaggtggcagtgagctgagatcgcgccactgcactccagcctggacaacagagtgagactttgtctcaaaaaagaaagaaagaaagaacccttggggaaatcaccctatcaccctatatcccaaaaggaacagaccagggagggaagaattcatccaagcaaaacattcatggaagggagaaacagttgggcttttcatagagggatctgtgcaaaagataacccctagaacctatgaattgggattcccaacttgtgtgctctgtgtctagatgattcagccctaatgtggtgagggccctggctctgggagcctcccaggcggtcacagccactgcatttgatcatcatcaattctgtgtctgagtccctccctcccttccaaagaatggacagatggacagatgggatggagaagtgagatgacgtcaaaggcaaggcatggaaagtgaccagcacagtccctggcacacagtaagcatttcataagtgttcccttctctctgctttgaccctggcttcgagctctgcagatgggttgcaggaatggtggctccgtggaaaccatgtgtctttggaaagtggccaccgtgagtggcgtcacaggagtttgtttgcgtgtcgcttttcccttgtcggtgtgagtggagaacaggagcagaggtgtgataccaatagctccagctctcaggatcatgggatcctccgccggctcagcaagatcctgcagaagttacagccatttgtgctgctgagacttttcaaaaaaaatgtgttattgcctctgttatggtttaacctgaattccggatggcacgtgtctctgctacttcacctcgaagaaaccttagaagttacatttgctgtttgttttgtgccaagtctgggccatctgtggcactgcagtgccgggatggtacccaaggcagtattgccatgctatctctgtctgccacgagccttcttacagctgtactatagaaaactaacatttaagactttcaaagaaggaagcaagagctgaagggcccaaggctctcagccaggagtgaacagatacaacaagctcttcttcagttccatctcatggagaacttccctctgtaatttttttttttttttttttttttttttgagacagagtctcactctgtcacccaggctggagggcagtgtcacaatttcagctcactgcaacctctgcctcctgggttcaagcgattctcctgcctcagcctcctgagtagctgggactacaggtgcacgccaccacgcccagctaatttttgtatttttagtagagacagggtttcaccacgttggtcaggctgctctcgaactcctgacttcaggtgatccactcgccaaagtgctgggattacaggcgtgagccaatgcacctggccctgctctgttctttcaagaaaacaggcaatgagtccacacaagttgctcataactggggccagccacatcagcccctgctgtttttagtcttattaaagtaaaacaccagaacttcttggcccttagaacagagttcccaaatcaggtcagcatcacccagggaggttttgaaaactggagatatccgggtcccaccttagaccaacccaaccagactcaactggtctgggacccaagaatcagtgtgtaaatgcaccaggtttgggaaaatggcctcagagcagagcttcccatcttttttcatgccttgacaggtaggaagtgtttcgttttggccaggcgcggtggctcatgcctgtaatcccagcactttgggaggccgaggcaggcggatcacctgaggtcgggagtttgagaccagcctgaccaacacggagaaaccgcatctctactaaaaatacaaaaatcagccaggcatggtggcgggcacctataatcccagctactcgggagcctgaggcaggagaatcacttgaaccctgaaggcggaggttgcggtgagccaagatcgcgccattgcattccagcctgggcaacaagagcgaaactccatctcagaaaaaaaaaaaaaaaaaaagagaaagtgatttgttttgattgacacattgaggaggagctcctggttaagatgaccaacccctgagctcagaaggcccagtctgttactcaagggctgcgggagcaatatgccttatcacatctactatccattcaccatagggaagctttgcctaagagagctcaacttactgaggtcaaggttttaaaccactttattgttacttaatttgggggaggagggatgcaggggggttagcaatgtaagcctgtaagcctgcccattccccgattgtgagagaggtcagtgcctttgaattttgttctgtctgttgggaatctgacgccatctgtagaatcagatccaaagtcttccttgacagctactagcgttaattataacataagtttgtgcagtttttttcctaagttgcttctgatttgggggtggcttcagattgacattattgaagtttatttcctccacccaaagactctaggccggctgtgattgttcacgcctgtaatcccagcactttgggaggccaaggcgggtggatcacttgaggccaagagttcgagaccagcctggccaacctggcaaaagcctgtctctactaaaaatacaaaaattagacaggcgtggtggcgggtgcctgtagtcccagctactctggaagctgaggcaggagaatcacttgaacctgggaggtggatgttgcagtgagccgagatcgtaccatttgtactccagcctgggcaacaagtgagactctgtctgaaaacaaagacaaaacaaaaaaaagactctggtagctgtccaccaggtcctctggctaaatcttctccaagccctttctttgtttagcactctaagaatctgcaacaatgactatgatgtttgaggtggcatttttctccttgagaaataagacctgacagagcgattgtctgctccacatctagttattcagactccaaatacaactgttcagcttctgttccaaaaatacccaagaaagaataagtgttattaaggtgcttgtcttcatcttttattattaagaggcccagagaaagacttataattactagctcattagcttgggccttagaattttcaacgaaaatttctcacaaaattgctaaacctggttttagaaggtatggaactaacttttgagaaaaataaattccaccatttagagtctcactgtcgcccaagctggagtgcagtgatgcaaccacggctcaccgcaacctccacccctccaggctcaagcgatcctcctaccacagcctcctgactaccagcacatgccaccacaccagctatttgtgtgtgtgggtgtgtgtgtgtgggtgtgtcgtgatggggatcttgcagtgttgcctaggctggtctcaaactcatgggctcaagtggtccacctgcctcagcctcccaaagtgctgggattacaagtacgagccaccactgcacccagccaacattgtctccattttatagataaggaaactgaggcttagagagtctaagtaactggctggaagtttcaggaagcctggattcaaaccccaaagtgtcctaccccaaagattatgcttcccctacaccaagtaagattccttcaggtaaagctagacgtacaaacaactgttgtctttggaaatcactctaagaaatagttcccttcttaaatatatcttcccaaccccgagtctcagtgactaaatgatcttagggaaagactggtatgtagaaaaagaagggcctttgagacggttggttacctgatgtgatagaattccactcctcatctttggggagaagtttcctctttacaaacattccagaacatagtggattggccaaaagcagcttgggtctgtaaaaaaaaccaaaaactaaaaactagccatcctccattagagaatagaaaccttttattattttttttcttttacacaaggtctcactttgttgcccaggctggagtgcagtggcaccatcacgacccactgctgtcttgacctcctgggtttaagccattctcctgccttggccccctaagtagctgggactacaggtgcacaccatcacacccagctaattttgggtttttttttttttttttttttttttttttgtagagacggggtttcaccatgttaggtttcccaggctggtctcgagctcctcagctctaaccatctgcccgcctcagcctcccaaagatgacaggtgtgagccaccacacccagcccaggaagctatttttaaaaagaaaaaaaaaagccattagtcaccaaagaacccatctacagaccctaattcagaaatattccttttctcactttagcatccacacgatagtcttagagttaaataacttgcccaggttcacacagtagttactggagctgaaattcaaacctgggggcagggcatgtgttctctcacttcaaagcctcctcagttcatctctcagttctgctccacagatctgaggaccccacaaggtgctcccgggcatggtaaacagtgaaatacattgtatcaaacagtgaagggagaaacagcctgaagaatccactcatcacttttacctgctttatatactgggattccaaaagtgcatttggagaaacaaaatgagttctgaagctcaaataagtttgaaatctaaaagtggaaatattttattgtcttcaaattacagactgattggcttattgaacatctctaccctggtttctgttcgacaagttggaggcctaaatttcccaaaataatacagtacacaaggagcaagctagacttagggacagttaatctggtgctgatcactgttggcatgctgcaactcatcgagatatttgtcagcctattatcagcttttgatttaataaacttaagctatctctaggccaaattgtagatcctcggtaggaatgcaggctgttaatgcctccccatagccttcgtctaaagagcactgctaaaatcagagtggagaacagcctcaagttcaaaggctgcaaaccgagccaggttctaataagctccctttatgggaggagctgggttcttggcctctcactgtctcatgtattaaggtggggtcctctccagtgtgcccttgaatgaccttattgcttttgattagaggttaccttgaactatactcatattgccaaacggaacaggttagtgttctgcaacaggatgttagggagacagctcttgttgctctggaactgggaaccaggcccaaagctggggacaaagaggaattgggactccacattcaccaggcagctgctaatcaccagtggcccagatgaccctcttcccacagctctggttgcccctatcttccccttccctaggccctatgtggagatgaaggaggggagtttgtagtcattgggagtatacttcttgcctcaccccaatcccatgtgacaggagtagtattctgagagaatcaactacagtagctggggcatctgcaaaaaaaagctggctataggcccagtgcagtggctctaatcccagcactttgggaggccaaggcgggaggatcacttgaggccaggagtttgagaccagcccagacaatatagcaacagcccatctacaaaatatttttaaaaattagctgggcccagtggcacatgcctgtggtcttagctactcaggaagctgaggtgggaggattgcttgagcctaagagttcaaggctgcagtgagccatgattgcaccactgcactccagcctgggtgacagagtgagaccctgacacacacacaaaaaatagttgactgtttgctgagccgggaacttgcaggcccaccctcaatgctgccatcctgcaagacttgggtgatactaataagtgtccccaaaagcttgcagaggaacgtagagattgcacctgctgcccatctggaaatttctaaaggagtttttgaaggagcccatggctagggctgagatggaaccatgggagtgtgagcttgggaatagcacgggggcatccccttgggcattattgaaaatgcaggtaatagtgggctacttttagtagcttgcttatgagaattctggggtgttttctgtgtctccaaccagttcaattctccagcaccagctatgtgtccaacaattcaattcaattagacactgtctatctggagttagcatcagatcccagtcccacaaagctgccccacttctcactgacaggctataggccgggcacagtggctcattcctacaatcccagcactttgggaggccaaggcaggtggatcacttgaggccaggagttcgagactagcctggccaacagagtgagactccatctctattttttttactaaaaaaaattttttttttaatctggggtctccacgactccttcctcaggctcaataatttgctagaaaggctcacagaactcaggaaaacatttacttagatttaccagtttattatcaaggatatgactcagcagcaggtaaatgggagagaggcatcaggtgaggtattggggggtggggacttggggcttccgtgccccctctgggtgtgccatcctcccagcaggtcagtgtgtttaagcgtttatggagctcaatcccagcaccccctccctccctagaggtcagtggatggggctgaaagttctaaccccctaatcacctggtgtttctggtgaccagagccatcttgaggccatctagggcccctcacctgtgtatgtgatctgaaggagcttgttatgcatcccaaaagtcacccccatcactcaggaaattccaggagtttttggagcattgtcttaggaagcagtgacaaaaaccaaatctattttgtattacatcacaaggatgaaatgagaaagcgaatctgaagtgcctgacacagactctggtacggagcaagcacttgaaaacgttagctcctagggtgatttttcccagcttccttccttgactttcctctggccacctctcttgcaagttctcatttgctttcatcttctccccagttcctaaaaggcatcctgggggctagaaaccataggctttttttttttttttttttttttttgagatggaaccttgctctgtctcccaggctggagtgcagtggtgcgatctcagctcactgcaacctctgcctctcgggtttaagcgattctcctgcctcagcctcctgagtagctgggactacaggcatgcgccaccatgcctggctaaattttttggatttttagtagagacggggtttcaccatgttggtcaggctgatctccaactcctgacctcaaaagatccgccctccttggcctcccaaagtgttgggattacaggtgtgagccacggcgcctggccaaaaccatggactattacattgttttgtgtgatgtgctcaaatttctcatttgcctcgtccctcttcttaaagcaatgagtttcaagtgtttgtggcactgaactataactgagaagggtacaaaacagaaacattccccttgccacagctgcctttcagtgcctttctacacatcagatgcaccttatgagtcaaactcctttaagagagtcattttgcagagaaaaaacacaaaccgctcagggtttgcggtgcattctagtgccaagagcaaatgctttaaaaatagcactttaggtattaactgctaacaaagcaagaattgactgcttctggcatgatttgcatttagggttttggtttgtttttttttaagttgatgcatagcagttgaccttttaagtcaagttttaggtcagttctccagcacattctgaaagctccttagttttgtctcttttttaaaaaacagctttattggctgggcacaatagctcaccactgtaatcccagcacttttggaggccaaggcgggtggatcacctgaggtcaggagcttgagaccagcctggccaacatggcgaaaccccatctctactaaaaatacaaaaatcagccgggtgtgctggcacgtgcttgtaatcccagctacttgggaggctgagacaggagaattgctggaacttgggacgtggtggttgcagtgagccgagattgcaccattgctctctagcccaggtgacagaatgagactccgtctaaaaaaaaaacccaaaaaaacagctttattgagatatagatcacataccatacaattcagccattttgaatgtatagttcagtggattttactataatcacatgtttacctcaccacaatcaaatgtaaaacattttcatcaccccacaaagaaacctcatatgttttagctatcatctccctaccctctcccctcacccatctcccaagcctcagcaaccacactgatctactttctgtctccatagatttcccttttctgggcatttcatatgaatagggtcacttaataagtggtctttggggactagctgctttgaaagctccttggttttatgtgtatccctcttaagattcaagttcaaggaatcctacattaattcagggctaaactttactttcattggaggggaatgagaatgagatctgcaacaccttggagtcttcaggagaagttccaggatggagagaaaaaaatctgacatgtgatatgtgttgttcatccatccctattttagggctgagggttatagttacataatgtagcaattcctggctggagttcctgcttagccttttttcatttagcatttatcaaaaacttctcatttcaattaacagggcaagcccctgttggctattgccctttgtggttcaaattgagagtgtaattaatcatggagacttcatatctcagtgaacgtcagctaataagattgcctccaagatgcaagctcagccccagctggaccaagctctcctgtgggcttctccttgcaccttccaggtgggagactgattctatccaaaacgaggacgcagttttacacgggctgctcaaacaagccctttgctctgccttgtcccagtgcgagatggatgaggcctgcaggtgtggctgatcctatagagtggacgccttctaaagatgtgccgaagtccatctggccccagggaaacagccctggcaccagctcaaccccctcgatacagatgggctttaactacaagggtccaatttgccatctgccaagcctggagagaatcggtagcatccggagccagagatctcattgtggatgaatttataaaaccctggctagaagaacttgcagccccacgcgttccccaccagccagctgccgggccgagaggagctgggcagggcccttgaggcaagagcatcgcttgcagagaagttccacatcccccagcggagccagatgccactactggggttcggtgctccgtgaccacatgagtgagctggaagagtgaccgcggaacctagaagacttgccttgtaaaaacctctctgactcatgttatgggtttgtgtccccccagaaagctaggttgacgtcctaacccccagaatgtgaacttacttgggatagggtctttacaaaggtaatcaagttgaagtgagatcattagggggaccctaatccagtatgatgggtgtccttataaaaaggagaaatttggagctgagtgcagtggctcacgcctatggtcccagcactttgggaggtcaacgcaggcggatctcttgaggtcaggagttcaagaccagccaggccaacatggtgaaaccccatctctactaaaaatacaaaaattagccaggagtggtggtgggcgcctgtagtcccagctactcgggaggctgaggcaggagcattgcttgaacccaggaggtggaggttggatggcaccactgcactccagcctgggtgacacagcaagactctgtctaaaagaaaaaaaaggttggggggaatttggacacacagacagacaagcacagagggaagacgatatgaagatgcagtgagaatgtgatgacttcactccagtgatgcttctacatgccaaggaacgcccaggggaaaggcatgaaacagattcctcctcacagcccttggaaggaccagtcctgatgacacctcgatttggggcttctagcctccagtactgtgaaacaataaatttctgatgtttaagccaccagtgtgtgattatctttttgttgttgttgttgttgtctgtgatacttgatacagcaggaaacgaatagactagtggaaccaaccctccaccctaaataggtacgaatgaaaaacacatatcacatgttagatttctttctctgcattacggaacttttcctgaagcctccaaggtgttgcagatctcattttcattcctctcccaatgaatgaccatttcaaccaggtaaaatttagccctgagttaatgtaggatttcttgaacttgaaccagggaggaagagagccctgccctggcttggaagattactggaaggaaaggacagcgtatgcctctgtatgcctttcagcccttcacaaggagagcttgtaagtcacctttaagatgcgtgaaggctgccggactttgaggctcacccatcctgccattgggaggtggctgcccagtacatgcaccgttcaaggagggccccctgcttggctgggaccacgaggttccagaggcccccaggtgaaatcgcctaagggagcggcccatgacagggacaatctgctctgctctctgctttcgtccacttggaacagagtgttcctgcctctgaaacataagagaaagggggaaagacattggtactgagcactgaagactgtcggttcacctggacccagaacccagtcataacatcccacagaacaagaacccttctctcgcaattcctccaaccaccatacttacggacactggcatgtgacagcttccagaaaatggaaatgcccacccaggctttcactcacacaaggaaacctgcatgctgttgggcagtcatattttttatttgagatgatcagcatttttctgtacatttgactacaggataacaataaactcatagtaatcctacagcccctgggacattcccactgcctttctttggaggagcttaataagatttgaacaaagtgcactacagcatctctcagggcatccttgtatcatgtgcttatcactttgggatgtctcctgtgcatcacgcaccttctatgtgccaggctgggctggggactttgcctaccttatccaatttaagtcttgcaacaacccgcaaggaagttttttgattttttttgagatggaatctccctctattgcccaggctggagtgcagtggtgcaatcttggctcactgcaacctccacctcctgggttcaagtgattctcctgcctcggtctcccgagtagctgggacaacaggagcgcgccaccacgcccaactagtttttttgtatttttagtagagacggggtttcaccatattggccaggctggtctcaaactcctgacctcgtgatctgcccgcctcatcctcccaaagtgctgggattacaggcatgagccaccacgcctggccaggagttcttaacaccattctacagatggggagatggaagctctcctctgatcaattgtgccagaatttcagacagaatgtcctgtccacatggtgtaggggtgacgtgttaaaccatttgggctgcaataacagaataccatagactgggtagcttataaacaataaacattgattttttacaattccagaggctggcaaatccaagatcaaagcattgacagattcagtgcctggagatggctcgtttcttggttcatagatggcgcccctctcactgtgtcctcacatggcagaaagggtgaaggagctatccagagtttcttttataagagcactaattgggccgggctcgctggctcatgcctgtaatcccagcactttgggaggccaagatgagcggatcacgaggtcaggagatcaagaccatcctggctaacacggtgaaaccccatctctactaaaaacacaaaaaaaattagccaggcgtggtggcaggcgcctgtggtcccagctactcgggaggctgaggcagaagaatggcatgaacctgggaggcgaggcttgtagtgagctgaggtcgcaccactgcactccagcctggacaacagagagagactcatctcaaaaaaaaaaaaaaaaaaaaaaaagcactaattgcctcccaaaggtccccaccccctaataccatcacactggtgattaagtttcaacatatgggttgggttcggtggttcacacctataatcccagccctttgagaggccaaggcaggaagtgtgcttgaggccagaaatttgtgaccaacatgggcaacataatgagacctcatttccacaaaacattaaaagaattttttaattagctgggcatggtggtgcatgcctgtaatcccagctaggtgagaggatcacttgagcccaggagctcaaggctgcagtgagctgtgatggcaccactgcactccagcctgggagataagagcaagaccctgttgcaaaaaaacccaaaaagtttcaacatgtgaattgggggaggggcaacaaacgttcagaccaaacgttcatgggagcccgggtcggggtggactgtggctgagttgctgattacttctcagcttcaggttcctcatcaagagcatggagataatatgtgtacttcatagcagtgactggatcttgactgtacattcaggtcaccacctgttcagaccccacccaggaccagttaggtcagagcatgggggtctaaccttgctcttctgtctggacctcatcccgaggtttcagtcacagttctggaggccggaagtctgaaatccaagtgagagatttcgaggctctaggggaccatccttcctttcatcttccagcggctccaaaatttccttggtttgtgactccttaactcccatctctgcctctgtcctcgcacaaccttctcctctgtgtcttctcctcttctgtatcttataaggacacttgtcattggatttagggccctcccacttaatccagcatgatctcatctcaagacccttaacttaattacatctgcaaggacctttcccaaataagatcacgttcatagatagatactaggggttaagacctggacatatttttggggaggatttatttaacccacagcagacatcttgcactctgttttctgattgcactgagttgggacccagcaggggtttcaagacacgtaatctcggtcacactaaagtccagccttatgacgttttataattggccagaccttgaaacttgcctgtggaaaggcccaggggatttttaacatcggggatgaaggttgaggtttataaacctctttttaaaataaggaaacctggaaatggaggattaaaatgtaaaataattctgttcttttataaagaataagtgctataacaagagtttgaatcaggcccaaaacactacagacattctagaaatacaaaacagaaatatatacatatttggaaatgttgtaagagaggtcaaccgatgtgtgaagggggcaatttagatactgaatgttcgtaaacccaagtgagaaaatgagaaagaaaatgacttcataaagaatgggtcttgggaggtgttaaggaggacagtgaggaggagggggtagaatgtgaaaagagaagtttgcagcaactggactatttcagataagaccagataatttggttcccttcccctccccacccccgttttttttgttttgttttgttttgttttgttttgtttttggctcatcttcattcaaaagcatttacctggatgttcatttctaatcttgagttttgattaaaggagtcctttcccttacctccctctagctctttgaaagtgaatccttaattataggccatgtttgagattgactagatgaaatcaacagctgtagatatgacaccagactgcaaaatatcgacacaatgttgccataaaaagcccaattgttaattgcttatttggcactgggctataacaaaaacaccctttttctgtttaatattaaaagtaaatgtagtggaaagaacatcgagctagaagtagggtaggctgggattctagtcccagccctattgccgagtgcctgtgatttgggggcaaagcattttatttttctcaggccccggtgtccttatctataaaactgagggcatgaaaccaaattaccactttcagcttaaaaattatattcttaatcatgaaaatacagcatacttctcatttctatcctttttccaaaactttatttcacaatacccaaatataattctatacttttgtcacgcaatcaggaaccacacattgatttaagcatctacatcgtttttgctgtgcaagcaatacttttccagtcttattctgaactgaagtgagctgtcagtcccgacaattctcaactgctttggaaatgcaatccactggtgttccatttttaataccgtgaagtcttgttttattcttgaagaatatgaatctgaaatgtacatgaagatgctggaatagataccatctcaaactcagctgtcattgactgaagaaacaagccaagggcagtccatgaatcagggagggagggcaaggtcgggcacagccaactggtccaggttcctcttgctcagtcagacccactgtgcaggacctgaagggcaggaaggcagctcagactatggccctggtgacagtgacaggagggcagccaaatgcctaggcagataggggtgggaccccagtgaaaccccacttccaagccaaagacagtttaaagcctgaaagccaagctacaggttaaatcctcagaccagattgagaactggcctttcctctgattgatccccacccttcacctattttaaatatgcctactctttcctaattggttatctacactgtcgtgcccacttttgagtggtatcttcactttaaccttttttgcatactcacaaaccaatcagcatgcgctccctattgttagcccataaaagccccaggctcagccatattaggggactttcccactttgggataggtaaccaccccacccccagtatcctctctttgctgagagcttgcctttcgcataataaattatactccactcactctctggtgtctgcatgcctaattcttcctggttgtgagacaagaactcggacctagctgagctaaggagcagaaaaaatcctgcatcactggtttttattttatttccctgcctctggtgcctgcccaccttgctttgtttgctgggttgtctcctacatctctgggttaccaggagcttggactcctgctttcctctacttgccgtctttgtcctatcctttacttactcagttgcttacccaagcaggaagacctccacttaggttctcgagggtttgcctgtccatattctggtcaactgcaggggggaagccatgtcttctaagcctcaagatagttgtttacgtgcaactatcagaggtaaacacccatcatttacctctgttgggaggaagtcaaaagacagatggggaaagaaaccaaatttccctgtttaactccacctcctgtattttaactcatgagagcttcttgagaggtataaatttccttgttttcagctttcaggcttgtggctgattgtgtgaacttttggtgtgctctgggaaagaacaaagcagcattcattctcttcatctttggtaatccagttaatgcacctgttttataatatgcttgatggatgtgttttgttacctgttgctgagcaacagccccaaaatttagtggcttaaaacaatgagagtgcattgtttctcacaattctgcactcttgactgggtttagctggccagatctgctcttcatgatgtgagcttggattgaaatatctcagatggccctttcactcaacgtggtctcagctgagatggctggagcatctgagacctggttgagcatgttgccacatggtctcaccacatggctagcttgggcctcctcatatcatggtgctctaaggtaatcagcctagtcttcttacattgtggagggttccggtttctggcttccagcttctcttgaaaggctaaactgacacaatgtctcttctggtacattctgttggtcaaaacaaataacagaccagtctagattcaaggggtggggaaatggtgaggggaacagcatgtcagcacagtgggggaaggaattgatggtggccatctttggagatgtatggtagataatctctcaatttattggtcttctcttttctttttatttttttccaaattcaacattatttcttattttattttttaaacatacaaaaagctgtacacagctttttaattaacacatacagcttgatgattttggacataagtatacacctgtgaaaccatcaccacaatctatgccataaatctttttttgttttttgttttttttagagacagagtcttgctctgtcacccaggatgcagtgcagtggcgcaatctcaggtcactgcaacctcctccccccagggttcaagcgattcttgtgcctcagcctcccaagtagctgggactgcaggcacacaccaccacacccaactaattttttgtatttatagtagagacagggttttgccatgtggcccaggctggtcttaaactcctgagctcaggcagtccacctgcctagacctcgcaaaagtgctaggattacaggcatgaggcactggctgctatgccataaatctatccatcacctccaaaagtttcctcctgccctgttttattattttattattatctttttactctcaatggcatgatatggtataggaacacagagcaggcaggaactagtcccatggcctcaagcagcaaatttcccagcaattccggggtgctatggaaaagcatgttgtctctgccctggactataggattggatacattacttaaatgctcctttgactgccttgggaaatgcaataatggctaacatcaattgagcacttgctacgggccaggccctatattagtctttttcatgtatcatatatattttattttattttattttatttatttatttatttatttgtttatttatttatttttgagatggagtctcactcactttgtcacccaggctggagtgcagtggcatgatctcagctcacggcagcctctgcctcttggattcaagcgattctcctgcctcagcctcccaagtagctgggattacaggcacatgccaccacacctggctaatttttgtagttttagtagagatggagtttcaacatgttggccaggctggtctcgaactcctggcctcaagcaatccactcaccttggcctcccaaagtgctaggattacaggcatgagccaccatgcccagcctcatgaatcacattctcttttttttttttttgagatggagtctcgctcggtcacccaggctggagtgcagtgatgcgatcttggcttgctgcaacatccacctcccaggttcaagcaattctcttccctcagcctaccaagtagctgggactacaggcgcccgccaccacgcccagctaattttttttttttttttttgtatttttagtagagatggggttttactatgttggccaggctggtctcaaactcctggcctcccaaagtgctgggattacaggtgtgagccaccacgcccagtcgaatcacattcttaaattagcatagtctttccaggcctatgcatatgatttcggtggtggtttccgggttggtttaggcaatggaaacacaacctggcaaaattaatagagaagattcagaaatgtcacccacagtcaaggtcacgagcccctcccttcagactcacttactcccttcagatacttattattcattctcttttccttcccccttcccagaatctcttttgtcaatattgttctactccattagcaaaacagactttatatcctattaatcaaatatttgtcccacttgagtccctttctcccctcacccccaggcccactgtcttcctgcaacagagaccaagaaggaaggaccctgaaggaagctcagggaaccctgatcttcagtgtagggttgcgtctgttctgagtggagggaagtgctctgtgaccacacatgcccctcctacacccccagggcaaagaaatgtggtcaaggtggaaggcagtgcagtacctggttctcatggagcacactcaagaaacgtgctcaggatcatgactctgataatatgactttaggctgggtgcagtggctcacgcctgtaatcccagcactttgggaggccgaggcaagcggatcacgaggtcaggagttcgagaccagcctggccaacatggtgaaaccccatctctactaaaaatacaaaaattagccagtgtggtggcacgcacctgtcatccagttacttgggaggctgaggcggaagaatcgcttgaacccgggaggtggaggttgcagtgagccaagatcacgccactgcactccagcctaggcaacaaagtgcgactccatctcataataataataataatagtaatatgactttaggtaggaccatcagcaaacccagagccagtacatgccctgaaaaacccaccgacgcaacatagcatttttcagattgtattttttaaatgtttataatatgtcatttacataccataaagctcacccattgaaagcgtacaacttggccgggtgcggtagcgtatgcctgtaatcacagaactctgggaagccgaggcaggtgtatcacctgaggtcgggagttcaagaacagcctggccaacatggtgaaatctcatctctactaaaaatacaaaaattagccaggtgtggtggtgcgtgcctgtaatcccagctacttgggaggctgaggcagaagaattgcttgaacccaggaggcggaggttgcagtgagctgagattgtgccactgcactctaaacagagtgaaactccatctcaaaaaaaagaagaaagtggtgtataattcaacgtttttttcatatacttatctagttgtgagccatcattttaatctaattttagaacattttaatcaccccaaaaggaaattttgtttctgtttgccgtcattctgcataccactcccttcccccagctttaggcaaccactaatctgcttactttctccatagatttgcctcctctggacatttcatatccatggaattatacagtgtggcctttggtggttggcttcttctacttagtagcatgttttctgaagctcatctgtgttggtgcatgtatcagtacttcatttcttcttttttttaaatttcaacttttagatacagggggtacatgtgcagaatagttatatgggaatattgtgtaatgctgaggtttggagtatggatcctgtcaccctgtggtgagcatagtaccccatggacatgatttcattcttttttatggctgtgtagtattccatgggcacctagattgatttcatgtctttgcttttgtgaatagcacagtgatgaacatatgagtgcatgtctttttggtagaatgatttcttttctttgggcatatacccaataatggggttgctgggttgaatggtagctctgtttcatatgtttgttggccacctgtatgtctttgagaagacttcatttcttcttatggcacagtaatatttcattgtatggatataacacatgttgtgtatctgatacaggcaagcccctaaatgggtgcttagcccaggaggttcttggcttcacccaggaaagaattcaagggtgagccggtggtgttaaaagttgaagcagtaggccgggcgcggtggctcctgcctgtaatcccagcactttgggaggccgaggcgggtggatcacgaggtcaggagatcgagaccatcctggctaacacagtgaaacccccgtctctcctaaagatacaaaaaattagccgggcatggtggcaggtgcctgtaatcccagctactcggaaggctaaggcaggagaatggcgggaacctgggaggcggagcttacagtgagccgagatcgccactacactccagcctgggcaacacagcgagactccatctcaaaaaaaaaggacaaaaaaaaaaaagttgaagcagtagcagcagaggtgctgctccttgcagagcttgactgccccctaagcagtgtgcccagaataacagcacagaggcagtgctccactcattttatagtcacttttaattatatgcaaattaaggggtggtttatgcagaaatttctaggatgcgggtggtaacttccacgttgtcaggtcattgccatggaaaggggcagtaacttcacagtgttgccacagtgatggtaaatgacatggccgcttcttatggaaacctgcttccgccctagacctgttttagctagccctcaatttggtccagtgaccgagcgagcttctagaatcaagtcttcatttctcagtgtttgttttgttttgttttttgtttttttgttttgagatggagtcttgctctgtcgcccatgctggagtgcagtggcgtgatcttggctcactgcaacctccacctcctggattcaagcagttctcctttcccagccttcccgagtacctgggactacaggcagatgccaccacgcccagctaaatttttgcatttttagtagagacggggtttcaccatattggtcaggctggtctcgaactcctgacctcaggtgatccacccacctcggcttcccaaagtgctgggattacaggcgtgagccactgcacctggcctcatttcttcctatggcataataatatttcactgtatggatataccacctattctgtatccattcatcagtaatgcagttgctgggtagctctgttttaagttctttgagaagtctccagactgctttccacagtgtggactaatttaccctcccacctacagtgtatcagcattccgttttctccacggcctcaccagcatctattgttttttgactttttaatgatagccattctggctggtgtgagatggtatctaattgtggttttgatttgcatttctctgatgattagtaatgctaagcattttttcatgtttctcggcgacctgtatatcttcttttaagaagacttcatggtcaggcatggtggcttacgcctgtaatgccagcacttcgggaggtcgaggcgggcagatcacttgaggtcaggagttcgagaccagcctggccaacatggtgaaaccccatctctactaaaaatacaaaaaattagctgggcgtggtggcgcatgcctgtagtcccagctactcgggagtctgaggcaaaagaattgcttgaacccagaaggcggagattgcagtgagccgagatcatgccactgtactccagcctgggcgacagagcgagactccatctcaaaaaaaaaaaaaaaagaagaagaagactttgtttctttgtatgccagaataatatttcattgtgtggatataccatatattgtgtatccatcaatcagttcatggaaatgtgtattgtttcccttttttgtggctattatgaattagaacatccatgtacatgttttgttttttggggttttgtttgtttgtttgtttgtttgttgagacagggtctcactctgtcactgaggctagagtgcagtggcatgtttacagcttaatgcagcctcaatttcctgggctcgagtgatcctcccaccttagcctctcaagtagctgcgactataagcatgtgccaccacacctggctaatttttgtattttttgtagagaaggggttttgccatgttgcccaggctggtcttaaactcctggactcaagtgatccacctgcctcagcctcccaaagtgctagggttacaggcgtgagccactgcacccagcccatgtacatgtttttgtgtggatatgtgttttcaagtctctcgggcagatatctaggagtgaaattgctaggttaaatggtaaccctatgtttaatcttttgatgagctactgaaatgttttcaaagtggccacactatttatatttctgtcacaatgtatgagggttccagtttctccctatctttgccaatgcttgttattgtgaacatagaatttaactagtctttcacttaggtatttaccaaattttggctaagattctgatgtcccagccacatgtgtgtgatacgtcgaatagggttgaagcattcactcaacaagcatgtattcaacatctgtgatgtacccacctgccagacccatgacaggggaagcttcagaagcagaaaggaggagccctcattctgagccacccaggaaagggtccttggaggggatgacactgaagtactttttttttttttttttgagacagagtctctgtcacccaggctggagtgcagtggcacaatctcggctcactgcaacctccgtttcctggattcaagcgcttctcttgcctcagcctccctagtagctgggattacaggcatgcatcaccatgcccagctcatttttttatatttttagtagagacgggcttttaccatgttgcccaggctggtctcaaactcctaacctcaaatgatccacccaccttgtcctcccaaagtgctgggattacaggcctgagccaccgtgcctggccaagtgtttttttgttttgttttgttttgtttttaatacagctgggatcttgctatgttggccaggctggccttgaacttctggcctcaagcaatcctcctgccttggcctcacaaagtattgggattaaaggcgtgagccactgtgcccggcccctaagttaagtcttgaagcaaggaaaggagaatcaggcagagtgcaggacttggtgggggagaaggaacttcaggaagggggaccagtgcctacctaggaggttccagactcctggggctttggagaatgaggccagcagaagcttcttaaggctcacgagagaggtgtggctttgggaggctggtccggaaaagatgccagaaaaataagtaataacatcaaaggccttgtacctccttcctgccagggcatattacttttatgctacactcatggtgccatggacagattttgaggaggggagtttacatctgggaggccaccgtggcagcagagtggggaatggtggatggagagattgagaagaggcaggagggcaagcattcacccgctactttgatgaaggcctggcgtcagctggcatggaagttggccctgggagtgcactgtgttttttaggggagctacagttgtggaagtggtcaccatagcaaaaaggtcctaacagaggaggcagatctgtaagggaagtcaagggcagcctgaaagccctctttagaggccagtgccagatggccttggcggagccacggccagatctgagagaataaacctgtctttatttgtaagcagcctgcttttacctcccaagcccacccctgagacacagtctggtctgcattaaaagggctggggctgtcccagccaatttgattttgtgtctcatcctatctacttctcaacacaggaccccttgactgccaggtttctcctgggaggggagatgccaattttctgcttcagcctgtagactccgctgtgtgctgtgaggttctttcccttcctggggtccaacatccccgtgaacaggaccaggactagccccaaacccacagctggacagcagatcctggagcagctgcacgtcttctttatgataatgaaaactggctgggcccggtgacccacgcctttaataccagcactctgggaggccgaggtgggcagatcacttaagcctaggagcttgagactagcctgggcaacatggcaataccccatctctacaaaaaatacaaaaattagccaggcatggtagtgtgcacctgtagtcccagctacttgggaggctgaggcaggaggattacttgagcctgggaggtcaaggccgcagtgagccatgatcctttctcaaaaaaaaaaaaaaaaaagtactgaaaattagctcatacatacatatttaagcataattactgggttttatatagtttacatgttctaaggtatctctgaaaaaaataatcttctaatgaaataatcagcaaatgattggctaatggcaatcattagacaaatattggatgattaaacttaaaaaaaaaaaaaaacccttgctgggcacagtggttcatgcttgtactttgggaggcctagcactttgggaggccaaggtgggtggatcactcgcgttcaggagttcgagaccagcctggccaacatggcaaaacccggtctctattaaaaatacaaaaattagctgggcatggtggcgggtgcctgtgatcccagctacttaggaggttgaggcaggagaattgcttgaactcaggaggcagaggttggggtgagccaagatcaaaccactgcactccagcctgggtgacagagcaagactccatctcaaaaacaacaacaacaaaaaaacccttttacctgtttttttcattcttgtaattgaagtataatacaaatcttaagtgtaaaactcagtgaatgtgtacacgttacatccaggtcaacatataatcatcccagaagtttccttcatgtccctttgcaccaagcccccacccccaaagagattactgctcatctaacttttatcaccatacataaagttttgcttgttcttgaacttcaatttgaatcatacaatgtatatgctattgcatttggctacttttgcttaacatagcatcagtgagagttgtacacgtttttgcatgtatcagccatttgttctttttcattgctgtgtagtattccattgtgcacctagaccacaatttatctgtctagtttcttgcttatgaacatttggactgtttccagtttttgcctcctgtatttaaagctgtcgtgaggccaggtatggtggctcacacctgtaatcccagtactttgggaggccaagaagggaggatcacttgaggtgagaagttggagaccagcctgggcaacatagtgagacccatctctacaaaagaagaaaagaaaaaattgaggccaggcacggtggctcacacctgtaatcccagcactttgggaggccgaggcgggcagatcacgaggtcaggagatcgagaccatcctggctaacacagtgaaaccccgtctctactaaaaacaaaaaaattagccaggcgtggtggcgggcacctgtagtcccagctactcgggaggctaagacaggagaatggcgtgaacccgggaggtggagcttgcagtgagccgagatcgcaccactgcactccagcctgggcgacagagcgagactccatctcaaaaaaaagaaagaaagaaaaaaagagaaaagaaaaaattgagacacaatataattcacccttttaaataaatgtgcaattcagtggtttttcgcatatgcacaaggttgtgcaactgtcaccactgtctaataccagaatgttttcatcactccaagaggaaatgttatatccattcataatcactctacatcccttcctttcctcaatccatgtcaactactaatctactttctgtctctatgtttgtttgtttgtttttgagatggagtttcgctcttgttacctaggctagagtgcaatggcgcaatcttggctcaccacaacctctgcctctcgggttcaagcaattctcctgccttagcctcccgagtagctgggatgataggcagtaggtgggattaccaccatgcccagctaatttttgtatttttagtagagatggggtttctccatgttggtcaggctggtcttgaactcccgacctcaggtgatccgcccgcctcagcctcccaaagtgctgggattacaggcgtgagccaccacacccagccctatttctatgttatttaatacttattcctgacatttaataatgatggtcaaacttttaatatatcaatttctttgatttttttttttctaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtaagtggtccaacagcagttcctgggctgtggacaaggtaactgtctatattgccaaattggagtccatgatacacaacaggtgcacaaatacatcaggtcactgcatctcaaaaacactttttgggccggttggggtggccaacacctgtaatcctagcactttgggaggccgaggcgggtagatcacttgaggccaagagttcaagaccggcctggccaacatggtgaaaccctgtctctactaaaaatacaaaaacattagctgggcatggtggtgggtgcctgtaacccagctactcaggaggctgaggcaggagaattacttgaacccgggaggcagagattgcagtgaaccaagatcgtattattgcactccagcctgggcaataagagagaaactctgtctcaaaaaataagaaataaaaataaaaaataaaaaaataaaaaatactttttggatgaaaatgcattttatgcataggttcaattttcttccactaatagatgttttatgccccatctctcattctgtgacctccatgtctattaggcaagcgtatttgggaaacacacttctcagtttggtattggactcatctactcccagacagagaaacttgggaaacagccaaagggcttatctgtgagcacagcccctaaggttaattgccacccaaaagatctacaaatgtaagcacctaagcagaagatgcccagaggtagaacaagaaatcccaatagtcccattagacagtataccccagcatttctgcttctttaataattctgttactaaagtagccaggtgtggtggctcatgcctgtaataccagccctttgggaggctgaggcaggtggatcacttgaggtcaggagttcgagaccagcctggccaacctggtgaaaccctgtctctgctaaaaatacaaaaaaattagccgggtgtggtggcacgtgcctataatcccagctactcaggaggctgaggcagggagaattgcttgaacccaggaggcagaggttgcagtgagccaagatcgtgctgctgcactccagcctgggtgacagagcaagactccatctcaaaaaaaaaaaaaaaaaaaggaaataataagaataattctgttaccaaataattgttaacagcctcgggatgcagatttcaattgtaaacctactttggctaaacatgttcattttggttttttgttgttgttgctgctgctgttgttttgagacggagtctcactctgtcgccaggctggagtacagtggcacaatctcagctcactgcaacctctgcctcccgggttcaagtgattatcctgcctcagcctcccgagtagctgggactactgggaggtgcgcacgccaccatgcccagctaatttttgtatttttagtagagatggagtttcaccatgttggcagggatggtctcgatctcttgacctcctgatctatctgcctcggcctcccaaagtgctgggattacagacatgacccaccgtgcccggccggcatgttcattttgtagcagaatcccacttggtgaagagtcatattttctcagggtttctaacatgactctgtccctcatgggagaaaaaaatgggaaatgcaatgttgagcattgccctttgtagctgctctcattttcataagaataaatactacccaaattgtctctacattccagataggctggttatctgtttatttttccacttaaaaactgataagagtagcttgccaaaattattttggagtcactggaatttaaccttaatgcactgagctttttgttacttagatggatttgtctattgagattgggggccagttaacaataaaaagtttaattctggaatttaggtccaagaactagactgccagtctcttgaaccctcataactcaggctcacggtaatggcagactctggcacaaacatgagagccctgggtgttttcttgaacagagaagcatgccactcctttcccgtgctccagaacccagccagccagccaggagccagaatgaaatgtgatacgtagaaatcaagctccaggatctcctgttttcctcctgtgtcctgattattgcacaggaaagcaattgcagctcccaaagtaaatgttttccagcctcagctttgtgtctatctaaggcagtgtcttccttggtttcccacagcatccctttttgtgtgtggctttttaaggtaaaaagacttcctcttactagggccactatcatagtattattttgttttgttttgtttttttgagatggagtctcaatctgttgcccaggctggagtgcagtgacatgatctcggctcactgcaacctccacctcccaggttcaagcaattcttgtgcctgagcctcctgagtagctgaggcacaggtgcatgccaccacaccaggctaacttttgtattattagtagagacggggtttcaccatgttagccaggccagtctcgaactcctaaccttaagtgatttgcctgcctcggcctcccaaagtactgggtttacagtcgtgagccaccatgcccggcttcatagtgtgttttccactcacaaagcatatttaataaggcagagttgtcagttaaaaagagaataatacaaaataaaaataaggctgggcgtggttcacacctgtaatcccagcactttgagaggccgaggcaggcagatcacttgaggtcaggagtagttcgagaccagcctggccaacatggtgaactctcatctctactaaaaatacaaaaattagctgggcgtggtgacaggtgactgtagtcccagctactccagaggccgaggcaggagaatcacttgaacccaggaagtagaggttgcagtgagcctaggtcgcgccactgcactacagcctgggggacagagcaagactctgtctccaaaataataataataataataataataataatttaaaaggccatatttatattgccccagggtccactgtgtttcttttctcacagatgactcaggctagttttgagaatctgtttcctgaaaatacctgtaagatttatgccttgccctttccaaatataaggaagtgttattgacactccagaaacgcacctgctctcgcacgtgagtcgctaatgagtatctgaggctagcatttgcatgggttgaaggtgccagggatgcctttctctgaacacctttgtttttttaagaatctattcacagttaaggggaaaaaaatgttcgaaagcgagccatgagcacattattgaattctggtttccagccgacagctgtgttgtgcttcgtgtaatagggtacatttactgatgcctcgatgctgttcttttgatttccatgaatttgagacactcagcactcaagtgtgtatagctgtgtgttgtttcttgtattcattatgtgtttcctactttcaagtcataaaagcctcactagatatccagaggcctggagtcataaacacttcattataaatgctttccttgtttctgcaaattcactgaattaaaatccttcatttattgaaacatgcttgaaccttccacgagaggtttttcacaatcactggatttgtttggcaggaagaaaggaatgttacagggatactgtgagtatccaagaaatgtaaaaagacatatttacccaggatggaaaagaataccatgaaataaaaacacatgaacagtatctcacacacgcagacacacacacacacacaaatggtatatactattttccttagccttctattgccattatgtgtcaccataagaaacaatttcatcctttttgtgtccagtcaagcttgtcattcccattacgttctattctagttcaggtctcttttttcatcctttcaatggtaaacggcctttttccccctcttctattacatgaaagtcaaacctaaaaggatatttacttatcttgtatctcacacattcatttatgcttgtttaaaaattgaggccaggcgtggtggctcatgcctgtaatcccagcactttgggaggccgaggcaggcagatcacaagatcaggggttcgagaccagcctgaccaacatggtgaaaccccgtctctactaaaaaaatacaaaaattagccgggcatggtgacaggcacctgtaatcccagctactcaggaggctgaggcaggagaatcacttgaaccagggaagcggaggttacagtgagccgagatcgcagtgagccgagatggcgccactgcactccagcctaggggacagagcgagactccgtctcaaaaaaaaaaaaaaaaaaaaaaagataaaaagaaaaattgaatcaatatttattttttaaataattttttgtgggtacatagtaggtgtaaacatttagggggtacatgagatgttttcataaggcctgcaatgtgaaataggcacaatgtgaggaatggggtatccatcccctccagcatttatcctttgtgttacaaagaatccaattacactcttaagttattttaaaatgtacaattaaaaaattgaatcaggctgggtgaagtggctcacacctgtaatcccagcactttgggaggccaagacaggtgaactgctcgaggccgggagtttgagaccagcctggacaacatggcgaaaccctgtctgtactaaaaatacaaaaattagccaggcatggtggtgcgcacctgtagtcccagctactgaggaggctaaggcacaagaatcgcttaaacacaagaggcagaggttatagtgagttgagattgcaccactgcacttcagcctgggggacagagcaagactgtctcaaaaaaaaaaaaaaatcagtatttaggatatgtcatcagaaaagagggaatgttaagtgctgttcactttttaggatatgtcatcagaaaagagggaatgttaagtgctgttcactttttaggatatgtcatcagaaaagagggaatgttaagtgctgttcactttttaggatatgtcatcagaaaagagggaatgttaagtgctgtttgcttagaagtgacttgctgtcggccaggtgcggtggctcacatctgtgatcccggcagtttgggaggtcgaggtgggtggatgacgaggtcaagagatcgagaccatcctggcaaacatggtgaaaccccatctctattaaaaatacaaaaattagccgggcatggtggcccacgcctgtagtcccagctacttgtgaggctgaggcaggagaattgcttgaaccctggaggcagaggttgctgtgagccaagatcgcgccactgcactccagcttggcgacagagtaagactctgtctcaaaaaaaaaaaaaaaaaagtgacttgctgcctagaaaagtgttctagatttccaaaatttatgacctcctggcaccagtgagacacaccctcccacagatgaaaagtagatgctgttttagttaaaaataaatggagagaaaaacttcaaggtaattaacctagatatttatttgtatcactgctgtgtgactgtcaagtatttgtcattagtttgtacacacacccagccctactctcaaataagacaaagagatgaatatactgcaagtgtgtgtacaccatggggaagggctggaggtgtgtgagcactataggacctataggcagcctgtaattgtcatcacctatggacagagggattaagaactctgtaatcaccaagatccccagaattgttaacaacttgtcttccagatagttttcatcaaagatgctattatttcagtctccttcttttactttttaggtggtccgagacattctgctgattggacatagacaggcttttgcatgggttgatgagtggtatggtaagtcaatttctccaaaataacttgtagaacaacttcatgttgtctcgggctttctgtccatttggcttcaactgctacctagaaggacaacaacaaaggcaaggccgctgcttcctgtgttggaaatagcactgtctgccaagcataatgaagatgtaattatagaagcttggtctaaaataaccacagaattattgactaagtaggaacctcaggatgtttgatgcttacatagttgatacgcatggctccatcattctctgttagatgggtttcaaacccatcctaatttatcccaaacttcaagatcaaagctgtctgaagcatcctgtcaagtaaaagcagtcctttgattcagacaacatttgaaaccaccccttgccgggcgcagtggctcacgcctgtaatcccagcactttgggaggccgaggcgggcagatcacgaggtcaggagatcgagaccatcctggctaacacggtgaaaccccgtctctactaaataatacaaaaaattagccgggcatggtggcaggcacctgtagtcccagctactcaggaggctgaggcaggagaatggcatgaacctgggaggcggagtttgcagtgagccgagatcgcaccactgcactccagcctgggggacagagcgagactccgtctcggaaaaaaaaaaaaaagaaagaaagaaactacccctcaacaaatatatacaggttctgcaagaatttaagggcagacagaggcataggtgccccgttcatcctaattgaaactattgttctggcttttttttcatgatctgggaagagttaaacaatttctacacatttgcagcaaatgaaaacaaggttagcttcatcccatgatggatggaccatccttcccaggtcctcagcagtcttgttttgtccacatgaattttctgcactcccagaatcagtcatcagatggctaccgtccttggctataaatagaaaggaacacgccccaccggtgacttaggttagatctgattttcaggtcgattgtctaatgaaatgcccttctccttggccttttccaaagtcacattaaatttgttctgagtataacctagattgcattttggtccttttctgtcattgtttcaccaactccctcccttttctgagcagaaggtaccaaagtaaaaggacacgttagacggaaggggcaaagacagtcattattattaatattgttagctatttctgagccacatttaaaaggcatggttctataagctatgggcttttcttttttttttctttttttcttacctccttttgcagttttcccagatctgcaccttctgaagagcaaatgcaccttcctgggtttgtccaaatgcagatcatttatgctctcttatcacacacccacagaatgccgctctcataccgcaaaagcactggcttgccacattgtcatgtagtctcccagagacctgtctatttctagttgtgttttgtgaggcaggcaggagagtctcctgtgattacttcctctgatccttaaataaatctttctggttgtttttttctggggcgcttttctccgattctcagagggagcacagaccccaagaaaggataagaacttctggtctctcccagcttgtgctcctcagagctcatggtttccttgctaccaacaccaaggaaatatcaaaaggatatttaaagaatcataggtgcaaactgattagaagtttggcaaaaagagaggtacctgaagggccaaaaatctgccactttgaaaaccaacacacagggcacttggataggtttctctctgttgccagagtgccaaagaagatttttcagctaaaagaatagccgggctctgatcaagaggacagaataataaaaagggtttgattagaggcaggatataggaagaaaacccagtgtgggtgggtatctagtaaatgaaaggccaggaaggcgatggggcctgacttttccatctcagctgagcctagggcaaggaagagacttagggacttctttttttttttttgagacagagtctcgcactgtcgtacggactggagtgcaatggcacaatctcggctcactgcaacctccgcctcccaggttcaagcgattctccttgcctcagcctcccaagtagctgggattacaggctcccaccaccacgccctgctaattttttttgtctttttagtagagatggggttttactatgctggccaggttggtctcaaactcctgacctcgtgatccgcccacctcagcctcccaaagtgctgggattacaggcatgagccactgcgcccggccttagggacttctaataaaagacttagggacttctaataaaaattgaaagaaaaaaaaaaactgccaggcacggtagttcacacctgtaatcccagcactttgggaagcctaggatggaggatcacttgagcccaggaattcgagaccagcatgggcgacatagcaagacatcatctctacaaaataaataaataaaattagccaggcacagtggtgcatgtccgtagtcttagctattcaggagaccgaggtgaaaggatcacttgagcccaggagctggaggctgcagtgagctatgatcgcagcactgcactctagcctgggtgaccgaacaagacctcgtctctttaaaaaaaaaaaaagaattctgggattacaacaggagcccaaggctagaataatgtatcaaaggaaacaggagatctccccgaatctggagaccttcaaaagagagcacttatttacttaggatgagtgaagtggaggcatttaacaactaaggagtctattgtgcaaaaaaccttttccttatctgagcacaaaacaacactgtgggctttagtgaatgtggatcattaggacaccttgcactccccagagtgggtctccccctgcatacactgacatagccccagccaaaacaagcagccttttcactcagcagtggtctgagaactacaccgttaatttcatgtaagcttctgcaaccatcagtacccacagctgagctgctgaccaggaaaacagtggctccttcatcacacagatgcagacactcagtgaatcaaatgaatggaaatgactcctgtccacagagtgccttctcagtcccatattcaaagtaattctgggaactgtgggccatatgtgccactggtacccaggctaagcgcccaccagcattacccttccactccattttggggtacctgaagtggcctatttttatttgttctggacaggctcagtgagactctcatggaaacatggaaacatggaaacatggaaaagatccaaaataaatccttgcctatagctatagcgtctagcactggttctcaaagtaaggtccctggacctgcaacgtcagcatccctagggtacttgttagaaatgcatattctcaggccccaccccaaacctactgactcagaaactctgagggtctagcccagcaattgttttaacaagccctccagatggttctgttgctggctaaagtttaagaactactggcttatagcatgggctataaaccagactgggacattgggttgtaaggaccgtttaattgattcaatccaaataggttaactagagaatcatagctgtctgcagggccaaccacactccagcctgggcgatagagcgagcctttgtctctaaaaaacaaaaaataaaatcaattttaaaatgattgcaggaacccaaattcttacaactctgatttcttgtgagaattagaaaaaaaagcttccctttagacagatgaattagaaaaaggtgccccttctgggcagactcagcaggtgctctgggcttagggctgaatttgagccccatttgcctcctctgctgtgtgttcatacagtgcacaaactgtacacactgatgcatgggtagctctagatgtctttctctctaattagacacaccacctccagtgcttaattaagagtcaagaaaaaaggacattgttgagggtagtgatcatttgtcagccaaggatgaattttgtatctcttctgagtttcagcatttggctgtcacgaaactgtttccctaaagagattttattctgttcgtgttcattgtaaagtgtaaccatttccatattggaggagttgagtgtgtctttcaaagccgtgattggtctttatccatgagccttgggtctctctgcacgactagaacgctaatcagagaaataacaacaacgtatttcaggagatggggtgagagggaaggtggataaaaataggcagcccagtttcacaaaggcttggttttgctttacaaatctgacagtgttttgagaaaggaacacagaacattgccagaaggagcctatgattgaggtgaacctcacgaatgtctttgaaaacctgactctaaccaaaaagtatgagggagggagagttctggctgctgtagacgacactacctcatgaaagtgacttagaaatcagcctggagtccctagagcaggtctaacaatgagggaggcaagattaaaatggagaaagaagcctgctaggggttgcatgagctggttgagttcaccaagccagattttccaacgcaacattttatgtgtgtgtgcttgtattcgtttatctggggagagaatgaataactttccatcagattttcagaggaacctgtgaacccttcccctgcctactccctgctcccaattaaaaactacagaaaaaaatcacaactataaggctggcacggtggctcacacctgtaaccccagcactttgggaggccaaggcgggcagatcacctgaggtcaggagttcgagaccagcctggccaacatggtgaaactccgtctctactgaaaatacaaaagttagctaggcgtggttgcgggcacctgtaatcccagctactcaggaggctgaggtaggagaatcgcttgaacccgggaggcagaggttgcagtgagctgagatcgcaccattgcactccagcctgggcaacaagagtgaaactctgtctcaaaaaaaaaaaaaaaaatcacaactatagattacagttctagatcttagtggtctgaattatgtggaaaaggtatacaccacacttcgaggactggctactttcactacaaaaaaatggagtcaccctaagctttttgtaagaagcatgtattgaatttgtaatcattgtaaagggtttaaaaaatggcatttctcaaaggatggctaccattttgctggagccaaagaagtatccattcttatttatgatttctggggcctccctgacccaactacttgttcaagacttttattttgacttagaatgatgtaaaaatgacttctgttttggtgaaggaggctgaaagtgaacggaaatgtttgtagagggaaataaagtataatgtgccatttcacagatcattgaattagaacagaagactcccctttttaaaatgtttgctgctgcaactgtgtggtacaatgaaggaaaattcacgcttgcagatgctttgttcaagggcatttgtagtttccatgtgtgttcaactgacttctaaaggcctttcaaacatatgatcttgcctccacttcctgtgaaattaacctcctttctttaaaaatacaatgatttaaagaaaattgccaccataaacaaagctaaaagactaggggaaaatatttgctgcatatgtagtcaacaggattaccatctataatatataaagaggtcctataaattgaaaatttggccaggtgtggttgttcatacctgtaatcccagcactttgggaggccaaggcaggagaatcactcgagctgaggagtttgagaccagccctggcaacacagggagaccccatctctacaaaaattaaaaattagctggacatgatggtgtgcctgtagtcccagctgcttgggaggctgaggtggaaggaccacttgagtctgggaggtcaaggctgcagggaactatggtcacaccactgcactccagcctaggtgacagagcaaaaccctatctcaaaaaaaaaaaaaaaaaaaaaaaaaatcagtcactcaagaaaatggtaaaggatatgaataagtaaatcatagaagaagaaatacaaatagccaataaacttactagtaatcacaagaaccgtaatgagaaaaacaagaaaataggacatttgcccatctgatagcaaaaatttaagagtgattatatccagttttcaatataaaatgataatccaatttaataaaatataccatagaaatgataagcacaaacaacttatgacccagccaatccacttccagaattttattctggaatacacatgaggccaggtgcagtggttcatgcctgtaatcccaacactttgggagaccgaggcaggcagatcaccttaggtcaggagttcaagaccagcctggacaacatggtgaaaccccgtctctactaaaaatacaaaaatagttagctgagtatggtgacacgtgcctgtaatcccagctactcaggaggctgaggcaggagaatcgcttgaacctgggaggcagaggttacagtgagccgagatggcgccactgcactccagcctggggacagagtgagactctgtctcaaaaaagaaaaaaagaaaaagaaatacaaattgcccatgaatacatgtacaacaagtacaaagctattctgtgtggtggtgttcatataagctaaaaattagtctcagtgtaaatgtttactaacaggattatcaattaacaaatcccctgagaccagagcctctttgccaaagtggagctgatggttgaggaggagattttggcctcagcccagtcactggcagaggagaacgttctactcaggccccatgcagtatgacctcacgccctgagataagagtctgggatctgatctctcctcacctgaaggagagcaagaaagagaagaaaagaaatggcctctccagagggcaaggaaaggaaatattgtcccactgaagtacagtgagcagggcatgtgtgttcccaaaatacttcccagggctgtttaacctctgatagcagagtctcaaagatattaggatgcactttctttatcagaagaaataccgtaccagttgcaatattctcttaaattaggcaattatccccagtattgctggcttaaggagtctttatgtaggaaaccttatttaggaagagtaaattatgacctttcacaatctataagtgaagggctgactgtttaccaatgtatttgcaaagtaattgacatgggcttcctttaattaagagtttgggccgggtgtggtggctcacgcctgtaatcccagcactttgggaggccgaggcgggtgaatcacaaggtcaggagttcgcgaccagcctggccaacatggtgaaaccccgtcactactaaaaatacaaaaattagctgggtgtggtggcgggtgcctgtaatcccagctacttgggaggctaaggcaggagaatcgcttgaacccggaaggccgagtttgtggtaagccaagatatcacaccattgcactccagcccgggtgacaagagcgaaactgagtctcaaaaaaaaaaaaaaaaaaaaaaaaagagttgatacacataagcatttgtttgctggaagcaaagaagtctgaacctaaattgtttgaagtcactctgatcattgaaaatcaatcaataataaagatgaatcatcattactgtataatctgtcattgggcacatgtaactgaatttactaaaatattgatttctacaaagattttgaggtcatatatgttgcaaaagctagacagtgcattttaccagctaacctgaacaggagcattttcacttgattaggatttccataaatttctgagaaatactgaaaatatttacatcatgttcatacacatttatagtctgtgaggatatttcaggatttagacaaacatattttccttcacagcagggaccatattatcaccatcttttagagaactactctactaggaatgttcattcctatgtggcaaaattgggagattttcttttatagaattttctgaaatttcatttcttaactctttgtttaaaaaaaataataggggatggctgggcgtggtggctcacacctgtaatcccagcactttgggagggcgaggtgggcggatcacttgaggtcaggagttcgagaccagcctgaccaacatggtgacaccccatctctactaaaaatacaaaaatcagccgggcgtggtggcacacaccagtaatcccagctactcgggaggctgaggcgggagaatcacttgaacccgggaggcagaggttgcggtgagctgaaattgcaccagtgcacttcagcctgggtgacagagttagactctgtctcaaaaaaaaaaaaaaaagaaaagaaaagaaacaggggattatgtttctagagtgaacagaaattctggaaaagtctatcttctccttaccaattccaaattgacggtatccatctcataatgatccaaaataacaaattttttttttttttttgagacagagtcttgctctgtcgcccaggctggagtgcagtgacatgatcttgactcactgcagcctccgtctcccaggttcaagcgattcttgtacctcagcctcctgagtagctgggggttacgggtgtgtgccaccatacctggctaatttttctatttttagtagagacagggtttcaccatgttggccgggctggtctccaactcctggcctcaggtgatccgcccatctcggcctcccaaagtgctgggattacaggcataagccaccctgcccagcccaacataacagattcttaaataatgtttttttttttcttttccacaagcaacgcatatttgatgtagaaaatttcaaaaatgtagataagcaaaaagaaggaaattaaaattacctgtaattctaactcttcaaaataatcactgttaacattttgaaatatatcctttcagtgtttttttaatgtagataatggttttctgactaaattgatttcatatgctatatacagttctttttacctattttttatttaacaatagattaaggatatctctctaggattaactattcttctacctaatttttaacaattgcatagtgctatcagtcccctgggttgttttcaatttttcattattatgaacattgctgaacaaggcagcaatgaatatctttgttgttaaaccctttttcacatccataaaatggatacatctttgaaagcccatagtcacaaagtttaagcccctatcttgacgttgagctaattcaagatgaagtatgatttctgtggggattcaatagaacaaaaaaacctataactccttggcttttgttttccaaattactgtcatgcctgttgggatggtggggggcaccccctaatgacatatgtgtagagaaacttctttaaattttcaactcctagctaaaagtgatcgtctagtattatttcagatatatttgtgtttaagaaatgttgataagcagccattgaaagtgattgtactgaaagaatgtgttgttattattaactaagatgcatttgttttcatcataaagcagcatctctttattgctttttggttacctcgattttctaaaagaagagcatgctccttgcttggccaagctgctgcttagcattcttgatacttacattgcttatggaccgcatttgcgattgaggatctccaggtatacctgggaatgatcttctgcataaaatagaccaggtctggatttagaggcacacagcatcttggtcccagaccacagtgaattaaatcataaactcctggcaaatctgccctttggaaatgaagaggatctcacatgacacatggattgatataaaaagacaccaaaccacatgatgcagaaaatacctaaggaaaaattccagctgtgaatgcccactctaaatccccactaagccaattagtggtcagggtggcagaggaagcactttgttcggcataccatcattggtaaagagcatgaagttccgctctgccaagagagtaacagaggaatgcctacctgggaatattgctgataaaatgtaaaataaccaaggagccgggtaggggtgggggtaaaatgacagaagtatttgaagtgagactaattgttatttatatgcatttcacatactgaaggtggatgggttccttatttaagttttttttgtttggttggttggttttttttgagacagggtctcactctgtcgcccaggctggagtgcagtggtgtgatctcagctcactgcaacctctgcctcccgggttcaagtgcttctcctgtctcagcctcccatgtagctgggattacaggcgccctccaccatgcccagctaatttttgtatttttagtagagacggtgtttcaccatgttgtccaggctggtcttgaactcctgacctcaattgatccacccgccttggcctcccaaagtgctgggattacaggcatgagccaccatgcctggcctgaacatttttatcagttggattaagacagggtttctcaactttggtactattgacattttggaccagataattttttgttgggggctgggggtcctgtgcattgtaggatgctccatagtgtccctggaatctgcacactagatgccagtagcaccccttccctagttctaacaaccaaaaatgtcacaaaattgtcccccgttgagaaccactagattaagagatcattatcctgaaatactgaaaaactgcagacttgggccaaaaatcatgtcatgtgccattttatttttagatcagtgtgggtggaagtagtgccagccatcttcaagctgttagccaagacttgaggttcagtatagacctgcactctctgacgccatgcattctgtgcaaatttacatctgtgtgcaagttgcaccaaatctcaattgtaccagtgaatatcattgctctgccttctacatcctgcctcctataacagcaatgaaagtgtcctttctgttgttgaatgcattgatttaaacaacctctaaatctattttgaaagctatgtggaaggtaagtattaaaccaagcaaaactgaccctctgtccccaatgggatcttctaatgatgctttaggagatctcaggctatggtactgcccacatgctaatactttctacccaaacctagctcactttacaagaatcacccctaaataatttccactcttctctgttctaagactattttgacttaacttccttgccctcactccccctttggttggtttagctaactttatgacttactcatcataaagttagacaagtctctgcttttttaaacctccttggctactgctcagctaccatctttccctaaagtgtccccattgaaagtttgcatctaataacggaagttgccaacatcttgacctctttcagatatgacaatggatgatgttcgggaatacgagaaaaacatgcatgaacaaaccaacataaaagtttgcaatcagcattcctcccctgtggatgacatagagagtcatgcccaaacaagtgtacgtagaatttttaaaacatgttgcccaccctttcacaaatgcacatgtaaactgatctgggaaatactgcagatgcccggttcgcaaccttccatagaaacatgtcgtcacccagaccctgttgctgcagaacctgagctggatctaaattgggcagtgtcacctctctcttccagacatttcgatcccttaaagttgcttgacgtggaggttatttcggtcataaaaccaagaacatggagagtggaaacacttttgtgggactagtaaaacggcctgcaccataaaagagcagaggagtgaaaatcgatgtcatatgtaaactagaataacatgtcagtaacttttaaaaacatagctaacactcacttattcattcaagggagggcttctggctcatcagctattttaggtttctttacatttgctttgaaaagctttctgtggctctttatagctgttttacccaatcagttcctttttacttaggataatctcaagatgggctgcagtctgtgcagacacacaggctgagcagtgaaggggtgtgagctggggatgtgctgagctgcctagcagatccctgggacttagggtaagccttagagagcctcagttatttcgttgcacactggaaattgagagctgactgtatattgtatgccagcattttaagtatcgtaatctctcaatcattcatgctaatgaagggtagctagagataacaaagaaaagtgtaatcaccaaatcatttctttgcatcttcagccagagctgtgatctctttgggttccgccttgagtcctcatgtccattagcccagtctccagaataatacatagtaggtgttaaaaaaaaaaaaaaaaatcagctgggcgcggtggctcatgcctgtaagcccagcactttgggaggccgaggcaggtggatcacctgaggtcgggggttcgagacaagcctgaccaacatggagaaacctcgtctctacttaaaatacaaaattagctgggtgtggtggcgcatgcctgtaatcctagctactcaggaggctaaggcaggagaattgcttgaacctgggaggcagaggttgcagtgagccaagatcgcgccattgcactccagcctgggcaacaagagcaaaattctgtctcaaaaaaaaaaaaatcaatgctgtagttctaggaaatttagatgtggctgttgtcataaatggatcctttagaattgtgaagaccttctgattgcactttggaaatttttagttaaatttttggagcatgtctttggaatgtgccctgcaagtctcatgtgctgcaactggttgcatgtgattgcccttgaggttgcaagggccctaactcttctcccattttgcatgcagtgatctgatttgcaggaaactgttggagcaagaggcgtttcctctctatgcacagaccaattccagtaggacttccccctagaagtgctctttaaggaaactctccttgaatttctatcactttcaattaccttttcttttagaaatgttgggccccagttccccctcagccactctgaaagccattcactataaatatgaccaggcaaacaaaggaagaagccacaggtaaagaggagacaccagatggctaaaagatgctaagctcagtgattttctcacagcttataagccccttggcttggctttctttcagttttactgtgattattactttataattaaagtccatggctgggtgcggtggctcacgcctgtaatcccagcactttgggatgccaaggcgggcgtatcacctgaggtcgggagttcaagaccagcctgaccaacatgaagaaaccccgtctctactaaaaatacaaaattagctgggcgtggtggcgcatgcctgtaatcccagctactcgggaggctgaggcaggagaatcgtttgaacccaggagatggaggttgcagtgagcagagattgtgccactgcactccagcctgggcaacaagagtgcaactccatctcaaataaataaataaataaataaagtaaaataaataaataaagtaaaataaaaaataaagtccacttactatgtagaaggtgataacgtagagtggttcttcccatggaaaagcccacataatctctggctgcccctcagcgttgttcccgtgacttcagggtgaaagatgcctgccaccggagaagttacacaaagtggttattttgaatgcttatgacatttccattatcctttggaattccgtgaaattggagcacatttatttttccttagtctttctcctgtatcataatgaaaagcagtgaaaatcaggaggtggctctttgtcacaaataaaaactgcatgggtgctaaatgaattttagatcatcaacccaagcagggacaaattagattgaaattaggcaaaattaacatccatgaacacagcagtgaggaaataagtcttttcaattgagcaggttcaaagccttcaaggacgggaacttctaagagcctctgggagtggaaaatcaaaattctgtgctttagattatttctgccccctgctggctatgtggagtagaacaatgtattcagccacttgattaagaaagtctgctttttcaaagataatatccatttatcatagcaaaaacataacataccctgatacactaaaatttttctcagtctcaactttattgtgaaataaatgcctctttttatataaccttaatctcacttcttagctcatttaatagtcttccatgtttttaaaaattggtaagtttataggtacaatttttcttgatatatgctgaattttatatcttatccacatagtcataatgacttatatcctttgtaaaaactttccctttcagaaaattttaataattgttcccaggaaatcctcttaaggatttcattttgtgaaaaatacttctggtttgctcagatgttataaaacctaaagattaagctgggcacggtggctcatgcctataatcccagcactttgggaggctgaggtggacggatgacctgaggtcaggagttcgagaccagcctggccaacatggtgaaaccccatctctactaataacacaaaaattagccgggcgtggtggcagacgcctgtaatcccagctactcgggaggctgaggcaggagaatcgcttgaaccccggaggcggaagttgcagtgagccgagatctcgccgttgcactccagcctgggagacaagagcaaaactctgtctcaaaaaaaaaaaaaaagaaaaagaaaagtcctaaggattaatactgtgttatgaatattcattacatactcagtatttccaaagtggctatattgtttcctgctggttattccctccaatattatctaatgaagtttcaactgctaagtacatggcagtggacaagaaacaatgaaaaatgggtctctggggggccaaaacagatacagaaaatccgcgggcactaaattttgcattttgctccaggataagccttgggccttgactcagtctttaataagcccaggttcctcttttccctgttcccagcaagtaaaaatggcaaaggataccagggatagccagggtaacaataattaataataacagtaataaggctgggcacggtggctcaggtctgtaatcccagcactttgggagtctgaggcaggtggatcacgaggttaggagttcgagaccagcctggccaacatggtgaaaccctgtctctgctaaaagtacaaaaattagcagggcatggtggcacgtgcctgtagtcccagctattcaggaggctgaggcaggagaattacttgaacccaggaggtggaggttgcagtgagccaagatcacgccattgcactccggcctgtgcaacagagcaagactctatctcaaataaataaataaataaataaataaataataacagtaataatagagtttctgagcatgagagaagagatatcaagccataaagagcaaatagaccctgagaaggaactaaggaactgtatttttgcacagtgatatatcttcaacatattatgtctcaaatgtaggaagtatgtataatacattaaacacattagggaaagatttacattttttaaatactgtttttactttctcacttaaataagaacatttcaggtatttggaaaacctacattatccaacaatgattattaacagtggtatcactgtcttatttgttgaattccaagtcatgcttttttttcttttaaatagaatcctcactattaaatgatcctctcctttcattctctattctttttaagtttcctcaagaaatggttttattttcttggctttggaatgattagcagggtgtggtgaaattgttgatttacgtgtttttgaaactgaatttattaaaacacaatctctgaaccttcttaggatcgacacacagtcaggaaaccagaaacaacagcatctttgtggcccctcagaataaaaaagtatatgtattgattaagaagatagcatgttggcctgagtacagtggctcacgcctgtaatcccaacactttgggaggcttaggcaggcggatcacttgaggtgaggaattcaagaccagcctaggcaacatagcgagaccctgtctctacagaaaatacaaaaaaattaaaccaggcattatggcatgcacctgtggtttcagcctcacggggccctaatgcaggaggatcacttgagcccaggaggtcgagactgccgtgagtcatgatcgcaccactgcactccagcctgggtgatgcagtgagatcccgtctcagaaagaaaaaaaaaaaagaagatagtatgttgaaaaatcctgatgatttacctgtttaccctataaaggtatactttcatgatctaaagttgacaataatgacaataatatgtgtcatttcagggccattgattgttttaattaccttctctttatgaaaaatatgaccagttaattatagctccaaataccccacaccagacccacaacaacacagatgcacacgggtgcacacacatacacacacacaggcacatatttcccccgtctagttctgtattctactgttaagtccttattgagaatacttaaaatactcactgtgaagagtgctttggaaaatcttaaatggataatcataaagggatattgttttcagggtgtagcttccaatagaaaaaattgggggtttggtatttcaatgatactttgggtgtataatcgggagaggcccctttatgatagggttcccatagttcctgtaaaaacaagggtagtgatgaatctatttgcctctcttataaataactgctcgtttttctttctgtttttctccttgaagacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatggatgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgttttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaa

SEQ ID NO: 2173 - DNA, 319984 bp, Homo sapiens; identical to SEQ ID NO: 2172

SEQ ID NO: 2174 - DNA, 1984 bp, Homo sapiens
tgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaa

SEQ ID NO: 2175 - DNA, 24829 bp, Homo sapiens
aggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaatagtgtttgtattttttctttatctggtttaacacatctaggaaaacataatattataaaaaatatatataatttgtaatataatttttttatgattacaaatactgccttttaaaaattcttacctggataccaaagcactttcacattttttttattgtaatcttgttttttgtaattattttatatttgtctggctttgagttttactgggcttttggttttttggaaatgggggtttatcccaatttagaaatttgtatccttgctgtaatacagtcttccatttttgttcccccaaatctttcatctgtcagaacgtcactcaaaggtgaaaatatttcccacataaaattattctgttcctttaatgaaatgagtttcagctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaa

SEQ ID NO: 2176 - DNA, 8873 bp, Homo sapiens
ctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagca

SEQ ID NO: 2177 - DNA, 9034 bp, Homo sapiens
tcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagca

SEQ ID NO: 2178 - DNA, 8403 bp, Homo sapiens
taaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaacccttataactgttcgtatttcccggaaacaatttactggttaggaagtataattccagttacaatgtttgctatcatttttaggtgacttgtgtctccatccgtaattcttgggtttttcatggtgaatagctagcttctctatttaatgaggagcataaattgagattaatagctaccttgtttgtcttcaaaagcttcatagagagtacaggctttctcctggtgacccactgaaatttccaaaacaataacctttccactctcatctgagttttgtcttcccaaagtgggctttttgcatttcctcctatttatggtagtttctggtctctcaatttatcattcctataaatatttgaccaagtgtctagaaggcatgtaggtgtttagttcacattactttcctttcacagttgatttttgatcttgtaggaaaataattataagatatcatgaaatattttggagttttattaacatactataaacttgcatcaataatgctttaaatttctacctctctgtaagtcacactgaagtagaaactttgttttctaggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtgatctgaataaaagagtaatatatgccttttcttgtagacatgtagctaattgaatttcatttaaaataggaatttagatctcttagggacagaagttaacaagtttgactactttaagaaactcaaatccatatttaagaactttcaaatattgatttaagatttttaatcaatacacatttgcccacttctaagaagttcccaattaaaaatctcatcgactttatttcctaaattctctattttctattagaaaatatttcaaagatacatctgtagtagaatgtgagcatccccagtgcccaatgcaaggaagtcactatagaatatctcttgaggaatcatggaataaatgaataatccaatggattctcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaatggaagatttaattaaaaatgcaatttctgtaggataaggaatgagacatttacataaaacagtgttctttaacctcctcttcttcacatacagcatatctaattctttatcacaacatgttttatggaggtacacagaatgtaggatactgataatagttatgtctttactttctttggataatgaaacaagttaatatttatcaaggaatttcagtcgatactaaatgttttattagtgtgagctcttattattatcattgatgtagaagactaaaaattaggtaagtattttcacaggacaacaggtatctttgacattatgcttctttcaatattgtagcctatactttatcaaataaaagaatataagaatattacctgttgagataataggaataagaaaaccattttgcacatttcgtgtaacaaacaggaccaggcatggtggctcgtgcatgtaatctcagcactttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgtctaggaacgctaaacataccctaggagttttcatctaagtacgagatgaatatactggatttgactgatgtttgcatataatcttttaaagccaggttattattaaaatgatcctatcatttatgaagtatgtacaaagtttccatcctgtagaatttacatgtattatatgaattaaaaatataaaaaatatttatattataacaatacagtattgaagccttattttaatctagtttgattaaactagattggtctagtttgattaaactagattaaacttcttggtctaggcacatgaatattgttgtggggaagagaattctgtataatgtgatatggatattgatccttctggagtgcctctaaatgataatgtgctgaaacctctgaaaggaccttttttaataacaaaaatcttatatttgtaatatgaatgtaagtattccatacatgtatatacaaatatggaccatacatgtagattacacatgtgtgtgtgtttgatgtgtgtgtatatatatgtgtgtgtgtgtttgtgtgtgtatatatatatatatctcttacaggaaaagcatttaattagagaaagaatttaatcttcagatgccatgccttacagagagagatgcacagttaagttactctcaaactgttgtgaaatgatacatcaacgtatatcttatttttcaaaaataggaactggggagaaggttggggtttcgtaccttctgacagagcgcttgtctttgtggataaccatgacaatcaacgaggacatggggctggaggagcctctattcttaccttctgggatgctaggtagaaaaccaagttctctatttttttaacacgtcttttaatgatggcaagaatattctgacatcctatgaaaatataattatgtaacttccaggctgtacaaaatggcagttggatttatgcttgctcatccttacggatttacacgagtaatgtcaagctaccgttggccaagacagtttcaaaatggaaacgtaagttttggagttgttcaatatatccttttctgaagaaaaaggaagcaatcttattctaacttaacatgacaactattaattatatatttattcaacaaatatttaattgattgtaaactggatacagggctgtgattttagtaatgtaggttatattaaaggagtaaaatttatattctccattgacaaagagtatgcaagctgtttcagagatatgacaaacatccccttagcccgcagggaaacaaaaaacaaaaaacagaaaaacactcaaaactaagagctagacacagggattaaaatatatacttcgaataagtacctacctcagggctgataggaagattatacatgccaacacttttagagaacttaaaacatcatctgcccgtagtgagaacaatataaatgtttgttaaatacttttaaaaagttatatggaatagaaagaaatgaatcaattgagctgagttaaatagggaaagtatcatataagaggaaggaaatgatatgtactaaagaatagaaatttagagagtattccaagaaaggtaagaatgagaaaaatatttgggagtatggtaaagacattaatctgatgagaagtttcaaaaaggaacagagaaattacagtgtaaagatatttggaaagctagtagaaggttttcttttaaactaaagggttcagaaacagcatcagagacttcagaactaaagcagaaattcctccttcctatgagtcacacggatatctagctagctttttttagattcctttcagtttgagaagtccgcactttgtatagcaatttattctattgttaaacagctttaatatttagaaggtgtacttttatattgagccaacttcttttaatttctactaattggtcttatttctgatgttaggagtcatagagtatttttattttttctattactataacatttccactttgccaggactgctgcatgctaaaaactcttagttttgttcacttttcaccatatgacatgattctaaggtcaacactgaaaaacttcctaagattcctctggattttttaatgaagattttttaaagtgccaatcagaaaaccataatatgaaaaatgtggtcaatttataaataatgttcagatgtattgttttgtacatttatctaaaaagaagcatgaatgattctaatatttattcagcacatgtcacattcaaggcattttcacatatattacttaatttttatagcaaaaaaaccaatattcccattttacaaatgaagaaactgagacacagagatattaagtgtattgattaaattttctcaggtactagtaatagagcctatgttttaatcctggtgtttctagtactaatgcccttcccatttcaatgacattgcatggcttaccacgatgttaagaagctcttgcaggccaggtgcagtggctcacacctgtaatcccagcacctagtgaggcgaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgatcatgccactgtactccagcctgggtgacagagcaaagaagcctttgcagttctttggaatgaaaaggagaggataaaaatttgttaccttgtttgaaatatgccagaagaaaaccagaggatagagagatgatgaagacccagtaaagggctataaacattaatgaaggcattggattctagataaagtcactgaatgcagagacacaagtaacaggattggttgggtttggtgtaaaggagaaggaagaggtaaatacatgcatagtaaaatttggctttttcccccctacttaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccactgcattttatttaaaacagttgaagtttaagaatatcaacgttttatatggtattgtgtttttaggaacatggttattttccgcaatgtagtggatggccagccttttacaaattggtatgataatgggagcaaccaagtggcttttgggagaggaaacagaggattcattgttttcaacaatgatgactggtaagtaaatatcaattaaaaataatattttgtaccagtatgttcttggtttattcttttttttctctgttcattgacttttatcatatctgaaaaatcatgtagtcagtggagcaagaagacaatagagatcaaaattgggcagaagcaaaaggatgatggctgttactccttcgttctttttttttcataagtgctttctgttgtaagcagaatcctttctgtgcacccttgcagtatcatatgcatatatatgatgcacatgcatatgctcacctacacatgccacaaaatcaatatataaaatcacaatcaatataaggattgtgaaatcattaaaaaaaagtgtcttataatcctgcttttttaaccatggagaaatgctgcctaggtactaaaatatctttatttctaactctttttctcaatgactgctctacgtagttttttggtacactttcttcacttctctgtctccttgtgacaaataacatttttaaagcacatgtatgaataatatgtatcttgtggttactgttttgcttcaggagatttgagttttatttttgaaacttctcattattggcctttcatctgtgattcttatatgctttacctgaagcataaatgattatctaagatatagctcagaagaccttggtgtaaacagttgaattgtccctgtccaagaccaactgacactcatacttagctcactctagtataaattatatttcactgatgaaaagtaaataaatacatcaatatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttcttcttaataagacttcactgcttaggtttgtttctacaacataaagttatgctgtttatttgtgttagtctgtattcttgattttcattgtattgaagatcaaccttaaattttattttacaggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaa

SEQ ID NO: 2179 - DNA, 8871 bp, Homo sapiens
tggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagc

SEQ ID NO: 2180 - DNA, 8849 bp, Homo sapiens
cagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagc

SEQ ID NO: 2181 - DNA, 58218 bp, Homo sapiens
  misc_feature (2675)..(52674): n is a, c, g, or t
tggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactggtaagggcgcgcccctccggagtctcccgggaaggcatttgggaagtgaccggggagggggagcgctgacaagagtaaaatggaaacgagtggggaagatggacttgtgtgatgagagctcccccatcctacctcttttttatcaaaatatctgctctgcgaagtggagttttaatcggctcgagtctggattagtcatagcactgcagaaaagggcaagtgagaacgacaaagcagaagaatggaaattagcttagttatattgagttttcggatccatcctgagagcctcacaacttttttgaatttggggttatttctcctggactcaagagtattcttacaaatgtgcatcaagggattttttaaagtcctacttcatttataagccaatgttaaatcgttcattaaaatagaggagaagctacattggtgacttgcgtaaattaaatgcagaatttcaactagaaaaagaggcttttcataaaaatttcccgatgacatcttttagggaacaattttttagggctgttaagagtacctgtgtaggaatttacacaattactttgttttgctttatatccaaagatattttagatttctcttcattaaaataggaatagcgatggtgcaagactcagtggttttaaagtttccctaggtgattttaatgttaatgtgcagcccaagttgagagttactgaattagaagaaagaccaattttgatcagtttaaatgtcacttatgcctgcaaattaaaaaaaaaaaattatatatggctcaatttaagtacatcaggtcatcgtgtatcagattagacaaaattagaatgtgcgatataattattaaagtaacttttaataagcattgaccagagctcttccttagcatagtgattcttttactgttgatttgtgtttcttttctgatggtttttaaaatccgtataatttatgtttaaaaatagacttctcccattgaacattattacaaagataaagcacaaaggaaatatgcaccttgaagaacgatttctctgttggtgaatgtttttaaactacgcattgttatgtatagaggaaagtttaaaatctttagatctgtcataaatgaaggaaataaatttttagttggttaaaagtgaccctctgtgtagaacaggtctttaaacttttggtcttttgaactatttgcatgtgtaaaacgtgtgtctttatatgatagaggttgcatagctttcatctcaagtctgactcaaaaagtattgaaaaccactggactgaaattagtaatcagttaaatggtcttgagttttcatcctttcccgtgattttattaacatgtcacattactccactggtaaaaagtcagatttctttgtgagaaactgaaattatattggaagtaatttgtaccttaactctgtttcagaaacatacagcttttgccacattccctaatgaaaaagcagctataaaggtatgactttttcttgacgattaaagttgtcaacaggatcctcttatacaatcttggttcagataatgtttaactgtggtttttaagaagcaaaagcgtttgtattccaacagtttccccaacagactacatttgatttgtcagttggcagatcttgcccagtcctttagtagattatctataaagaaaaactaactgcgtatgtaattaaaataacaatttctaaatgatttagattgataaatatctctgtgactgttacaaggtaagatgtttcaagtgttaaaaggagaatatacatttctttataatgccagggaatcattcacaggaggtgatcttttagctagaagtctaatgattaattggattttttcagaaggaaacaagtggagatgggccttctgggcttgcagaacaccaaataaagctgtgagacattggaagttataagtggagcaggagctaagggttgagatggaaatggaacttgaaaaatagatttgagtctgggagagaggtattgagtttggtttagtaggtggacacttgatacttttgagctggctcataatatgatcaggcctgttaaagatatctggtatagttcatatcatggattggatgtgcagaattattagaggtaggagaccaaatggaaggctgttataatggccaaggcaagaataactatctgaagaagacagtaagaagacaaagggggaagtaaatatatattcaatagagattgagtttgtaggttttataatataggggttgagagagaatagttcaggatatttagattgaggattgagttatttgggttgttatattagctgacatgaggatccagaggatgtttgcaaaggcataggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcactatattaggaatttaaaaatttggtttgtgtttctgactttagatcttagctatctgctttgaagagtcactcactgtctctggacatcacctgtaaaattatggttttaattagataatcattgaggttcctttctactccgaagttctgtaattgcttataataatataatgaactctaggccaggtgtggtggttcatgcctgtaatcctagcacattgggaggccgaagcgggggggatcacttgaggtcaggagttcaagaccagcctggcctatatagtgaaaccccatctctactaaaaatacaaaaattagccaagcatggcggtagacggctgtaatcccagctacccggggggctgaggcaggagaatcgcttaaacccaggaggtggaggttgcactgagccaagatcacgccactgcactccagcctgggcaaccaagcaggactctgtctcaaaaataataataatcataataataataatataatgaattctataattgcttataactggctgttaatcctttctatttttccattcttggttatgtagtagtagttgtttttttaatcacttgagcagatagtgccagattgtaaggaacttaaaaaattgagataaatagtaatttaagaagtttgcagccagtgcggtggtccacgcctgtaatcccagcactttgggaggccgaggcgggcagatcacgaggtcacgaggtcaggagatcgagaccatcctgactaacacggtgaaaccccatctctactaaaaatacaaaaaattagccaggcgtggtggcggacacctggagccccagctacttgggaagctgaggtaggagaatggcgtgaacctgggagatggagcttgcagtgagcggagatcatgccactgcactccagcctgggtgacagagtgagactctgtctcaaaaaaaaaaaaaaaaaaaagaagtttggttttctagttgctaatagtataatttttaaatcacatacttttatgatagttgagaatagttaaaagtatatcttaaacaaatactacctacttgtagaatcaattttagtgcagaacatgaaatatatttttagaaaactgaataattgacgtgcctatcaaatagtgtagtcacttttatttgaaatagcaaaatgttagattattcaacacattttcattcacattgaaactgacattctttgaatcaaaactgtttcttccttctaggtttgatatacgtttgatgaaagaaggtcgtatgaaaggacaagctttcattggacttcctaatgaaaaagcagcagcaaaagccttaaaggaagctaatggatatgtgctttttggaaaacccatggtggttgtatcctttaaatccatctatttcaaaactatataatttttagaaggatataactgaaattaattttcatgttaccctttagaaatttccacaattggcattctagcagtagatattcattcgttacaattaaacccaccttactgagtcagatgacagtgttatttagatttttaataaaagagcttcagcagcatgaggttgttcaatttcagccaagtttaaatgtttcacttatgcagctcaaaagtacataggcatgctaagagactagagtatccagaagtacatttggagtcataaaagaactaattcattttatcattttattgtaatttatatttctacatgagaattttaataactagagtatatcattgattaaccatcttgcttttagtagtcaatgcagtttgcaaactagaaatcagcaagataggtaaagaagcaaaggcccaggtataaaaaataatgactgtaaaggaaaagttaattattaatttcctctcaagtcatgaagagaggcaggaggcactcaaggtaaattaaaaaaccatactcccaccatacactagaaagtttttgagaattatttagaaaagattacttgcatattcatgaaggaaaccttaattttaaattattagcagtttgctcgatctgctagaccaaaacaagatcctaaggaaggaaaaagaaagtgttaaaaattaataaaggtaagtgtgaataaaacataataaaaagacaagactaattcttgagataaaattaagaataaaagtttgacaaggtagtaattcaggtatctctttttttttttttttgaggaaatacctatctgtgcagttaagtcccattaaacgtcaaaactataactacagattaaaacccatttatatgtgaaaattaagtttggagaatgaatcttataaggggagtgtgcctgttactctttttttaactttttctgcctatagtaaagcaatggttcttaaaccctaatatgtatcatatcacttggagagcctaataaaacacagattcgtaggttccttccttccctgaaagagttgatttggtaggtctgatgtggggacctagggaaactgtttataccagttttccttttaatgaggggatttccaggatgctggacatttagtgctgaaatggggaatgtgtctggtaagccaagacaggtcggtcacccttgttggcacctgaaaatttgcgagattaatgaggtttcaggtaatgatgaggcatcttatccagagaccacagcttgaaaactcctggaataaacacttacagatacattttctaactcttaaaattaacctaaagtaaatgttaaaataaaagttaaaaaaaaaagtcaaactgtcattaaaaataattctggctgagcacggtggctcacccctgtaatctcagcaatttgggaagtggaggtgggcggatcacaaggtccagagatcaagaccatcctggccaacatggtgaaaccgactctctactaaaaatacaaaaattagctgggtgtggtggcgcctacctgtagtcccagctacgtgggcggctgaggcaggagaatcgcctgaacctgcgaggtggaggttgcagtgagccgagatcaagatcacgccactgcactccacactggcaacagagcaagactccatctcaaaaaaaaaaaaaatctacagtgctgagtatataaaattattaacacatttcacaacaatatgtgtttgtggagttaaatattttttgtctttaaaacaggtaattttagtgcatacttaatttgatgattaaatatggtagaattaagcattttaaatgttaatgtttgttacattgttcaagaaataagtagaaatatattcctttgttttttatttaaatttttgttcctctgtaaactaaaagaacacgaagtaattggtcacaattactggtgtttaactgccaaatatgggtaaataagggaaaattttgtttaatatttagtccttctgagatggcttgaatatttgaattttgttgtacgtctatactgggtagtcacaagtcttataaacactttagaggaaagatggatttcagtctgtatttttaaacatcatttattttaaatctggtgctgaaaaataagaaaaaaattaaactgcattctgctgttcttctttagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataa
